United States Patent 10,900,036 (RNA INTERACTOME OF POLYCOMB REPRESSIVE COMPLEX 1 (PRC1)) - sequence listing, part 3

SEQ ID NO: 4798 - DNA, 1128 bp, Homo sapiens
gccgggcctaatgttaatgttaaaatgctacttaactattgaaatgcaagtttttcaccagctgaatataaaatcccattgcaataagacattttatttagacataaaatttcacaagaacacaacctggagcagaatagctgtctattgaaagaagcagccaggcgctgtggctcatacttgaaatcccagcactttgggaggccgaggcaggcagatcacttgaggtcaggagctcgagagcagcctggccaacatggtgagacaccggctctactaaaaatacaaaactagcccagcatgatggtggatgcctgtagtccccgctactcaggaggctaaggcatgcttgaacccgggaggcagaggctgcagtgagctgagatcatcccactgccctcaagcctgggccacagagtgagactctgtctcaaaaaaaaaaaaaaaaaagaaggaaagaatgaagctgtttaaatgtgtatcacaataataaacgtctatgaaaatgtttctacaggtatgctggtatcctcctgggcatcacaaatacatttgccactattccaggaatggttgggcccgtcattgctaaaagtctgacccctgatgtaagtagataatttacttgtaaactggaaaggttttggagctgcacatctgtgtcaaagttcagtgtattttaattaagtttaaaattctaaatgttcttatgaaattctttttagcaacaaaaagctaaatgccttaatggatgggaaagtatattttcaaagaacagtttttggattttagacaaaacaattgaactaagtcaaatgaagacactgtagctgaaaccacacaagtagttaaaagttgtgatattggccgggtgcagtggctcatgcctgtaatcccagcactttgggaggccgaggcaggtggatcacgaggtcaggagttcaataccagcctcaccaacatggtgaaaccccgtctctactaaaaatacaaaaattagccggtgtggtggcaggtgcctgtagtcccagctactcaggaggctgaggcacaagaatcgctcaaacccaggaggcggaggttgcagtaagccaacatcaccactgcactccagtctggcaacagagc

SEQ ID NO: 4799 - DNA, 1146 bp, Homo sapiens
tacatttgattactttaaaattatatcactctttttttttacattcactttagggaaggcttgcatattttgaactctttttttctttggcatttaatcatccttagcatttctcaggcagtcttgggttaatatggaaataacctttgtatacgttcttaatcttatttttaaaaatttttgcattttatgttgacaaatatattattgtgccacactttctatattaaaactagattaaatatattttacatatatttatttaaaatttttccagcacctatcaaaatacttttttgtgttccaattaaggtagtcttaatgcaaacttacaacttttgaactggaatattaaatttatacacttagatcttagaatttatggttaagttcttttttgttttttatttttaggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccatgctttgtctgattttatcactttatgccaataatttcaacttttggtcagccttgtaaatcttaggtaaggatcaaagaaatgattcttttgccactaaacttgtgaaagcaacattattgtgatgttattttagtgaaattttacttctaacagctcaaaattagtctcaacttctgtctcaacttgccgtttgaatgcatattgctttttccccctacccactccagtatatcttggaatatgctagaacccgggggtagtggaagcagattatctttggctcctggggtctatatttctttttttttttttttttctcagctatgtgagagtatgcttaaatattggatatatcccacagcttagaattaggctttagtagaatggctttgtaagatatttcagtatttgtttttttctacactccgagtgggttcaggtaggtttctctcatcaggaaccaaccaaagcaggacagttcctgggctccccagctatcatctaatggacccacaactgtttaacctaa

SEQ ID NO: 4800 - DNA, 1118 bp, Homo sapiens
cacttcttttgagtatacttttttattagttttggaagcacattcatattctaatcattcaaaattaaatcaacaaagataaaaagaattctaaaatgaactgcaaacagaaggaaaagaacccaactattattgtaagtgaataacaaccacaatgaaccagtaaagaaaatagctaaataaccactagacaataagactttgactaattagggaaatattaggaaaacaatttgactcaaattagggaaattaaactgaactaaactaaaaatctgtacctatatcttatctctgtccactaaacgacctaaaagtgatgatgatctagtagtaataagtatacctagctgccgaaattttggtttataaataccatttcccactataaaggattagacctccttggaaaaatggctcattccatgcctggggcagaaaaggtccaaggtgagcccagaatttattgttatgctgcaaaataagtagtgtaaaaaaaactgaaggggatgcaggagaaagattaacgagattcccactgaccaaatttggttcactttgaatatcaaatgaaatgtgttcaataataaattataactttttgtaaaaaatagtttattagctagatagattagataagtatctcttatagaaaaatgcagattgataaatatacgtggagtaatagagttggagaattattattttgcaattagcattttaaatatttcaagaatcatgaatcagtattaaatctaggggagcaaaatttgatggagattaggatatctgcataatttcattgtctacccatagattgcttattagttgcaaagcaaaaatagtagctattcagtgaggaaactagagaacattctgaccttgtgatcaaaattaacatcaccaataaagggtaggtagatgccgtgtgcctccaaatgggatattctgtaaagatcaaaatattttttacacagtatacctagaggtgggaatacattacttgaactgattatgaagagacatcagacaaaaccaaacaggaatattctataaaataattatccagggccgggtgcggtgcctcatgcctgttatcccaacactttgggaggccg

SEQ ID NO: 4801 - DNA, 1154 bp, Homo sapiens
taagacattgtatacaaggtgtagatactgatagattctggaaatgttagatgaaaagaaagccattccagggataaggagcagcgtgaggtaggaagttttaattaagggtaatataaattggagaagtcacagtagagatacagtgctataaatctgagttggggccacatcgtgggtggctttgaatatgaatctaaaatataagctctgagagcaaggggctgttgaaagtatattaacatgagaataacatgttttacactatgccttaaaaatgttaatttgactgcagtgtctaatttaattgacagagaagagacaaaaagcataaatagcagattgactgctacagttgaccaactaagagttgatgagggcttaatttatgaaagtgagaaagggacagatgcccagacatacttgaggatagagttcacagcccttgaccactaattgggtttataaggaggaggaaagggaaagaataatgaaaaaccaagattcccattactgtaagaatgatatgttgttaaagaaaaatagaaaaaggaacaaggatatctggggagtcactattaagtttagacgtggaattttaggtgttggtagaatgctcaggagaagggttaggacaaattgcaggaattttggaattcatttacacagataaaccacaagtatgtgaagcaaaaggtacagtgtcaagatgcgttaagaacaaaattttaggaaatacatttaaaaataaaagaaagagttggaagacaagaaatgtattagctgtttgaagactgaggaatggaagaagcacagcagatacctaagcaaagactgggagatgagacttgggtttggtgtaatgatatagtgaggccacactgaaagctctacatagagtggaggggtcagggttaaatgtgtgtgcataaattattggagtaagccaatggagaagaaagcaagccttcagcttcaacttttaccttaaaatatggttttacgaacaaatttttaaggaaaaaaattatcatggttctaatcttacatgttaacatttccttgttatgtagggatcagacttgttataacataattccactttataattcaatgaagaagaaagttttgtctgattctgaggtatgtaatat

SEQ ID NO: 4802 - DNA, 1177 bp, Homo sapiens
tatagtgggtagctttattttatgattgaaagatatttaaagcagcagttggaattttgcctttctctctgtaaggtttttggtaaattatgaaattcagcatagatgttaagtgttcttaaattttttaataacaaactatcagttcttaattcttaattattctggagatttactttacatcaaagacgcaaaacaaaatattttatacttggatgaatttttttattgttgctcaaagattttgaaaattaaaatgataaactgaaacctactatatttgtcttttacataataggtgaagtattacagacacttagcacctgatcacttgctgcaaatatgtcatcgactaggacctcttcttgaacaagaaattcctcaaagtgttcctggagtacaaactttattaggagctggaagacagtctttactacgcacaaataaaagtatgaaaattttctcataggatttagacattatttatctcacttttgtttttgtgttctttgtatgcataaaaatacatgtgtttaataggctgcaagcatgttgtgtggaaaggatctgctctggctgcgttgcactgtggaagaccacctgagtcaccagttaactatggtagcccacccagcattggtgagttgtttgagttcactagtagttaatagcctcttggtaaagagcttttgaaaatgaaaaggttttttagttactgtggtattagagaacttcatattatgtacatctgcattcaaaaagaaaaaaatagattttttttcttagtagtagttttaatagtgaaaaagtcatgtataatgagggattgtgcacattgcaccttatgtaggccaattagctcattggaattttatttttacgaaagttccatattaaggtatatattattaggtcgagttagtagaatcaatatataattcagattagttataatggtaggagacaaaagtagttatctttttaagagcacagtacttttttttttttttctttttttggctaaagtttcaaagagggagtactgatgcaagtatgtcttcttgagatgcctcctaggttcatgcctttcacatctgctactaccaggcccttgccttacccggattaatacagcatcatccaaactaatcttcttgcctatggtgtcttctatctc

SEQ ID NO: 4803 - DNA, 1192 bp, Homo sapiens
gacaggcatgtgctggtggaggtcaaagaaacaggaacacaagtgaaatcgaggtgagtgtcaggtaaggaccaaagcaccacgcctacctcatctttgcccacagaacacccattcttcccgtgtcctgtttcccaggacgtatccggggcggataagaaatcacccgtggggaggcggtgaactcctccgcaggggccgatgcccgggacaggggcggggaaggctaatgaggcgacttgtgcggggaggggccaaggaggagcccaggtgtcccgctcccgctcgacggcgcgcgcctgcgcgagcccagttggcgtcgcacccttgagcgcagcatccctacgccagcgagtcccaatactagggagggagggagggaggaggggcggccggccccccgcccccgcgcgcggccacgtgacgccggctgaggagattggaggggcggctgcgcgaggctgcagactggtgcagcgcactgtgctggcggctgggcctcctccacctcctcgtctttctcccgggaaccttgacgacgccttccgcttggccctgccttctgccgcatccccgccgccgcggcgccttgaggagcaggagaagacgcagccgggccgccgccgttagaggggttcccggccgccgctcgccccgtcggccgccaccgcctccggggtcagccctctctctgggtctccgctttctcctgccgccagcgcccgctcatcgccgcgatggggctcctggactcggagccgggtagtgtcctaaacgtagtgtccacggcactcaacgacacggtagagttctaccgctggacctggtccatcgcaggtaaagccgctgacttccccatcctcgctcggtcccccgcggggggtcaccggcccctggtctcgcagctcccgggcccggccccacaggcccccgcgccctgcggctttcggatgctgcggatcagcggaggggccggcgcgggcactgcggttgagcactggttaatctgatccgaatgttaaggcctcccctcccccgacactcgcagggttttcttctgagctccctccatctctcatcagctctcggatgcgggagctgacatatcagatggagcctgtgcagccaggagctcctcgcaggagccgccccaccctgtgctcccacatctcccgagctcgcctccctcttc

SEQ ID NO: 4804 - DNA, 1401 bp, Homo sapiens
ttataactgaagttgtatgttccttgagggcaaagatgtctgccatcttcataagttagatgttagctgagtcttaaatcatttttaaatacatggattttaatatatatctaattattatatttatataatttgtaatgtcttctatttattagcttattatcatctgagaatataaagtttcctaataaatatattttgtataggaatttacctaagactggctttatttaagaaaaagtaaagagataaagaaggccttgaaggctcatatgtatgtttattagtagctctgttatatttctctcatagaaagattgagttatatctcatgataggtaatgcttaaggccaagcttcgtgtttaaaattctttattatctctaatagtttataaaataatttcccaactgtaagaacaagagagaaataaatgtattatatttagaatacatcaaaatacatctactgatgtgacagtacatttaactaaaaaattgcaaaacagatttgtgttttttaatttcagactttatatgaacactatagtggtggtgaaagtcataattcttcatcctccaagacttttgaaaaaaaaaggggaaaaaaatgatttgcagttattcgtaatgtcagataccacctataaaatatattggactgttatactcttgaatccctgtggaaatctacatttgaagacaacatcactctgaagtgttatcagcaaaaaaaattcagtagattatctttaaaagaaaactgtaaaaatagcaaccacttatggcactgtatatattgtagacttgttttctctgttttatgctcttgtgtaatctacttgacatcattttactcttggaatagtgggtggatagcaagtatattctaaaaaactttgtaaataaagttttgtggctaaaatgacactaacatttcaaagttgtaaggttgttttctttaagcaaatgtattgttggcatggcagcaaaattcttaattagtaaaaagtagattagggaagatgtgagactagaccttagtaaatgaactttgaaaaacaaatcctgaagggtttgaattccaaaatagacttcctaattatttccggcaccgataacagtctataattttaggactgaacttggctctttcagatattcataacgtctgttgtttttggtatttagaatatcatgctggattctgtgttgtaagctgtatagggcatgccctcactgtatgacttgctaggtaatggataattgtaaatgtggccccagagtctcttgactgaatctgatagcttaaagtatcctcacatagcatccttttctcaatttttaaaaaaagattttaagagattttattttttatagcagttttaagttcacagcaaaa

SEQ ID NO: 4805 - DNA, 1162 bp, Homo sapiens
attttaatttgacatttattatgtaaaggaactgcagtgttcctgtggttctgcttttattttagacattaaggttgaaaaatgatctttggatcctaaagtcagctggagtagagggaagaagtcagtttctttcattatcacttggggactttttatccagatggctgtaagagccttccaggtgcatgtacctctattgcaaagcaaaataaacggaacatttaattattggagttcccactgttaagtctagctgctgctgtaacatccattgtgggaggaagtgcttgtcccaggtacctatgcaaggcttcaggccaaaggcctctagcaatagcactgtcctccatgggacaccctctgcctcactgcacaatatcaactgccagaaccttactcttgtcattttctctccatgtcagaaaaaattcccgtacttaaaaaaaaatcaatcattcctaattccccaggtaaatggtgaaggcattctccttgtaaaataatttcaaatcacagggtcaagttcaaatccgtggactaccatttctaatttcactcccgtctgtataaccactgtaaccaggttgctgtgtatgtttccagacctttacctacgcatatacatatatttatatatgcccctggaagtatatacaaaaactattgtgttttcctttttcttttcttttcttttttaagacagagtcttgctgtgtcgcccaggctggaatgcagtggcaccatctcggctcactgcaagccccgcctcctgggttcacaccattctcctgcctcagcctcccaagtagctgggactacaggcacccgccaccatgcctggctaattttttgtatttttagtagagacggggtttcaccatgttagccaggccggtctcgatctcctgaccttgtgatcctcccgcctctgcctcccaaaatgctgggattacaggcgtgagccactgcacccgggcacgtttttcttttttttaacataaataatgtcatataccatagtgtccttctgcaatttatttttcaccccattatgtcttctcagtacatatagatgtatctcattctttaaacctatattccataatgtatttcatgatttatttcgtcattctattaaaattattttaaatttttcttt

SEQ ID NO: 4806 - DNA, 1218 bp, Homo sapiens
tctgaatattgaaaaagatactgatttaaaaattaggtcaaaggggttgaatcactaggtatcatgcagagacatagcattttgagtttgagtataatttaatagaaaattaaattctatccacaaaattaatagcatgtgtaaaggcactgagatgggagggagcaagtcttgaacagtggacaattgcctaggttttgcttagctgggacagaagtgtgaataagattgaaggaatgggtctattttatgaaggctttatatggctaacagcttgcatttcatgtctaagaaaatgaatatcacaattatagcagtaataagagcacttcttatacgctaagttaacactgagctaaagagctttccagggattatcaaatgtacttttctgagcttccagcagggaacatgctccacctgctttttcctgtgtaaaattaattggctcttggagaaggtgaaggtagtgaaaataggttgttgacatagtccaggtataaaataggcatgaattaaagaccattctgaaaaatgcacatttgtagactttattaaactgctccaaatgaaatcgcacaagtacaaacttgtgtaattaggaagatgatggtgctgttgacagtaatgaaggaaaacaaggaaattcagaaaataatagcagtgcttgacagactttacagcatttcttggagtgatattctgacaacagaggtactgtgaaatggaaagtgaggagaggtgtagtaacagtttatggtttatcagtattttggagggtgcctatgttttgtagagattttttacaataattaagcaataccttattttggttcttattctattacgtgcttcagaatctgcaaaaatatctagagttaattctctcttacagaattaacacctcagcaaagttattttgttctttcatgatgagcattattaatattgttgttttgttaccatcttaaccttaaaacatgagaggggatggacattgaagggttgtaggagctgggggaaggtctgctgtaggctgtaccccatttttctctgtaaagtatcttgatatcctcaacattaattctagtttactttgtccatcaagggagttaacccttgtgcaaggctactttctgtcaccattctttcacagattttggaaactgatgtgcacagatacatgcatggtctgtgtccagggtgaaccctttttta

SEQ ID NO: 4807 - DNA, 1189 bp, Homo sapiens
cagaagacccagaaaggttgtggcttcaattccctttgcaactgtgccactcttacaatttgatcttgggcatgactttcaccacctactctactgcagctgcaggaaaggatgatttcctcaaatgctgatataagcccttgacttttataatgcacattgattgtggctgacctgagccattaattgtctttatttcaaggcatccaaagcaattagtaaaatccagtcattctacaatattaataattacctttgccatcatactatatgaataacccctcacattccacctgtacctctgcctaaccaatctcatgtgagaatcttagcaattgcattccactggttatcaccactccatctctttcagcaatggggtcttcattgccatcttactgatgagttcttcagttcccaaatcctatcctaatggtctgctttctagggataactctaatactatctgtctttcccagggttcccctgaaaggataacattaaacatagacttgaatgaaagtaatgtatttggaaatgagttgtcaagtagtagaagtgatgaataaggacagtgacgggggagagagagagagagagagagagagagagagagagagagagagcgagcgagccaatacaagaatgtatcatcaaaccattgctgtgaacaactggttccaaatcacagcagacattctgaaaagtcttatgaaatgtgtatcaatactgtctaccctagggtgaaaagcagaaggcatttattcatcggttcctccccacactggtcaagggttagcccacagaagttaagtcccttacacttccgatgtgcaagctttgagtgctgaatgggttccctcaagtatcagagaaaccccagggagtggaaagcaagaggttcacatgcaggcttaaggcaggcacacttttgacttaatctgtgaagctagtcaagcctgagcgaaactggtcccagcagcagtgacaagagtaaaagacgaggccatgaacatgtgaatgtgacatataagacagtccaatggagcacacagaaaagtagagtatcaaccatcaaaattggaactaataaaggaccatcggttagaaaatgactctatatggcctatttatgcttaagactacagattgtgactggaaaaatacttgtttctggctaaaagatatt

SEQ ID NO: 4808 - DNA, 1956 bp, Homo sapiens
ctgggattacaggcatgaccgctcccagccctaaagtggcaaatttgacagctaaatcaattgtaaaaattctgtaacaggtttattgggagattttgaagatcatgaagaaataaataaggttcataactagagatttgtggtattttgggatgcctatattgtcatcctgatcctctgatcattactactactaaaacttaatctagtacaaataattctgtattaaagttatgtgaattatgcgaagtaaactctggatttaaactgttacaaatggctaaatgcctacttgttaactaagtaatttgatttaaactctaatctctgtctcttttttaataggtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcggggtacgtggtgcgaggggtggccgcggtggaaatgtaggaggaaagcgcaaagctgatgggtacaaccagccagattccaagcggcgccagaccaataatcagaactggggctcccaacccattgctcagcaaccgctccaaggtggtgatcattctggtaactatggttacaaatctgaaaaccaggagttttatcaggatacttttgggcaacagtggaagtagaaacagtagggcctctgtaaaattggagactgataggttgatcagaaactcaccctaaatctgaacgggtgccgctataatttgtgacatctggcaagatttccctttatgtatatattttaacaatccgcttggacacgaacaaagccacacttctaactgcttctggcgaactgattttatttttaatttttttcaataaagatattcttagatactgaaagaaatagttaatgagtttgcatttgtgcttgagaaaatttggctcaagtccatttggctgtagtgtcaacgatgtttccagtagtgtttagatttggtgtcttcaaaggtagttgattaaaaccaagtgtgtctttaatatcttgtatcagaataactttgtatgttaccaacttaaattgctagaataaggtaaattgatacacaactgctatttttaatttagaactttgacctaatttgggttttcaaaaccattttggctacttgtattctttatgctgttgtttatttcaataaaaaattcacacctaaatgtatacttactaaaattgtgtttacaattcgtttttcacaaaatttcctgcaaatttggttcaaattgtatagcatgtcaaggccaattaaagggttttgtgccttgttaattcttgtgtggaatatgtctgcacattacacaacactgatttattgcagttttctgcttctggtttaaagtgctattttacaacagacttcatgttcccatcaaaaataaaaagataatacatgtagtaagtttaagttggtaagtattttagagttcttaattgtgatgaatgaactgtataaaaggacaaattcaggtagtctcaaagggtttgcaggtcacactgacaagtccactttcagttgcctaaagtttatcctaactaacctaaaactcagattgagtatattgccctcttgactgttttgcacaccatgggactagaaagcagcaaagaaactctagtgtgaaaacaatgggaataggt

SEQ ID NO: 4809 - DNA, 1148 bp, Homo sapiens
ggggaaaaagtacagttggatttagaaataaaagctgtttttttaggcttaaatatttgaagcctgaaatttcttattacaacttttgataagaggaagggaagatggaaaaatagatttaggtgctggttaacagaacggcagagatcttgctgatcttgggatcagttttccttgtatgagaataactggttgatgggatgaacttaagtaaaagttaagtttttgaggaactggcagtttttgaatttaagctgctgcagatctgatttctaattaatcaagtaaaggatttaataaccttttatttgcattaaattggttcatgaacttgtccaatgggtcttgttaatataatctgttcctcataattcccttgtatgggaattaaggtaaactactttttaaaggatgatttgctcttgtgtatcttttataattaactgttctagttgtataagtaatttaaaaacatgatgcactttttcccctttcagtataataatcatgaaattcgttctggaaaacatattggtgtctgcatctcagttgccaacaataggctttttgtgggctctattcctaagagtaaaaccaaggaacagattcttgaagaatttagcaaagtaacaggtaagttggatttatttggaatgaggtgcagcttttaataatgaagattaatagcatatttctgtgcgtcatgcattgttctaaatacatttattgactcatcgaatcctcactacaacttttgaagtgtaggtaaccccatttttcagataagaagaacaggcattcagggatttgggaaataacttgccaaacgttgtacaagttagtagggaatacagctagggtttgaattcattctgcaaaatcattgttcttcctatgttttggaagatcgtatttctttgtgtgttctttctctaggtgttagttgatgttcttagtagaattgtttgaataatgatttgatgttcttgaaattacaggagtagtaagtattgccgtagcagagtgtttttttttttttttttttttggagacagtcttgctttgttgcccaggctggagtgtgctggtgtgatcttggctccctgcagcctctgcctcccagattcaagggattctcttgcctcagc

SEQ ID NO: 4810 - DNA, 1143 bp, Homo sapiens
tgtatttttagtagagatggcgttttgccatgttggccaggctggtctcgaactcctgaccccaagtgatttgcccgcctcagcctcccaaagtactgggattacaggcgtgagccaccgtgcccagccaagccatggccattatcattttaaggctgccttctgctgttctgctttcgtaggggttgaaagcagcccatttatgactgatgctttcttttcaggtagggtgacattgagcaccttaccacccagttgcccccatgacagtattctaagaatgataaaatagattttgcttggatgagcttgtaattattttttgactttgtaaattatttacatgtcttttcccattagaatatgtatatatttttcctttttccctaacatttagaactgtgccccattatgtagtaggtgttggataaataacctgacttgctgaccagtgctctctaatattcttatgtaactcatggaccatttgctgttttaatagcctccatttacaattctgtgctacttactgccctgtgattaaggtaaattagtaggtgatgatgctttcttcccttacctacctaggggttgtttggaaatagacatgttgatttaaagaccatgaagaagggcaggcaggtgtgtttatgtatttgtgtggtatgttgctggaattggagcccaaggctggtgatgctgcaattccatgacaatcttaaataacggaaatatcctgatgaaatgctaataatgtctatgtacaagcattggaatagatgaaatctgtttgcacgttacgattttttttgtttgtttgtttgtttttgagatggagtctcgctctgttgcccaggctggagtgcagtggcacgatctcggctcattgcaagctccacctcctgggttcacgccattctcctgactcagcctccgagtagctgggactacaggcgcctgccaccacacccggctaatttttttgtatttttagtagagacggggtttcaccgtgttagccaggatggtctctatctcctgacctcgtgatccgcctgtctcagcctcccaaagtgctgggattacagacgtgagccacagtgcccggcccacaagttattttaatagctctgatggttctga

SEQ ID NO: 4811 - DNA, 1374 bp, Homo sapiens
ccaaactaaaggagtaaacctgttgatttacaggaataggaactgttgcatcgtttgaaatttacttttttttgttagatacacgaaaaaacttccagaacatctgggagaatatttaatggaaaatcgcttggttaaaacctgacacttttaacaggtatgtgttgttttagtactttatgattgagcatagcatttaatccacacctagactaaatcaaattttttttgtcagtgaacagcgttctgagtgtggacgagtagccagtgaagataatgaatgtcgaatgtgactgactagcagcttcattttgaagtaggttgtatggcttaaaagttctgtagtatttgtactataatacttgccttttagcattaccttggtttgtagtcagtgtcacagaagtgcagtttaatgtattatgtgtacatatacaaggtctgattggtctaatcaatgatgaaacctatcccgaagctgataacctgaagaaaaataagtacggattcggcttctgagattaagaccagtaattcagaggtggagtaaattttgttgccgtgattttataacagttgtgttataaaatcctgggttttttttttttctgccaacagtgagggtcgctgtctgcccattgatagaggccagattgtcttggaagttccaaagttgcaacgatttctgtaagtggagtttttctgtttgcttagagatcagtgaatattgtgtccttggtcttatctgtgatgatcttatcccgaacctgaacttctgttgaaaaaaaaaaacttttacggatctggcttctgagatggaccgttataaggacaatatttttttttaatacttttaatgcttttacatatgttgtaatgtttgtagtcttgtaagaatctcgtgtttttccttttctagggctagtgccacgaggtttacttgactgttgtgtgaaaagctgataagaaaaccatccagaaaaaagctcttcgttttacaaacatgaaaataaaacatgtaattttggattatgttcctttttgttattacttttaaataggtcctgaaataacatggggagcattaaatggaaaatccactaaccagccttgtaatcaaattactgtgagtgaatgtttcgggtttgtgcagggtacaatgtaagggtttttggatcagtgtaagagtggagagacaggaattagaagtaattgttactaagcaaatcatggaatatttagttttgatgtaactataattttgaaagcctggatgcttaagttgagaaatgggggaatgagatacagaaaataaggagcacaatagaataataatagcagtttattaagtatggtcatgagggaaggttactg

SEQ ID NO: 4812 - DNA, 1374 bp, Homo sapiens; identical to SEQ ID NO: 4811

SEQ ID NO: 4813 - DNA, 1374 bp, Homo sapiens; identical to SEQ ID NO: 4811

SEQ ID NO: 4814 - DNA, 1193 bp, Homo sapiens
aacagtaatccaaagttttagaaaaaagaaattcctgcagtaactagaaaaagttgtcagtcttctctgatttaaatgtatattaagtactattaattatgggtccaggtcaatcatgataaatatcagtaaagtttaaaagaaaatcttgttcagtaactcactttactaaatctctgtactcatgataaatatcagtaaagtttaaaagaaaatcttgttcagtaactcactttactaaatcttaatgcttagccagatcttaaactggagagtggttgaatgaacccactctgtggtcaaatgtttgatatttggccaggtacagtggctcacacctataatcctagcactttgggaggccgaggtgggcggatcacctgaggtcaggagtttgagaccagcctggccaacatggtgaaacccatctctactaaaaatacaaaaattagccaagtatggtggtgcatgcctgtagtcccagttcaggaggctgaggtgggaggatcacttgaacccaggtggcggaggttgcagtgagccaagattgcaccattgcactctaccttgggcaacagagtgggactctgcctcaaaaaaaaaaaaaaaaaaaagtttgatatttgctgttgacttaatgtagtttgatgctccagattaaaagctgtgtttactacttagctgtttccctgtatgagtagttgcaacattaaatgcctgtagaccccaggcatgtaaattaatgacttggatagagaaaggacagtggggaacaagagagctcttaccctaattcaccaactgctacctatctgcttattactgccatatgggaatgctggccggtgtttgctgagtcttttgatttttcagtgagaactaggtccagttgcttgtgtatagtgtctcaattttgaaatattggcaattaattcaaaatatctgggggaaaagaccctaaaagactgtatgagccaaataaaacatgcctggggaatttattcttagatattttgagcattctctagtttgccagttgtacatgaaaaacaactctctgatagtgagttttgattctttaattctaccgtggtctctgtgctttcatcattattcacatacctgcaagttgtacagttatgaatgcatttggaaacaggtgtacaaatggtcagcgtggctagggaagggaa

SEQ ID NO: 4815 - DNA, 1208 bp, Homo sapiens
tcaagagaaactgtaacttcaaataatatttaattgttaaaagggaaaaaagaaagtatgatctcaaccaaataggaaaaattcaaacaaaaccctgttttcttagggatgcttcagaaatacacaatggataacatcattttatttcacgctttttaatttgccaaattaaactttgcatgtttaaccaaaagtaaaagaaaaagttaaatttaaaaatctcttaaaccgttcaaatcattgaagggtttaaataaaacagacttgattaaatgtttgtgctatgtaaaaagataattaggtgttattgttttgttatatagtcgtgtgttgcttaacaatgggatacattcatagaaatgtgtccataggtggttttgttattatgggacatcatagagtgtacttacacaaacctagatgataaaaccgactacacggacctaggccataaacttgtgcatcatgtaaaataccaaatactgtatttgtgcaattgtgacacagtggtatttgtatcttaacatgtctaaacataggaagggtacagtaaaaatatggtattaaatataaaagatgctatacctgtatttaccatgaatggagcttgcaggactggaagttgctctgggtgagtgagtggtgagtgcatgtgaaggcctaggacattacactactgtagacattataaacatggtacacttaggttacaatgggtttataaaaaaatatttttccttgtatcataacttcagaataaaataataaaaattaaaaaatatttttcttgcctggacatggtggctcacgcctgtaattccagcactttgagaggctgaggcaggagaatcacttgagcccaggagtgttagggctgcaatgaactaggataacactgctgtacaggatcacactgctgtactccagcctgggtgacacagcaagaccctgtctctttttttttttttttttttttttttttgagacagagtttcactcttgttgcccaggctggagtgcaatggcacagcctcagctcccacctccgccccccaggttcaagcgattctcctgcctcagcctcccaagtagctgggattataggtgcccgccaccatgcctggctagagaccctgtctctaaaaaataaatatttttctttcttcaatgataaattaaccttagctgactgtaacatttttatttta

SEQ ID NO: 4816 - DNA, 1155 bp, Homo sapiens
tagtgacagcagatatctcttcaagttccataggtttttcatgagatggcttcgaacatctaataggttaaaaagtgaaggcatatgcatagaagacagactatctaaattacatcttatctgttggtgcaggtgctttagcgtagaccctgacagaatgtcatgttctgtggctctcatgaaagctaggtgagataaaaagtgttcatcgtatgtcagagtaggtagaatatgggtagagtgatttttcttacttgttacaaggtgaatttgaggggagggaaagagaatgaggaagagagagactgaatacagaatagcatgttagttgggaaaaaaagaaaatgtgtttacttaaatagaagtatggaactaaagagattgcctgagaactgggacccgatatagggaccatgaaagatgacttacttgtgtctttgtaagccaaaaatagcattagaactacctatctcattaggcctattatataacatacctactttgtgtgatttgttcttttcagctaagatgtgatacagtggtgagtgaaatcagtactggtcaaaggactgtaaatttcaaaataaacagagagctcttaacaaaggtaagaataagttaatatccagccattgtgctttcattctgtctgcttcagccacagtggtcttcctccagtttttaaattctttatgcctcctctggcctcaaaacctttgcacatactgatccataacttggagagtaccaccccaagttaacacctactcatcctttaaatcttgatatttctttggcagtagctttctgaccccttcatttatatgctctcatagcactgtatagtcatataccacataatgacatttcatacacaacgtgtatagatgatggtcccataagacaataccatatttttactgtacctttctgtgtttagatatatttaagtatacagacactattatgatacagttgcatacaatattcagtacagtgacatgctgtacaggtttgtagcctaggagcaataggctgtagcatacagcctaggcgtatagtagactgtatcatctaggtttgtataagcacttgggaggctgaggcaggaggatcacttgagcccggaagttcaagaccagccctggcagcata

SEQ ID NO: 4817 - DNA, 1174 bp, Homo sapiens
agcaggtagaatcatgttatgtagagtcttgctaactggctattttttattgttactttacatacaggcatggtccattacatgaatttgagaagtttggttgaagaatggaaactaccatgttaacttgccataaatgatgtacctacaatacaagtagagcaaatgaaagattaaaggttacatttttttaaccttttttttttttttgaaaaaagagattattgtggtatttggtttttattgcatcattgctcagcagaaatgctatgaatttagtttttttttttttttttttttgagatggagtctcactctgttgcccaggctggagtgcagtggcacaatcttggctcactgcaacctccgcctcctgggttcaggtgattctcctgcctcggccttgtgagtagtagctgggactacaggcgcgcgccaccacaccggttaatttttgtattttttagtagagatggtgtttcaccatattggacaggctggtcttgaactcctgacctcatgatctgcccgcctcagcctcccaaattgctgggattacaggtgtgagccaccatgcccagccaactttttcatctttcaaaactgaaactcattaaagactaccccccaagcctctggcaattactgatctaatttctatctcagtgtcagaaaggaacattaaaattttaaggaaatatagatttttaaactcaaatttgaactgccctcagtttagagaaattatagattttgaaggatgaaatggcagagaagatgaagtcacagtttgggaagagaatcacagatttttgttgcaagtgaaatacgtacttgaagttttggttgttgcttttggaaagcaaatcttgtaaactctttaagcatagtgctttcaagagtgtgtgattgtgataaaagggatgtataacacacagcatatccaaaaatttagaagacatatttgaatcctagaactatcctgaattttctgttaattggccagagtctagataacctggtgttgtgggagggacctggtgggaagtaattgattcgtgggggctatttccccccatgctgttctcatgatagtgagttcttatgtgatctgatgcttttataaggggcttccccctttgcttgacactcattctcttgcctgctgccatgt

SEQ ID NO: 4818 - DNA, 1231 bp, Homo sapiens
caagaccctgtcaaaaaaaaaaaaaaaaaaaaggaagaaagagagagagagagagagaaagacagaagaaagaaagaaaagaaagaaaaggaaagaaagagaaagaaggagggagggagggaagaagggagagagggaaggaaagaaggaaagaggaaggaaggaaggaaggaaaatttaaaatatttattgtgacagaaataaaaatttgaaattgaaaaatataagcacatttaagacaatctcccagaaagtaaaatttaaggatggagaatttgaaaagaaggaaaagagaaagaagatctgtccaggaggcccaatatttcaaataggaatttcagacagagaaaacagagtaaatgaagagaggaaattaacaaaaaaataatttatgcaaatacatcagaactgaaaaacgtgagtctgcaggttgaagtagctcactgagtgctcagcacatgtgtgaaatgagtcctacatcaagaaatgtaataataaaaagagatgatcattaacacctttttaaaattgcttcttggctttttgcctaagatcaagtacagtgtctcttcttatcagtttaatatctgatacgtcctttgtctgaggacaatatattaaatggatttttggagcagggagatggaataggagcatgctccatccactccacacatagacctggtattgcagtacctccaggatctgtgctctctcaccccacatgctataaactaaaaaaaagaggctgggcgtggtggcttatgcttgtaatcccagcactctgggaggctgaggtgggttgatcacttgaggtcaggagtttgagaccagcctaaccaacatggagaaacccagtctctagttaaaatataaaaattagctgggtgtgatggcatgcccctgtaatcccagctactcagggaggttgaggcaggagaatagtttgaacttgggaggcggaggttgcagtgagctgagatcatgccactgcactccagcgtgggtgacagaatgagacttcgtctcaaaagaaagaaaagaaaggaaggaaggaaggaaggaaggaaggaagaaaaaaaattaaaatattattatttatttatttttgcagtttaaaacttatgcattgtttatttctggaattttcttttaatattttgggaccttagttgaccatgagtaacacaaaccacagaatgcaaaacagtggataagggagggactactg

SEQ ID NO: 4819 - DNA, 1149 bp, Homo sapiens
gcgtcatatgagaagaaagaaatccccaccacctcaacctctgctgagattgtgtgctaggaacagccttccctccgtttcccctcagtcaaacttgagccagcctctggatcgatgtgatcttattgcatgtttccatggggtgtacctatactttaagccaatcctgctgcattcactgctaagttaaataaaaagccaagaagattttgcactgtgcagatcctttgctatctgacttgcatctcttcccccacctgtcagctagccacctgcttgtttgtgttgggatattttttagcacctgaagcaccatctgaaaggggcaccattttcttcttccctttgatctcacatatgctccctaaaaatccttaagttgtcaatctgatccccagtgtgaggttaatgagcaaaattggtctttggggccctttttgtccaagccccactgaaaggcctcttcagaaaactattatctttaaagccctactttaactccttaattccagcatacagctaaaactggatgtatattctggcaagtaaaggctgaggactcctctttaatcctcagatctagataactcatgacattttatttgaccaacatagcacatgatgagatatcaaggtaattaaaatagcatgcttgaaaaaaaaatacgtaatctgtttcacctgtaactgtttaagccaataaacttttcaaaatttatgtaatgtggggcttttatgtagcactttacgttttcatgctgcttattgttttattctactgaaaaaaatgaatttcaagattctcaacttttttaatttcaaaaattgtttattgttttgactataggaatacaaaatttcctattttgggagaataagaactctttttgtcatttttggctatgaataaactttctggtcttttgagaccacccatttttatagatcagaatcagaaaacaggtaaacctcactcacacatttggactcatttgaacaaaaatctaggccaaaatactgaaaagcctatgtgtttttttaattggaagtatatgtaaggttaatgcatttagtgaacgtgactaacaaagactaatgtgcacattaacagatgtactttttaaggttttatgggaggctgtgcattgc

SEQ ID NO: 4820 - DNA, 1124 bp, Homo sapiens
catccttgagtaattatttcaaagggattaagtgggaaataaacttcctaagtccttgaatatctgaaaatatctttatttcactctcagatttgaaaaataatatgattggtatattaatgagttcacagattttttttccttttgtctttttaagatctgttctgttgtcttctcatatctgtgttgttgataagcatctgatgcctttctagttctttcataggtaattgtttccccctctaaggattttattgttatccttgatttaaaaaattttttttcacttctctttttgttcctatagatatccttgatattttgaagttacactatgatttttttttttaggtgtgggcttgtttttaagtttctccattttattttgtgagtctgttcattttgagttttatcttttgttaatttaggaaaggcttctctattatttagttaaatgttgcttcctccccatattctgcattctctccttttggaacttctttagtaaaataatggttcttctgaatcttattcctgatgccactttaactttgatttcatactttccagtgctctattcttttgtactgcatcttgagagactttgactagccagtccactatttccatcttcatctgtgtttattctgctttttaatccatacattcatacatttttattgccaagatctatatacccctttttcataactgctcttcctctgaaactgtctgttcttgtttcatgaatgccatattttcttacatctctgagtctctgaagtatatttagcttgacagtttgctgtgattctgttattaactctgcttcttcaggtgtacattcttacatttgttgagtctatgttgtcttccataatcttggcattactcgaatatttgatgttcaaggaaatgttggagggaagatggtactgtatccacctctgatagtgctcttctccacacattgtagtgagagttaggagaggtgagaggactttgagggcagtagtggggatgcttccttgtccttctgggcatcactagcactgggggcactgccttccttctcatgcccaacctcctccatttactgctttcacctagaagatatcctagtg

SEQ ID NO: 4821 - DNA, 1222 bp, Homo sapiens
tatctttttaggataaattcttagaagtgaaatcgctgggtcaaagtatatttattctaggtgctgttaatgcccaactgcccatcaaaaaggtaatgttgtacctaagtaaagttgtgagtggatttttcactaccctcaccaacatggatgttgtccagtcaccctaatctttactagttttatggctttatatatatgtttacatttatatataatgcatttctttgaagactgagtttgaaaatcattgtgtaagttaacgcctgtgtgtgtgtgcacgtgcacacacttatgtgttttccttcaattagactgaagtcttctggggacctgagcctaaataatttcaggtggatcacttgagatcaggagttcgagaccaccctggccaacatggcaaaaccctttctgtactaaaaatacaaaaaattagctgggtgtggtggcaggcgcctgtaatcccagctactcgggaggctgaggcaggagaatcgcttgaacttgggaggtggaggttgcctggattgcaccactgcactccagcctgggtgatggagtgagactctgtctcaaaaacaacaacaacaaaaaaaaaaaaaaaaaaaaagaggagatctaggcaggaagttaattgctggagttactagcacctggaaggtcattgaagccacgagactggatgggacccctagagagtaagtatatatagacaggaggcccaaggactgagcctgtggattacctaatgttacagctggggagaggaggaaaagccagcaaaagaatgtgggaaagagtggccggaaagttaggaaggaaataggtatgtgtttatctgtgtgttagtgtgtatgtgtgggtgtgtgtgtgttttactgaaagctgagcaaagttaaggagaaaggattcacatttcaaatcctggatcaagttagtccaggagtgagaactgacatttgagcttagcaatgtggaaaacaccaagaccttgataagagcaattgtagtggggtggccgaaggaaagcctgactggagtggcttcaagatagagaaggagggaggccgaggcaggagaattgcttgaacccaggaggcagagtttgcagtgagatgaggtcacgccattgcactctagcctgggcaacaagagcgaaactccatctcaaaaaaaaaaaaaaaaaaaaaaaaagagagagagagaaggaggagagaaagtg

SEQ ID NO: 4822 - DNA, 1195 bp, Homo sapiens
aggacatatttctctaaattttttccttgcatttaaaaaatacagtgatgctcaacttcgttaacaaaaaatgaaatacaaagtaaacaaaaatgagcatcccccactttagctcttaaagataaaacaaaaacgtaaaaacagtagttatatccatgttggtggccacatagcaaaatgggtactctcatacaatgttggtaggaatataaattggttcaaattgaacatctcaaacctgaaaatctgaaatgctccaaaatccagaaatttttgagtgccaacatgacgctcaaaggaaatgcttattggagaattgtagattttggattttgggatttgatatgttcaaagtataatacaaatattccccaaccccccaaaattcaaaatcggaaacacttctgattctaagcatttcaaattaaaggatactcaaccgtataatctatttagagggcaatttgtcagtaatgatcaaaattttatgtgtaacacatgtcatgtgcatttcctctgttgactttagaaaaagaggaatgttgatagctgttttataataatgttattagcaatagtgatcgtggtagtggcaggaatactgctggttgtgctgcttgcagtagtggtactggtggtacggctggcagtgctggtggtactgctgctgctgctggtggtggtactgctgctggtggtggtactattggcagtgctgatactgtaccactgatagcactggtactggtggtactggtggtgctggtgatttgagcattcactgccttctactatgtgatgaagcttaacaaagtcacatccaagtctgctttgtacccagaacagtgccagagggcagtgtgggtcaaagcacctcttttgattctctcataacatagacagaaagatgagctttccaggaggaaagatttttaccattgcccctcataaggtggaaatagctggtgtccatccaagcccctgctcacacactcagaaggcacttcctaggaactccttccccgcctttgcttctaagtcccagaccagcagtgagattctgccctttgaaatatttataacattcaattcactataaaacactttgtaaatgtaagtgctgtaagtggcccaaattatatcagcagctttttgagaaatgggaaaaggaaaaggaatttaagggaatgggatc

SEQ ID NO: 4823 - DNA, 1186 bp, Homo sapiens
ttgcgccctctggtggcaggcccccagtcaccctctcccagccccgggcaaccacggatctgttttgcttgttcataaaggtcatgtaaatggaatcatacagtatgcggccttctgtgtgtggcttcttaaacttagcataatgtttttgagattcctccgtgtcgttacatggaggaatggttcacgcctctttattgctgaggagtattccattgtgtggatctaccacaatttgtttatccaaacctatggtttttaattttcttggtgcaaatgcttttccacatcatcgatatttccttattggcaatataagctttggtatgatctatttctagaggcatcagatttctttcatttcactcatgtattcaacacgtatttagtggttgccatgaagcccataacttgcagacaacttgagagtagtgtttttaaaacctgggcagaccccttgttgctgagaactaaactagcagtggttctccacctggctgcacattagaccctcctggggaactataaacaaacgaaaaaggaaaaaaaacaaaacttaaaaaaaaaaaaaacctgaagaccaggcctggggtgatggactgtcccagtttgccctgggctaaagggtttcccggaatgtgggactttcagtactaaaatagggatgctggatacccatccccaaggccacataaatcagagtccctagaacggttgtggctgtgcacagggctggtttgaaagcttccccaggtgattctaatgtgcacccaagggttgagaaccagcgagcctgctagaacctcaggcctgtaatcctccctgtgcctggaggtaaaagtgagacaaaaggtccaccagggctggttggagctaaggtgaagagaagggggataagcaaactggccgcatccagtattcctctattttttttttttttaactcatttctctttttaaaagatcaggaatctgatatactggagtatcggcagccaggactgtgagatccagaagggtgtgaactaggtgagggagaagcaatgaacaggcagtgtaatgctctgagcccacgcacctgcaagcctgacccagcacttgagctcagcagaaccaacgcggagcttctgtgtttaacctcctgagtgcttgcaggctcttggatgacacaatgtcacctatcacac

SEQ ID NO: 4824 - DNA, 1802 bp, Homo sapiens
gaatgaccatcctctgtgggtcatcatttccctctatgcaaagtcagtgcaggtattgcagccttgataatgggtactgaccactttgaaatggagattaggtgttgccacacttaacttatgtctcagtagctcctcacagcaagaagcatcaatcatcttagtgaaatatgcctatagggcagttctgttccagggaagcattgtctctgtgggtcacattaaggccttgataggaaggtaaagatttagtgtgaatgattccaagtggatgatggggagacaccactgtagggaaagcagattttcctgtctatcccttttcctttttttcagtgtccatcctcctggaaggggcactcagaaagacatctacctccttcttagtagagttctgaaaattctcttttacttagtaataaaaggtaggttcatatgcaggaataagacacaggagatgtaaaagttagcaaaagagatcacagaagagctagctaaggatgctggtttaatcgctgcctccccatttcaaaatgtcttttgttgacaggattctatcttggacattaaagtaccgatatttaaaggacctggagagatgcctgaaatccgatcctacatggaagagttcccattcccatactatatcattcttcgagatgtaaacgcacttcctgagacactcagcgatgccctcagacagtggtttgagttggtgacagcctctgaccacccatagaacagaaagaagagtccaaagtgagacttaactgtggtcagaaggtcacattgcttacccaggtgctcccttttggacaactacaaaaaattttattgtaatatttttattttacaacgtgatcttacagcctacagaatgctctctggctcccggctttgcctgggctgaggtttttataccaaacctggaagcagcagcaggtgcctgaactcgtaactagagaagagttatccttcttccctgccttggaagccctggcctgggaggaggtcataccccaccgttggagcccagctgcctgttttcttttgcaggggatctgggcacctgtgccttgaggagatgctgccaggagcatgggactctgacagtcctttgtataaaggactaaagggagctgcccttttgaccctgttctaagctctgccttgccaagcccatagtgtgtgcccaaaagctgtcaagtggccaagacagctcgtttctggagagtatgagggtgtgttttcttattgtgaaaggaactaccttctcttagagggtaggaagaatgtggtgtgtgtgtgttctcataaagcaactggacattataggtgcccaggtcatctataaaaacgatccttgggctgtgtaaaaatgaagtggcttttcagtatcctctttcacacttgctgcttcgggagactatgcaatgatgggaaggtgattgcccctttatttcattcagtgccatggtccctgttgttgtagtaatttatttgtttagttcatttttttttttcttaacagtcaaggggaagagtgattcctcacactgctttcaagctggactgagccagtctcattctgggaaagaaacgctgtgtccagaactcagcagctccatctattttttccagtcgaaagaaactgatctttaggcagtttttacttggccagaaagcagtgctgaatacttgaaactgtgtgctctgttctacttaatgttctgtcagaatgttcttttgtaggcagtatgtcatgatgtaatcatctatctccttgtctgtttccaagttac

SEQ ID NO: 4825 - DNA, 1202 bp, Homo sapiens
tatttttttgtgcattcccatcctcagatatatcttcatagtatatattttctcttacaaaattaaactttctgattgagagtcactactactttttctttttacttctgctcagcaggctagtattcttctcaggttattttcctgtataaaatagtttttttcaacatttcacagttattactatgtctgactgtgttctctccagagcctgttctgcccttactcaaggactttttccaaaatactgtccttctagtatacttcatttaggtttttgtcttggcaaagtgacaaatgaccacatgccagaggcttctacaaagtcaagtcatatgttaaatctgatgtcaagctgtgaaactgcataactattagcaccaaagaggagaagaatgtcagaagtctcctgtacttccagcggatttaagataatgagctagaaaaagaattcagtatgtgtttaaattgttttcctgtggcaagaatgaaatctccttttaaaattgcttttgtgcctaattgttcacttcctttttcttttttctaagggattttgcttgcccaaagaatttatggaagattcagctggagagggagcaactgagttccatgactatgagggaggtggaattggagaaggcgagggcatgaaggatgtgagtgaccagatcggaaatgaagaacaggtacgttttcacataggtatacagttgacagaagatcactctctttcttttcaacatgtaagttacacataaaaatggtttttactaggttaataatttttaatctgtgatctacagagccctagatatattggtgcttcggcagtgggtgtaaataaaaagcctaaaatccacaggaaggaacctggcaactccatcattggttttggctataattatggaggaaatgatttttactttttttttttaaatgggcagatatttactgatgattttctagagtatttttgatagtatttttaagcataaaaggcctggctatcttaagtgataattgcattaaacaataatgccaaaatttgctgttaataggttttactgttgtatatctttaaggcatagagtgttttaaaaaatctgtatccttttttggttggaatcaagcaaccttctgaactattcagatgctgtgaactaagattgttacattgcttggattttttaaatgcctgt

SEQ ID NO: 4826 - DNA, 1100 bp, Homo sapiens
tttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgata

SEQ ID NO: 4827 - DNA, 1174 bp, Homo sapiens
tgttggcttatcaattcctgtttgagttcctcttgagactgcaatttcttattagatactcttaactctttatgctactatctcctttatttaactggccaaagtgaattttttttaatcagacaattccttattaagactcatttattacatgcaattaaatgatttgtatgtagtactctatcttccttaacagacagtaaaccacttgtgggtagagacattttataaaatttatcttgagattcccagcaattagtctagctgtggttggttgacaatatatgtttggatgaatgaaaacgaatcctatttttttaatgtcctaacaaagagcttatgaaattgcaaggttggttttactatcatagtggatgacaaagtgttaggacttccagtaacatacctgtattttaataagggctgtctggaacaaatcctttgaggtacaggaaaagccataaaagtaggcatttgtcagtattgaatttcatggggaggcattttgggagtctttcaacatctctgaaatgattatatatctttgtttaaggacagcagggtgtaggggcagcaacagaaggaactgtctgagggacagaaggactcctctgcaggagctgattgagtgaaaaccatgactgggacctcactgcccagaactgcatttacttcattccaaatagttttagataagcactgattatccaggaaaaccagaaatagtcttggtaaaaccaatcaaatgctgagttatttgagataatatcactgtgggaaactttactccgaatcagtgtattgcttttaaaatattggtgtctctaataatccactcttacatactttctattttggtattactgattaaatgccaagagacatcaaatgaatgcttttttttctatgacataaattaaaggggatattgttatattatagctgagacctcactataggaaaagcaaatgagatggatcattgaaatgagcttgagatgagtgtttgcttcccccagattttaccttccaagatatttgggtcattagaattcttgatctcccctttttaatcacaagctgtacacttgtactttctttccccccccccactttctggtattactaagcctccctcttctcttcctggttacaccaaaccagggccatgaaac

SEQ ID NO: 4828 - DNA, 1175 bp, Homo sapiens
agtctcccatgggagaaaagtggaactttgaattgcggatttgaaaacacagcagcaatattctcttctgttgtttaaggtattttctgtgaagattctcactgtactgactgtgcattcagccaaacacagtaaaacaaaaccagcagccacttttaattagtcattgatacttcctttttatgtcttttttctaactacttcaaactgccacccctatagagggcaaacaaaaggaataggttggctgataaaagcttctttgtttttcctttttttttttacaaaaataatactttgtaaactatccaatttatattactccactgatccttcaaatttatggtaaaattgttaagttggaagaaggatgccattcaaagcaagaggttactcttggttacttgagcagtggctgctattggaactggtattggggatgaactattcacttctgttcttaaaagggtaaaaggagctgggcagggtggctcatgactgtaatcccagcactttgggaggccaaggcgggcagatcacaaggtcaggagatcaagaccatcctggctaacacagtgaaaccccgtctctactaaaaataaaaaaaatagctaggcgtggtggcacgtgcctgtagtcccagctactcgggaggctgaggcaggagaatcacttgaacccaggaggcagtggttacagtgagccaagatcgtgccactgcactccagcctgggcaacataatgagacttcatctcaaaacaacaacaacaacaaagtgtaaaaggctttgaacagttgtacatttgactgcccactacactttcaaagtgagatacacatgaaatccaagcaatttgtaacatatgagatatgaagagaatctgaaactttcatgtataccttgcatttgcctcgttttctgatgctaaactcattgaagaggttgtgagaaatattttattgggcaaccttaaaatataagttatgtgatgattatatattatttttctttcttgtattaaaatacttttattctagtagtagggtagcagtaggcttgaaagttttagtgctcaatgtactacatgaactattttttaaacactactttaaaaaggcttttaaaggtacatcaattataatgaaacattatccaatatgttttgggtaccaa

SEQ ID NO: 4829 - DNA, 1198 bp, Homo sapiens
ttgtttccctgactctgtgtgagtgtgtgtgtgtgtattgagtgctcattctattattttactttagttcaagtaaagcaagcttcagattaaatgtcctttggtatctctttatttagtaagcattacattgtacacttcatgagtggtagcatttcatttatattacgttagtggtaacaaccaaaaaaaaagcacccttttctattccagtcttatttttttcatctgtatgctgaatatgtatgtttgaatatatatttatatccatttatatatacatttatatatttatatatatatatcatttctatagaatttcctacatgggaatttatgtatatgacttatataaagagatatatatataaatatatataaagacatataaagtcattatatagatgggttttatatatatataaaagtcattattaaatacctataaatatatatataaaatatatataaaaatatatttaaaatacctatatatatataacccatctatataatgactttatctgtatatccttctgtatattgttatttgtgtgtatttgtatgtgtgtgtcttgtgtctgtatcttgtttttttttgtgtgtgtgtgtgttgctcaatcttgctgtctgtctgtgtatattagagtttcatgcatctgtgcaacaaatatattctagggaaaatactctaataggtctgtggctccatggactagtactaggcaaaatgataacatcatataccaagcacactaacagaaacctgggaattgggggagagaatgcttgagaaaattgaggaagaggtcaagggaaaaggagaaatctgcaatttgggagtgaaatggaatcctgagattaaaaaaaaagtgtgaagtttctatggtagaatcgctgaagaatatttaagaaagaagaatgtatttttttaacttttattttaagttcaggagtagatgtgcaggtctgttacataggcaaacttgtgtcatgagggtttgttgtacagattatttcatcacccaggtattaagcccggtgctcattagttattttttctgattctctccctcttcccaccctccatcctcccataggctccagtgtgtgttgttcccctctatgtgtccatgtgttctcatcatttagctctcatgcataagtgagagcatgtggtatttagttttctgttcct

SEQ ID NO: 4830 - DNA, 1138 bp, Homo sapiens
ttaatttatttttaaataatagttttaaaaacctaagatttaaaccaatatttatcctagtgtatacgaggaaaactgagcttaaagtgctgtgtaaaagactaatgatttaaatttgaaaagattttgaattctgataacacttctataattaggactttacgatgatagattaaagaattgtgacaggacaacaattttccaactactgtaatgtctatgaaaataaatattgatattcagccagtttaagcagtcattaatagatgatataacttgtgtacatgcatcatcccaactgccagtcaacaaaaataataatgcatcagttcagtcagtgctgtcttagatgctgaagataaatggtatataaatagaaagcaaaatatgtgtactttggctttgatttgaaataaagacttgatagtttaggagagaatgattttcttcatttaaaaaaagttactgaatacctagtttaataggcattggagagatactaatggagaagaaggacaaaaatacttgttctgatggagctcataatctagtgttggggcataggaagaccactaaatgagtaaatagtgtaatgtgtggtgataaatgctgtgggaaagagtggaatataggataggaatacagaaggccagaggcagttgtgattttaaatagagtggtcaggaaggcccaagtaagtaatatttgtgcaaagaactgaaggagatgagagaccatgctttgcagaagtctgaaggcaagaacatgtctggtgtgtttgagaaactatagggaagcagcaaaggctcatgtggaatgagaaagggaaagagaactaagagatggatcaagaggtaatggagagctagtttgtgttctgccttgtaagtggttataaagacttttggttttactctgagattggaagctgttgaaaagttttgagcagaggagtgataagagtcctctggctgctaggttgaggctagacttataggaagactaggcaaggggaaaagcaggaaggcagttagggaactattgtaataacccaaaaatgagcagctgtggctagagtggtggcagtagaggtggtgagaagtggtcaggtttcccatctgaagaaagtattttcaag

SEQ ID NO: 4831 - DNA, 1163 bp, Homo sapiens
caggctggagtgcagtagcgctatttcggctcactgcaagcttcgcctcccaggttcttgccattctcctacctcagccttctgagtagctgggactacaggcacccgccaccatgaccagctaaatttttgtatttttagtagagacggggtttcaccgtgttagccaggatggtctcgatctcctgacctggtgatctgccctccttggcctcccaaagtgctgggattacaggtgtgagccaccgtgcccggccttaatctctgctttagtcctttttaaaagaatgtcttatcttaattttgaacaatcaaatttaggcatattacatttgggcattactccataagaaacatctttaattccatagcccttaacttgttttaaccatgaaaaagccattctttctctcctatctcccacaccacccacaactgaatattgtgagagaaaatcatacattcatttttactaagatgattgactttaaattgttgatcataatctcaaatggccatcagctctagaatgtttgcttttctgctctccaaaatgacttaatgacttacttcagaacttctcttttttttttttttttttttggagaaagagtgtcactctgtctcccagtgcaatggcagtctcggctcactgcaacgtctggctcctcccgggttcaagcgattttcctgctttggcctcccgagtagctgggattataggtgcctgccatctcgtccagctaatttttgtattttttagtagagatggggtttcgccatgttggccaggctggtcttaaactcctgacctcaggtgatccacccagctcggtctcccaaagtgctgggattacaggtgtgaaccaccgtgcctggcccggaacttctctttgacataaaatttaatacgtactcttctccaatccattcgggttaacatcttgcctcataaatcattgaaaaatagaattggtcaggtaagaattcctatctttacagctttaaatctcccaacacatctgcttcatattcaacctctcagactattcttcttttatgttagaagtgtcactttctatcaagagctaattccttccctcgtgcactggatcttaactcttctcacctgttcaaggactttattgtttgtgtattttcac

SEQ ID NO: 4832 - DNA, 1099 bp, Homo sapiens
gatcgtaactgggatattgaagcccaactctattctctcctaaaaataaatccaattaggcaaacttctggtaacagttactgtttagactgtgaataaattttcttcttgtgatggtttctgataggtaggctagttatgcataaataaatgagtctttgttaaattatatataataaccagttgttaaattgccatttcttttttcttttttttttttttgagatggagtctcgctgtttcgcctagcggagtcagtggcgcgatctcggctcactgcactccgctaggcgacagagcactccgtctcaaaaaaagagctaaaagagtgaatgtgcaccttattagtccaattaaagatttgacctatgtagtatgcccaaatgtaatatgcgtacatttgattgttcaaaataaagataagacattctttagaaaaggactaaagcagagattagaagcaggcatattcatttaacggacttattggaatattcattaaatagctcatattctctccccgtctgatacactcaaacacacacacacacacacacacacacacacacgagatgagacacgctgagagcccataagggcttctgaaaatgtgggagatgcgtagtactccttgagccagtcaggtttaaggctttgtggaaaagaggcccacaggccttatggcttactaaaaacaatctttaatcagagggcatggaattacatgtctttaatcaaatctctggtagggtttgcttaaaactgacaaaattgatatgtatcatcttaaggaacaatactatgaccctgttgcatttattatttgatcatcagaagagtaacattggtctaaagtacatttctctcctgcagataacaaaacgatagctatccctgtgcaagcactctgcttaacacttactgcacataccttcacttaatacttacgacagtcgtgtgtagtgatatttctgtttccgttttatacttttacagactgaggcccagaatgtttgaagaacttgtccaggttcacacagctagcttaggaaatggcagaactgagatttgaattttcatatgtttaactccactgttt

SEQ ID NO: 4833 - DNA, 1176 bp, Homo sapiens
atgttcctgtccatccttatgaggctttggaggctcagcttccctcagtgttgattgatgagcttcatggattactcttgtatattggacacctatctgaacttcccagtgttaatataggagcatttgtaaatcaaaaccagattaaggtttgacttgtttcatttgatttttaaattatcagctttttctccccacaaggagtattcattcaagaaggagagaaattagtcagaattacagctctggaacctgactgcctgagttgaaattcttgccccccatcctccttttattaattgtgtgcttttgggcaaatgacacctcagcctccacatctgtgtaattcttacaacttaccagaatcattggatgaattaaataaattcatatacatgaagttattaaaacatagtagtcattgaatcagtagctattctcttgatttatgacagtataagtgtctgaaaattttaaagcaaatgaaataatctttattttctgaaatttttatcatatattacagtaagattcaagatcagcttataaaaaaaactttcaagaccacatcattatgtgtattctgacttttgaggcctttttggaatgtgattaagattgttttgactgtgccctttttttcctacctgtgataatcattccctctgaagtttggtttttaaaactttatattgttaccgtgcctagcttatagataagtaatagattctgcctatgaaaatgggagcttatatgaataacaaattatggtaattcacagtgagattccctgaagtctcaacccctttcattatatttgactttaccgttttgaataatatttactctttatgaatatatctttgttaaaatataaaaacggctaagcatggtagctcatgcctgtaatcccaacactttgggtggctgaggcaggaggattgtttgaatccaggatttgagaccagcttgggcaacatagcgagaccccatttctacaaaaaattaaaaagttagtccagtgtggtggcacataccttgtagtcccagctactcaggtggtcgaggtggggggatcccttgaactcaggaggttgaggctgtggtgagacatgattgcaccactgcattccagcctggatgacagagcaagaccctatctcaagaaataaaata

SEQ ID NO: 4834 - DNA, 1199 bp, Homo sapiens
ctaaaaacacaaaattagccaggcgtggtggtgcgtgcctataatcccagctacttgggaattgaggcaggagaatcgtttgaactggggaggcagaggttgcggtgagccgagatcatgccattgcactctagcctgggcaataagagcgaaactccgtctcaaaaataataataataataataaactgaacgtctttgaacagaaaagtttgggagctgtttcttcaaagaatatataaaaactataacaatgttccctgatttcaagtcactttcagataagttttgttctaaatcctgataagtggaacaaataaaataagcatagcctactgtgacggaagtgttaagctgagcgtctgtcttgacaacacggaaagttattttggtgacttctcaaagcaagtgggatttcagctagaatttctatcagatggaccgtttttcccctccctgggatgctctgtgcttgtagccccacaaaatttgttgtactccttcttctttttctatgtcaattagaacgccaacagagtttttaaacaataaagagatttattttcacctaaaaaaagtccgagcaggacagtgaccatggaagttggaatccactaaggagtgtgtaacaacccacctgccaaatcaactaaaaaaaaaaatccagatataggcacttgagaggttgtttaattcaatggttcctcaacattgtcaccctgaactaatttttttcatgccctttggttttgtcatcctcagccttgtctttacagtcatagcacatctgccacacaacagtgatcacatacagcagtttctcaactttggaagttggtatttggggctgaatcgttcattgttatggggggctgtcctgtgcattgtggaatgtttagcagcatccctgttttctacccagtagatgcccatagcactctccccacagttacaacaagcaaaagtgtcttcactcttcagtcactgccaaaagtcccatggggagcgggggcaaaatcatccccagaactgctcactatagatacaacagtcagtagcagaaaacagattgattttttttttcctccaaatactttagtttatgacctcgctcagaagttctcagcagacttcccctccatggcattggctagaattgtcacttgctcatgcctaaaccaaccacatacaaggtaaatg

SEQ ID NO: 4835 - DNA, 1147 bp, Homo sapiens
agtcagccaggtctgcgcggtgtgtcccatcctctgtccgcggtggccccagccaagggcctagctcgtggcctcagcacagagtctccttactccccaggccggcccaggagccgccccctgccctcatcagaggtcccgcaggtgcaggtgtgtgccagcagcccctcctgccctcccggccactgtccctgaagggcaagcagtcgtctaaaccttaggtccagatccagtctgtttgggcagttcccgggaaggcgggttaggtgccatcgtccgagtccctgcgccaagtagaacctaagtgggattcgcccgcgcgttcgggctcggcctcgccagcgcgggcctctagggaggtggcatagccaaagctgggccgcattcgaagacccggagtcccagggcgacatcgattgacgtttttcggccgtcacgcaggactgtctcatgaacgctgcatgaatttcgcccccagttttagtctggccgaaccccgccctccttgggtttctgccgtcttttcgcggctggctccaactcgggcagccaggttggcccgcaggctctatccctacgggaagcccaaactcgagggctggagctccgcgaaggcagagagagagagagagagagagagagagagagagagagagagagagagagagagagagagagagaaagagagagacagacagcggtgtgaccttcggcctccaccccacatttacagtaacattagtggattccctgggtgcggccgcggtgtctctggcccgggatcagcaggcaggagagatcagggcactgccgagtgcaggcacacactgtggggtccaggctgctgcgtggaacaagacctggcccggcgcgctcgccgatgccctcaggtcaaccacacaggctccttagccggagagggccgcaggcagggcgggcagcagtgccagaggtggggtcgggtgcgccttggtgcgtgaagggacctcctaccagtgactgctctaggagcttgattcgggctggttgcaccaatttccctctctttttttctctaaagagctcggctgcggaggcgcccggaggctgaacacgaaggccactcgacgcctcagcccggggaagacttgcacagtacacatttagc

SEQ ID NO: 4836 - DNA, 1210 bp, Homo sapiens
gttgttcatgtaatgaatggtggcttctgtgttcatcatcttcctagactccaatcctttaccatataattagatataagctccagaagcacagggaccagtgctaggcgagcccgttatatgtccgcagtgcctgtcacgtaattgttggatgatcacagactagcagaggagctaagtcaagcacaaaaatagtcaaaaataaaagataggcagtgataaacacttaagagagacgcatctgaattatttggatgcccaaaaggataaggcatcacagcacttgtatctggaagcagccaggaaaaactacttaatcgtaatagtaatgttcatctcttccacgtaggtatgagagtttctattttatttcttaaatgaaattttatgaaaaatgtataaacttttcaagtaattcagtagccacaaaactatattttaaaatgtttaaatcttagattttttcataagatctatctcaaatatttatactcagtttactcagatatacatatctaaatgctttcttgctcaccttcatttttaataaaagaatcaagagttcctgttgttgttttttttttttaataactccaccactttaaaattatcctgtcttctgtcctatcaattacaattccaagattgtctttaggtgttttccatggtttgcgtactttttaaaaatatttcttcaagccatattttttgaccatgtgatatgtattcctttattaaaatcaatattgttttaaaccatgatggcctttctctgttaagtttaaaatacttctctaacttaaaaataatttttcaggtatttcttttagtagtatcaggtttttttttttctgagccttgaaatgaatgatttcctttatcttagtatataattttttatgaggttatgttttaccttttcaggtggtattatttttgtccacatgtccatttctacaaaaagtctgtattgaccgccatatgaatttgctctcttctctgtttgaacatatggatactttcccttgaactgctgttgatttcttctgctaggtcatgtctcttttttcttcctaaagcatttccaggtaaactaaaatataaattcatcacttagaccacaagttttatcatcacccttttaagtgcattgctaaatatgtgtttttttaggctttttaccataaaacccatagcagtaaaataacca

SEQ ID NO: 4837 - DNA, 1223 bp, Homo sapiens
cttggggccatagctggagcagctgggatggaaggcaccaagtccctaggctgcacgcagcatggggaccctgggttcagcccacaaaaccactttttcctcctagacctctgggcctgtgatgggttgggctgccacaaaggtctctgacatgccccagagacattttcccctttgtcttggtgactaacatttggctcctcttttcttatgcaattttctgcagcagacttgaattgctacttagaaaatgggattttcttttctactgcattgttaggttgcacattttcccaacttttatgctctgtttcccttttaaaactgaatgcttttaacagcacccaagttacttctcgaatgttttgctgcttagaaatttcttccagcagataccctgaatcatctctctcaagttcaaagttccacaaatctctatggcaagggcaaaatgccgccagtctctttgctaaaacataacaagagtcacctttgctccagttcctcatctccatctaagaccaccttagcccagatttcattgcccaaatcattatcagcattttgttcaaagccattcaacaagtctctagggagatccaaactttcccacatcttcctgtcttcttctgtacccaccaaactgttctgacctctgcctgctacccagttccaaagtcattgcacatttttgagtatcttttcagtagcacctcactctactggtacaaatttactgtattagtccattttcacactgctgataaagacttacctaagactgagcaatttacaaaaaaagaggtttcacatacttacagttccacatggctgaggaggcctcacagtcatggcagaaggcaaggagaagcaagtcatgtcttacatggatggcggcaggaaaagagagagcttgtagagggaatctcccgtttttaaaactgtcagatcttgtgacacttattcactatcacaagaacagcacaggaaagacccacccccatgattcaattacctcccaccgtgttagtcccacgacacatcagaattgtgggagttacattacgattcaagatgagatttgtgtggggacacagccaaaccatatgatgcattatttcgttgtgcaaacattatagagtgtactttcacaaacctagatgatatagcctaccatgtacctaggctatatatgatatagcccttatatgggaccaatgtca

SEQ ID NO: 4838 - DNA, 1112 bp, Homo sapiens
atctggttttcccacttgtctgaagctctcctgatcttagaacctggagctgcagattcctccatgtcagctcccatcacggccccaaagacagagtcacttggttgctgagtcacttggttgctggaaaaatctttggggaaagctggtataagctacacactgacctgtccccagtgtttccaggtaatgacttggcactccagagaaagtttcatgctgttgcgtgtggtggctccaagccaagcacctggcatgcaggtcagcccttcccagcgggcgtggcgtcgtcctcttcacagatgccacgttgcagccccaaggcctcaccattttgcgttttttagaaacccattttcttggtcatttataaagctgctttatagatatctttgatcctggcatgccttggtttcctctcccttccctctttccaatcctggtttcctaacctcctcttgtagtaattctcaactcaactcaaagtcccaagaatttggaatggtaggatgctgtgcggggagctcgaggctgaggcataatcactgcttcggttctgctcatcaggggacacgctcccttactcatggcagccatgtttgattgtcacagagccccccgaatactctgtctatagtgacacactgtaggtgtcataaattttaagaaacctgcttttaagtactatttataggtttttctgttatacttgcaacctagttttaaaatacatgaggattttatgaaagctttatacagacatttataggaaactcattctttgattttaggtgccatttaaattgataacacttactttataaaaagatgctttttgtctggatagagccttatagtttaaaatatcttcatatattgccatttgatcaaataaatttcttacttagaaaatgtgtgtattttttatttcattcctcttacatatatctagcttgttcgaatgtcatgcccaaaggccaaggttgtggggatgggcctggtgcaggccattgtattctgagcagaccagcaggggcggtgcttgtgggtcggtcatacctgacttcaaaggtcctgccatcttggctgctttgactgtgaaaaaaaaaaat

SEQ ID NO: 4839 - DNA, 1167 bp, Homo sapiens
ttcctagtaatattcccaagagaactgaatatgtaattctgatatgcaaaatagggaaataacttgcgtccacacaaaagcttatacatgaatgttcataataggcaaagtggaaataacccaatgtccatcagctgatgaataaacaaaatactgtatgtatccttacaatggagtataatttggtcatgaaaaggagtgaattactgataatatgctacaaccttgaaaataccatgttaagtgaaagaagacacaaaagactgcacattatataatgcatttatattaattgaataaataactttgtgccaataaatttgacagatggacaaattcaatgaaaacacaagtcaccaaaaccgacataagaaataacagaaatgaatagctgttgataagtaactttgatttgtaattttaaaagcctcagagagtaaaacaccctgcacagatcgtttcattggtgaagtctataaaatacctaagaactagtcgggcgcggtggcacatgcctgttgtcccagctactcagaagactgaggtgggaggaacgcttgagcccaggagttctgggccgtagtgtgctatgccgattgaatttccacactaagttcagcatcaatacggtgacctcctgggagcaagagaccaccaggttacctaaggaaaggtgaaacagcccaggtcagaaatggagcaggtcaaaactcccgtgctgattagtactgggagtgcacctgtgagtagccactgcactccagcctgggcagcataatgagaccctgtctctaaaaataaaaataaaataaaatatttaagaaataatattacaaactttacaagctttgttactctgtacaaactttttccagaaatgagacacttgccaacttgtgttagaggccagaataaccctgatactgaaacctgataaagacattaaaagaaaattataagccagtatatttcatgatcatggatgcaagagccttcaacagagtactagcaaattgaatctcgtaataattaaaaaggatggtacacaccatgactgagttgagtttatcctaggagtacaaaattgattcaacattcaaatctcaatccgtgtaggccaggtgcagtggctcatgcccgtaatcccagtactttgggaggctgaac

SEQ ID NO: 4840 - DNA, 1222 bp, Homo sapiens
ggtttagtgcaggtatgaaaagaagcctgctaggtggcttctagaggagatttcccccacttctaagcaagttacacaggaaggaattatcatacctctatgtgacagctagaaatgtagcagtgactaaattcagtagcaaaggaatacactagttaaaccaactcagtctaccccttttgttttatatgtgataatatattttgttttttatcaggcttctgtgagttggactgttatttccaggcaaaaggatcctatgttttaagcagggattgtatcacaagcaaaatacatagaaaaggctacacttgccagcttttaattatgtaatacgtaagtatctaggaagaagagataggtcttttttggagtgcccgtctccgacaatacaaagcttaggaagcacaggtagattgcttttatctctcttgtcacttggagtcagtcaatgggcacatatgtttttccaaaaaggaaaactattaaggggagcagactgcctaacatttgtggttgacttttcacaatgtgtaagtctaatctatggccacaccaccctaaatgcacctgatcttgtctgatgtcagaagctaagcagggtcgggcctggttagtacttgaatggctgacaatgtgtaagtccacagcagttggaataagctttcaagtcctaggagtcttctcttgtttgctacttctttggcatatttgtgagcagaaggacaaggtgaacactaacttagggtactggaacaattaataaaaataggtcttgatgtaagacacattcatggtaagacgatgacagcatttcaactttaaggtatttttcagttgttacttaaattctcctgagctatatgtgtttctctttcccttcaaaaatactgtatttaaattcctaagaagatattagcctcacaggtagaaatgtatttttatatgtgtttatatatggcataatatattgtctttactgtacacaagtattactttcatagtatgaaactaaaggaaaaacaaaaagaaatatattgctgctaatgtacctttacattttatataatgcaaacaatagtgactttttaaaaaagtatgtacaggggccaggcacagtggctcacgcctgtaatcccggcactttgggaggctgaggcaggtggctcacttaaggtcaggagttcgagattagcctggctaacatggtgaaaccctgtct

SEQ ID NO: 4841 - DNA, 1176 bp, Homo sapiens
cttgcccctcttcccatattttacatcttccattttgacccatttttttttaattaaaaagaaacccttaaaaaaaatcattgggctctttgggggccattttacttagaaaaaaatctctttaaaagtgccatgttcgtgcacagtggctaatcatagcttcaggtggcatggatactgattttactgaccttgttttttacatctgattttggaagagtcaagatgccccttggatggcagtagaggggatggaatagtgcgaagtcctttacgaccacatgcaagttttcccttctgctctggtgccagggaaggcttccgttcagcttggcctgtccttcaggcgcgttggtagaatgttgtgtcactctttaggcgagaacactggatgatgatgatatgaatgtagacagccgtggaaacacgttcgcagtgtctccatctgagccgtgtccttccgctgcccccattccttctccatacatggttgctggttggagggagtggacatgtttccttggaaaacagtgcaggggcttttggcttcttgttagatttaagggtgggcctctttgagctcaccatgaactgtttacttttccgtgtgtgtatttgtacaaaatccaggttccgggagctttgtggtgacttccccagacctcagtgttagctactccaggcagtactacatcctcattcctcagggcgggcccaggtctgggcccctcttggggataccatgcattggaaggacacaggccattttagatggggtacacatgtcccttcccagggtccactcagaactttcctcttggactctctagaaggtcctgctgtcctatacctggccaccccctgccttggggggcacatgtcttcgttccctcccgactgggaatgtcaggctcctgcaggccagctgcatgctctccaggagcaccaactgggaaatcccctgacaggtaaagtcctttaaaatgatacttttacctacctaactctgggggccaaatgcttaagagggaaaggaaacagtcgaatgcaaacagtgtgtcataccagagtcctggaaaatttattgaatcacacagggtagtcatagaacccctgtgggatggcttaatattttgctactttaaaatgcagagataacagaaacaatctggattt

SEQ ID NO: 4842 - DNA, 1228 bp, Homo sapiens
ggttgcaggaaagcagttagtaaccacactctccatcatttttgctgttgggggagaaatcagtattatagctcttacattttgcaatggcatttgtactaatatgaagctttctccctccctctctctgctaatgggctggtcataaagaatgaatcaagtgtggagaagactgctttcccagacctcatctaaatcctaaaatctgccgttgacccacaggtcaaagctacttgccacatgaagctgcttttttctctgtattctttctcttttacctagaatgcctctgttcatataacatagagaagtaacacacttaatcttaacacagtaaacatctggcttttttgtcacaggcagaatttttggaaggccgcagtcttgagagtcagggtggtagaaatcagaaaaggacaaggaccctgtcctttccactgaccccttgaatgagtctctaaattcatctaggatttagcatctcccactttaacagggacacagtgacacctgctcctgtagtcacagtggggagaggggagcagagctgtgggccaggggcctgctgagttccatgaactgacatcagctagttcgtgtgttggatgagacttgatgaaaatgtgtggttttttttttttcttatgaaaaacttttcagagttcttgtttgcaaatgcagggtgttaggccatgtatgtctctaaggcactatacagctctgacattgtgaccctgccaccctactgtcagggcaaagaaggggggagatggaacataggctaggggtcagctctcccagcgggagggggaaacttgactttggggttctagaagctggacttccatccaccttttcctatttctggcaacccttcctggcaaagttattcatctgtaaaatggagatagtaataaatatttcagtagcattgctgtttgcttccaagtgaaataagtatataaaaatgcctggtgctgtatttgatgtaaattaggtgtgcaataaaatttgactcctagtctgggcacagcggctcatgcctgtaatctcaggactttggaaggctgaggtgggaggatcatgagcccaggagtttgagaccccatctctacaaaaaatttaaaaattaactgggcatgcctgtagacccagctactcaggaggctgaggcccaggagtttgaggctgcagtgagctatgatcatgcagctgtcctccagcctgg

SEQ ID NO: 4843 - DNA, 1577 bp, Homo sapiens
ctgggtgctcggttttggaccattctggttcatactctgtattttcttttctccctgcagaactccatccggcacaacctgtcactgcatagtcgattcatgcgggtccagaatgagggaactggcaagagctcttggtggatcatcaaccctgatggggggaagagcggaaaagccccccggcggcgggctgtctccatggacaatagcaacaagtataccaagagccgtggccgcgcagccaagaagaaggcagccctgcagacagcccccgaatcagctgacgacagtccctcccagctctccaagtggcctggcagccccacgtcacgcagcagtgatgagctggatgcgtggacggacttccgttcacgcaccaattctaacgccagcacagtcagtggccgcctgtcgcccatcatggcaagcacagagttggatgaagtccaggacgatgatgcgcctctctcgcccatgctctacagcagctcagccagcctgtcaccttcagtaagcaagccgtgcacggtggaactgccacggctgactgatatggcaggcaccatgaatctgaatgatgggctgactgaaaacctcatggacgacctgctggataacatcacgctcccgccatcccagccatcgcccactgggggactcatgcagcggagctctagcttcccgtataccaccaagggctcgggcctgggctccccaaccagctcctttaacagcacggtgttcggaccttcatctctgaactccctacgccagtctcccatgcagaccatccaagagaacaagccagctaccttctcttccatgtcacactatggtaaccagacactccaggacctgctcacttcggactcacttagccacagcgatgtcatgatgacacagtcggaccccttgatgtctcaggccagcaccgctgtgtctgcccagaattcccgccggaacgtgatgcttcgcaatgatccgatgatgtcctttgctgcccagcctaaccagggaagtttggtcaatcagaacttgctccaccaccagcaccaaacccagggcgctcttggtggcagccgtgccttgtcgaattctgtcagcaacatgggcttgagtgagtccagcagccttgggtcagccaaacaccagcagcagtctcctgtcagccagtctatgcaaaccctctcggactctctctcaggctcctccttgtactcaactagtgcaaacctgcccgtcatgggccatgagaagttccccagcgacttggacctggacatgttcaatgggagcttggaatgtgacatggagtccattatccgtagtgaactcatggatgctgatgggttggattttaactttgattccctcatctccacacagaatgttgttggtttgaacgtggggaacttcactggtgctaagcaggcctcatctcagagctgggtgccaggctgaaggatcactgaggaaggggaagtgggcaaagcaggtcagtgccgaatgctatggcataaaaataacaatatggggatgaggggggatctctgggggagcctgtcttctctttactt

SEQ ID NO: 4844 - DNA, 1186 bp, Homo sapiens
agcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggcttttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggatt

SEQ ID NO: 4845 - DNA, 1200 bp, Homo sapiens
tatacaaggaattttgagcttcaagataacaagaaaaatgatatattttacaaaggaccaatccagttggtagactatttaaattatcctatatcaaattaataaggatttactttgccaagattcttggcacttttatattaacttaaattgcactgggaaaaaagcataatagtagttgagaagcaactaattataagcaattataagccaaattatgtttataccacaattagtgtttgaggtggtttagtaggcagattcttcagtaagaaccatcaaataattgaacagcttgtaaaacacagaaatacttcttttatctttattccaagtagagtaaccacattcttttatcattataaaataagcaacatttattatcttttgtcccaatccgcagtttgagttggatgcttataaaacatggcaagagggctgggtgcggtggcctcccagcactttgggaggccgaagtgggcagatcacctgaggtcaggagttcaagacaagcctggcaaacatggtgaaacctcgtctctactaaaatacaaaaattggccgggtgtgttggcatgcacctgtaatcccagctactcgggaggctaaggcaggagaatcgcttgaacccaggaggcagaggttgcagtgagccgagatcacgccactgaactccagcctgggcaacagagcgagactccgtctcagacaaacaaaacaaagcaagagtagtttatgtacctagctcacaacatagcttctttcaacaggtttcacggagacacgtgaaccacgttcttgtaagacaagagctattctacagggtatctagagtgcaaacccaaaccatgtctttttcagtggatttttcatgttgacatcatcttatttcactttggggaaagtttttttctaaggatgatagcgaaaagtccttttgtcttgtgacaatagcaatttttatgtcagcttgggtttttttcctcccatattcccaagtaaaagtaataactttgttaccagttttgccatctgaggttaaactgtttgaccatggcttgacgactattttatacttaacacttataaaatattagactgatagttatttaagttaccaccagtgatagctctggaatccctgttttattaatttccaggtaaatccttcttaagcacatgggaagatagcactgtaaa

SEQ ID NO: 4846 - DNA, 1207 bp, Homo sapiens
ctcagtctcctaaagtgctgggattgcaggcgtgagccactgcacccggcctgaattttaatctttaacttcataaggaaaggatggattgtcattagtactcaatacagtttttgttgttatgaattgatccttgtaagaaatctaaagcaatgtgtgcttaaccgatgcttaaaactaatatgttattccccccaaatttttgcttatatgactattaataagctcagtttagaaactactgttctagaaaggaatatacttggtgttaatagttgttatgacccatcatcactagactgggctttttaaaaaaaagagagagagagagagatggggcctcagtatgttgcccaggctggactcctgggccaagtgatcctcctgcctcctaatagcgagactacaggcatatgctaccatgccaagctaaaatatttgagttttgattttgccgagtttttgatatgtggacaatagttgattagcttcgaaaagtgatagaattctacatctaaagtcatctttttttttctttcttttcttttttaataaagagcttcttttattctcgtaagaatttcatgaagccttctcaccaagggtacccacaccggaatttccaggaagaaatagagtttcttaatgcaattttcccaagtaagtttaaataaaatataaacctgttgtcttcttaaagatagaaagtgcaacctcagagatctttctatatgagagcatacttatgcatatatagcattctacacacactaatacttgcttttcttgtgggttttttggtttgttttagacaggggtctcattctgtcacccatgctggtgcagtggtgtgatcacagctcactgcagcctcaacatcccaggcttaagtgatcctcccaccttagcctcccaagtagctggggctacagatgtttgccaccccacctggctaatttttttttaatttttagtaaagacaaggttttgccatattgcccaggccggtcttgaacgcctgggctcaagggatccacctgccttggcctcccaaagtgctaggattacaagtgtgagttactgcacctggtccatatttactttgacttagatgttttgggagtacagtagtgatctttatatagcttgtaattcaaaatatgcagaatttataaagaacattaaaatatcagataaaatattttta

SEQ ID NO: 4847 - DNA, 1125 bp, Homo sapiens
aagacagaaagagtgaggaccagaaagctctgctctctagctccgggctaaatgaatatgaggaagagaatgaagaggaggatgcagaaaaatggaatgaaatggattttgaaatgattgaaacgaatgatacaatgaggcattctataatagagacatctagaagtagtctgacggagcccacagctgaagtctataatcaatacccatcaaatgcactggtgtttgagtcttctccttttaatactggcagtgcccatgtgaagcacttgccagaaaccaggacaaaagggactaacgtttagagaagatggattactcactgacatctttgaataactgccacttctaaggacgccattcagagcagagcattagcagaatttcaccatgctttggggattaaaatttttaggtccatattatagcaaatgctaaaaatttttgaaatgttctgtaattcccagagtcttccataaataaccaaatggtctcatacacgtacaataggatcttgttataacgctatcatttgacatgtgactgattaggaaatattttatggtctccacccctcagagcacccaaagaaggcattgtttttgagaaggggggtattctcagaatgagaccatgtaggagttgaattgattggttgaacaaattatcaggtatcaatatttttccaggaaagttgaggagaatagtttcataaaagagaaatgggccgggtgcagtggctaaagcctgtaatcccagcactttgggaggccgagacgggcagatcacgaggtcaggagatcgagaccatcctggctaacacagtgaaaccctgtctctactaaaaatacaaaaaattagccaggcgtggtggcaggcacctgtagtcccagctacttgggaggctgaggcaggagaatggcgtgaacccgggaggtggagcttgcagtgagccgagatcatgccacaccgtactccagcctgggcgacatctagactccgtctcaaaaaagaaatggagaggtatttttattaattgctttaccttatctgtagggttggatcaaagaatgtaatgactcatttgatttctaatttcaatgaagagaacacagaacagggccc

SEQ ID NO: 4848 - DNA, 1167 bp, Homo sapiens
tggtcatagtggctcacgcctataatcccagcactttgggaggctgaggtgggcggatcacctgaggtcaggagttcgagaccagcctggctaacatggtgaaaccctgtttctactaaaaatacaaaaaattagctggacatggtggcgcatgcctgtaatcccagctactcgggaggctgaggtaggagaatcgcttgaacctgggaggcggaggttgcagtgagccgcaatcgtgccatcgtactccagcttgggcaacaagagcgaaacactgtctcaaaaaaaaaaaaaagtcatacaatcttattctgaaaagcagattatcctcaaatgattatatattcaaatgaccaatatatttaactgtgtttcttctcttctcacctccctttctccctgcagtaccgtgtggaatcaatgatgttgcgtattgctaaaccaatgaactatattcctgtgacacctagtgttcagcaaagatcccagatgagagccccacagtgtgttcctctaattatggagcctgaatcccgcttctatagcaactctgttctcgttttggatttccaatcactttatccttctattgtgattgcatataactactgcttttccacctgccttggccatgtggagaacttgggaaagtaaggtttttttcacatttacaataatattgttgtgctttgtacttcttactaaaattagacactttctgagtgtctctttgctctggacaccttccctatgagcaagataaatggactgtatcccagctaatccattcattatagttgtcttaccaattgacatggatcaccatatgattaatccagcttcatggatggatgactcatgaagaggattgggaataggtcagccttgcaactgtttcactccatatgtaactatagtctcttttaaaatgaaagttaaattgttgatgtaaattacctttcagtggaacagtttgaggattatgatcttataacttcaactagacctcctctttatttttcttataaatagtccaggattttaaaaattaaatgttaggttttattaattaatgtaaattaaattttataaactgataataacattttaaattctcaaaggattagatacttttcttaaattgtaggaaataacggagtcttcctt

SEQ ID NO: 4849 - DNA, 1170 bp, Homo sapiens
attagaattcacgcaattaaagataatctagggccaggcacctataatcccagcactttgggaagcagaggcaggaagattgcctgagcccaggattttgagaccagtctgggcaacatggcaagaccccgtctctttaaaaaaaaaaaaaaatctaagtgaaaaatgattcaagtctaaataggttgggttaaagtaggttttagaggatgttgtcattggtgctggatatttcaaagaaatagtttgaacttacttataaagtaagaaatgggccatggtatgaggtatgtcactctggtatctggctgccattttaacatcatagtgataataagaggaaataatgggagttaaggaacagtaaactttgggtgaaattgtgttaacttgtaatttccatgtagatacagataaggcaggaatgagtgtcttaggcaattagaaataactcagtctactgtccaaacatgatgtggattttgagaccaaaacaaattataagtaaaagtaagaccctcttaatgacagcctatttaacctttttggtgtttttgtttggtgtgtgtgtgtgttttctgtcgttccttctaagttttccagatgatcttgtgtttcttccagctctctgtgggtttttaaatatttcattttataaatgaaaaatactttgttgtttaattagcattggtaaactggactgttttctgtagcagaaattgaatacaagcctagcaaagtaaattctgagaaaaatgagtagtaattgtcaatggaaaatttcgtggtttttttttttcttttttggccaattctatttttttagatgatagttttgggaaatactaagaatttgagctcaatttactttggggcagttatttaattttctttgggttcagagagcattactactatataaacaattcaaataataaaagagtgttacctcaaaaatgccttgtgtaatatataacagttcacaagaatactatttttcttccatttattacgattacaaagaagtataacaagaattaaaagaaatatattattttgcatatatatttatacttcaaagtaatttatatactaaattaggttttgtttgagatggtgaaatgaaagactttgtaaataagaatacatgttgatatgtgaaaaatgtaa

SEQ ID NO: 4850 - DNA, 1177 bp, Homo sapiens
ctcaatagttacaaagccaacttacagaaaaagagaagccatttaggactgcacaatctattaatactttctagggcacaggtctcctagaccaggggctcccaactcccaggccacaggctggtatcagtccattgcctgttaggaaccaggccacacagtaggaggtaaacagtgggtgagtaagtgaagctctgtctgtatttacaaccactccccatcacttgcattaccgcctgagctctgcctcctgtcagatcagcagcagattctcacaggagtgcaaaccctattgtgaactgcgcacatgagggatctaggctgcacgctccttatgagaatccaaggcctgatgatctgtcactgtcttccatcacccccagatctagctgcaggaaaacaagctcagggctcccactgattctacattataatgagttgtataattatttcattatatattacaatgtaacaataatagaaataaagtgcacaataaatgtaatgcacttgaatcatccccaaaccatccccatccccagtccatggaaaaattgtcttccatgaaactggtccctagtgccaaaaaagttggggaccactgccctagactgtcttaattctcttctgctgtccatttgttttgggggttttttggtttaatcggtgtctccctccagaagtaggaaggagaaacacaaggtaaaagaggagaaactttgccagtggccttaaaagcctttatgaggaaaaagctgaaagtatcttgagaagtttttaatgtttgaagccatttttcttcctatatccattaatgaatggctaatattgttttatttgctttaaaaggactaccaagctctaatcatagggtttatttcttttccagaaagcggatgttggtgctgttaatcaaaagcctttgaatcaaggtcatatgatttctaacagattatttccctcacaacatgtctttgtctcacagcaacaaatcatatcattaaaatcaccaaggcatgtgggctaagtgtttgattagctgtaactttcatttcagaaacggccacctgtggtaaaaagttatgccagtttatgtgagcagatgaaaatgatacacctcatcaatttttaaaattagggtactgacaatatagtcctccatgctgtccttttattg

SEQ ID NO: 4851 - DNA, 1196 bp, Homo sapiens
ttgtgtctggcttccttcacttatcatgttttgagagtcattctgaatttttcatgtctcagttctgcactccttctttactcctgagtagcatggcagggtttgactcctggggggatgggagtactccgcatgttttagccacatgcagacgcaaagaagaagaaaggggatctgcaagtgcggcggtcagggcctggatccccggggtgcccactctcactgcgcttgtctttgcaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaatcaggacaggtgtttgtttttgttttcttttttataaatatgaatatatataatatatatgtccctgtacatatacaatgtgggtgctaatgtggagactgtggccggcctgagccaccaagctgcgggacccagagggaggattttactgcaagtcagcatcaaagcaccggtgttattctgaaaacaccagtggcctcatttttggcttttgcaaagcatgaattttttcatttggattgcactttcctggttcatgactgtacctgtaggtggttgttactttgact

SEQ ID NO: 4852 - DNA, 1219 bp, Homo sapiens
cagcactttgggaggcccaggtgggcggatcacgaggtcaggagactgagaccatcctggctaacatggtgaaaccccgtctcactaaaaatacaaaaaattagccgggcatggtggcgggcgccaccactactccgagtagtctcagctactcggaggctgaggcaggagaacggcgtgaacctgggaggcggagcttgcagtgagccgagaccgcaccactgcactccaggctgggtgacagagcgagactccgtctcaaaataataataataataataataataataataataataataataataataaataaagtttaaaaaccctaatgaatctgggaaaaatattcatgatgtgttgttactttgtggagggaggtgtgacattaaaaatcagtttaaaaagtttgaaggcactacactaatgggacaataattattatctctgagaattgagattgctgccacttttttcttcttctcactaatctatggtttctaattccaataattaaaatgccgtcttagtaaatatgtagtgctcactttggcagcacatgtactaaaattggaatggtacagagaagattaccatggcccgtgtgaaagtatgacatacaaattcgtgaagtgttcctgaaacctgcacatatcaatattcacctgaaattgaatgggctaaatgccccaattaaaaggcacagaatggctactgaataaagaagcaggacccaacattatgctctcttcaagagacccgtaggctcaaagtaaggggatggattaaaatctgccaagtgaatggaaaacagtaaaaagcataagctgctattctaatttcacacaaaacagactttaaaccaacaatggttaaaaaaaggacattaaataaacataaagggtttaagttaacaagacataactttcctaaagaaatattcatccaacacaggagcacccagattcataaagcaagttctttagagacctataaagagacttaaataaccacacaataatatttggagatttaaacattccactgacagtattagatagatcattgaggcagaaaaattgacaagtggaacctaattacactaatttaactaaagagcttctgcaaagctagaaactatcaacagtgtagacagacaacctagagaatgggaggaaatatttgcaaactatacaccctgcaaaggtctgatatccag

SEQ ID NO: 4853 - DNA, 1218 bp, Homo sapiens
atacacacacatacacataaacacacggaaagatgggggaggggagcgagtggagagagagagacacacggatatagaccgacgagagtcaatgcgagtcaagttaacgctttctccgccccgatgcacaagtacccccctcccgtgttaattaattccaaacaaagcaagccaatcaagaaatgcattattattttcaagcagagagagacgagtgccatgtattttttaattgatttatttatttggaggacattaattctcggtctgaggctgattttcaaaccgtttgcaaagcgcggctccattgttcgccaggcgcgcagaccccgccccctgctttgtgtgcggcgcgcggattggccgacgcgcgcgggggccgcgtcagcgcccgcgagcccattcatctgtgcacttgggcgttggaccccgcatcttattagcaaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgtcctctccaccacccccacccccctccctccggtgtgtgtgccgctgccgctgttgccgccgccgctgctgctgctcgccccgtcgttacaccaacccgaggctctttgtttcccctcttggatctgttgagtttctttgttgaagaagccagcatgggtgcccagttctccaagaccgcagcgaagggagaagccgccgcggagaggcctggggaggcggctgtggcctcgtcgccttccaaagcgaacggacaggtaaattctacctgtggttgtggtcatttatttcgtgtctttctctccttccctcctggtggctcccaaggctcattcgtggagaggagtgtggctggattctagtctgaaagttgaatggaaatggatagcctaaattgtggatttttcatagccggggtccccccacaccaaaggagtggttccttagaatcctggagaattcttgagtagacgggaggaaaggagtgataaatcgtctaaaatggcgtggtttggagattggcagaacgtgactagctaggtgccctccttcccccgcccccag

SEQ ID NO: 4854 - DNA, 1164 bp, Homo sapiens
ttttttattttacttttttttaagcaccaaattttgttgttttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtcttttttttttttttttaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaatgtacaaatttgttgtgtttttttatgttctaataatactgagacttctaggtcttaggtta

SEQ ID NO: 4855 - DNA, 1280 bp, Homo sapiens
catacacctatatcgagttgcatcagtagtttcatacactggtaagtctacaggtataaccatttaactaatttatcatgctgtaaagtgctggcatgtcaaagcatttatattttaaaatagatattttaaaaattactttccttttatttttcctttaaattacaagtaagtttgctcttcctgtctgtgccagggtggcgcatggtctacgtcgagcaacagagacactcaggctgtgttctcacgatgactgagtgggagacagcagcaccagcagtggcagagaccccagacatcaagctctttgggaagtggagcactgatgatgtgcacatcagtgacatttccctgcaggattacattgcagtgaaggagaaatatgccaagtacctacctcacagtgcagggtggtatgccgccaaatgcttccacaaagctcagtgtcccattgtggagcgccttactaactccatgatgatgcacggctgcaacaacggcaagaagctcatgactgtgtgcatcgtcaagcatgccttcgaggtcatacacctgctcacaggcgagaaccctctgcaggtcctggtgaacgccatcatcaacagtggtccccgggaggactccacacgcattgggtgcgccgggactgtgagacgacaggctgtggacgtgtccccacttcgccgtgtgaatcaggccatctggctgctgtgcacaggtgctcgtgaggctgccttccggaacattaagaccattgctgagtgcctggcagaggagctcatcaatgctgccaagggctcctccaactcctatgccattaagaagaaggacgtgtggccttcttggagcatgtggccaagtccaaccgctgattttcccagctgttgcccaataaacctgtctgcccttcagggcagccctaccaaaaaaagcaaaaaaattacaactaagttattataatgactttaaaaaatgtgcatgttgatatacaatatgaatttcaagaaaggaaaagggagttataaagcacgttataaaaagaaatatctggccaggtccggtggctcacacctgtaatcccagctctttgagaggccaaggcgggcagatcacctgaggttgggagtttgaggccagcctggccaatatggtgaaaccctgtatctactaaaaaaaaaaaaattagccgggcatggtggcaggtgcctgtaatcccagctacttgggagactgaggtagaactgcttgaacccaggaggtggaggttgcagtgagccaag

SEQ ID NO: 4856 - DNA, 1223 bp, Homo sapiens
gcagaaaccaagacctcatctgcagcttcttcacttggttttcagaccacagccttccagagtccgacaaaattgctgagattattaaagaggatctgtggccaaatccactgcaatactacctgttgcgtgaaggagtccgtagagcccgacgtcgcccgctaagggagcctgtagagatccccaggccctttgggttccagtctggttaacatttgcccttgggaatactcctgcacaaggtctcctaccaccttctgctggacctgtgcttgggcatcagcaatgagtatgccttctattgtgctttgtttttgctgacttttctgcaccctgtttcctttggatattcagttctctcaacctcaagattgagacggtggtgggtatgcttctccacttccatatgaccttcatgctgttctggaatatcacatgctacgaggtcatccttcacactacttgtaagccaagcaaatgatactgtagattgtactgcctttatctgcactgcttggaccctgtttattcccagggcctctgaactggttgctgtcacttggatttctagctttgggagcctgttccacctactcagctctgcattgagcagtatgggcacatgccctgtggacagttactggacgttaatgaactcagaggagaaaagcagtgagccacttgttctgtgtgatttatggtacttcattgctcttccttcacctctagtcactttctattgctacctgccctacattggctcctgccaaggtccctctctctccctgttttccttttttttttttttttttttttttttgagacggaggacggagtcttgctctgtcgcccaggttggagtgcagtggcgcgatctcggctcactgcaacctccacctcccgggttcaagcgattctcctgcctcagcctcccgagtagctgggactacaggcgcgcgccgccacgcccggctaatttttatatttttagtagagacggggtttcaccatgctggccaggctggtctcgaaccccgatctcgtgatccgccctccttagcctcccaatcctctcttaaaaaagtgatagctcagaaacatttgtaaaagcaaggtttttatttcattttggctctgtcattttcagaggcaaagaagttggcctgtaaaatagagtgctagagctcttacgcccctccccttcttcccaacttcctacttcc

SEQ ID NO: 4857 - DNA, 1121 bp, Homo sapiens
ttctttttctttctgcttctcagtttgaataatttcaattaacctatcttagggttgtggattctttcttctccctgctcaatctgctgtcaaacccctatagtgaaattttaatttcagttttatacttacagcttcataattcctatttagttcctttttataatgtctgtttccatagtgatgattctctatttgttgagacattgtttttctagttttctttagtttttttgtgcataggtcctttagctcttttgaacatgttagacaatgaatttaaaatctttgcatagtaaatccaatgtctgtgatttctcagggaaaatttcttttaatttatatatttcactgttaatggaccacacttttaaaatttctttgcatgcctcataatttcttgttgaaaaactggactgattattgtaactatggttaactatggaaatcagattctcctctccttccaggttttcatgttgctgcttgttgtagttatttatttggggacttttaaaattaattttataaagcctctattccttgtcatgcgtggtctctgaaatctcttttcccttaactcagtgggtagctagtggtttgacagcagagagtgctttaaatatctggagccaaaaataaacaaaaagaaaagtctccaggtttttacagattggccctgcattgagccacctcttcaattcttagtcaggctgattacagctatgacttagcactactttactccctgcttgtgctaagcctaaaggaaaactagaagtaaaagcgtaggtctcttcatgttttttctgattgtggactctgccctggacatgtgcatgggccttcagactgtctgatacatgtgggagcttttcacatccctcatagcccaagtatcttactccccacctttccagccaggttttcaacatgtgtcttgtttgcctcaactgtatcttttgttgaggtttcaacatctcattcatttgccttttaatgtttttgaggaccattctttatttacaaagctacttttccaccctgagagaattcccagttatgcaaaacaaaggcaagccctttgcatcagtttttcagggaacctccaaacaggtcaa

SEQ ID NO: 4858 - DNA, 1135 bp, Homo sapiens
tttttaaaaaactataaactagaaattgagagtcttgcattctcttttgtatttgattattgtgtctggatataaattacaatagcacatgaaaataaaatgttttaaaaaattatagtccacattcagttattcttaatatttaatgttggcccaaattcttcaaataattttatgctcatctctccctcatctagtgattcaaggactgttaagtgaattttagcatgacgtatccagatgattgcaacaaataaaatgtactctgaggtcaaactattagcaatatctgctattgactgttcatagtccccttcattagtattagtaatttaagttgctgttacaaggacaagaaaaacatctggcttggaaaaggcaatcctggaaaaaaagaaaaattcagaatatggataaatgctaacagcatagttctgtccttgtatagagtaatgtttccattccgataaagatttatttcaattgctatatcttatggatttggttctatgagtgctttattttaataaatgtgtatttttcagtgttaatttatcagtaacagctatacttaataagtgccttaaatttctttcttcttttttttagagatgagatctcactgtattgcccaggctaggcttgaattcggtctcaagcgatcgtcccacttcagcttcatgagtagctgggctgacaggttgtgtgccaccatgccaggcaaattttttattttacgtgaaatagaagtagatataggtaatgataatagtaagcaactgttatcaccatgtattttacttagatttcagacaattagaaaataggacattcagaaaaatgtggaagctacttacctggggatgtttgacatggcattcatttttctagtgcagtggttctcacctggagtgattttgccccccagtggacatttgacaactggagacatttttgtcacaactcaggaggtatactagtggtatcaagtgggatgaggccaaggatgctgctaaacatgctgcaatacacaggacagcccttgcatcaaagaattagcctcaaatgtcagtagtgccaagtctcagaatctttggtctagtgtgatttctataattttgtcacttaatttgtg

SEQ ID NO: 4859 - DNA, 1197 bp, Homo sapiens
actagggacagttttgtggtagacagtttttccacggatggtgggggaatggtcttgggatgaaactgttccaccttagatcatcagacattagattcttataaggaatgcgttattagtccattctcacactgctataaagaactacctgagactgggtaatttataaagaaaataggtttaattggctcacagtttcacaggctgtacaggaagcatggttggagacagctcaggaaacttacaatcatggaggaaggtgaaggggaagcaggtacatcttcacatggctggcgggagagagagagagttaagtgggaagtactacatggtttcaaacaaccagatctcatgagaactcatttactatcacaagaacagcaagggggaagtctgcctccatgatctagtcacctcccaccaggcccctcctccaaccttggggattacaattcaatgagatttggttggggacacagagccaaaccatatcaattgcggaaccaagatttctcacatgtgcagttcacaatagggttgtgctcctataagaatctgatgctgctgctaatctgacgggaggcagagctcagactgtaatgctcactcacccaccactcacctcctgctgtgctgcccaattccaaacaggccaccaaccagtaccagttcatggcttggggattgaggagccctacagtagtacacaggacagccctgctcaacacagaattatccagctcaaattgtcaatagtcctgtagttgaaaagcctaatattgagacagaagcactggtctgagggacaagagacagatatctttatttgtctctgcttcttagaggtcaatcagaaaaagaaagaaaaagtgctttgaattctcagaatgatcaccttatacatatcctgacattttaaaaaatgatattaatatttgtaatgttgttaacaacagggttaatggcatgcatagatctttaagcaaaagaaagaaacctggaaggaaaggattaaggaaaaaaaatcttttatattaatgaccaagatggagagaaggaaaaagcaggaggtaaaggaataggagaggaaaatgacagggacatttgtagttacttgtttatttaactacatttgtgatactttttaccttgtagtaaacttagcaactgtcattttattcatctttttcttgaact

SEQ ID NO: 4860 - DNA, 1155 bp, Homo sapiens
tcctcagctgtatttggaccactctcagaatcagagctacttatttctgctcttagctgtattccaatgaccatgataatgaggtggtctttccaaccctatgaagacttgtgagcacaaagctttcagttacatacagactgtcaaagcatgagttgtggccagttgacaataggagagaagggtctcttgacctttggtggtcaaatcagtttgccagcctactcttccaagccacacttctcatagccttcaagccttcaagcatgcacaaagtctttctgtatcagggaactgcgctccccatcttgcaaactcctattcatttttcaaaatgtagcccttctctggtcttttggctaagccctttccccaactgggtaatgcacatccatctctgattaatcctttcataggattgtgattactgactcttcactagactgggtgcttttatccaaaggtagagttaatgtcttactcatatacttatccatagcctctagcatactgacatatagcaagggttagctaagtgttttggagtgaatgaatcaatgaattgaaaacaaaaaaaaagtgaaatactgtctgaatatgtcaagagccagtgctagaatatgagtcactcttttcatggttttgcacatgagaaggctggcagatgtgatccgcaaggtcagttcttcaccgccagatcattttggcagtctttgaacagctcttctgcctctctgacttgccttacatgtttgacaatcaacacattcgtcaggatttgtcttgtcaatcagtgattctcaacctgactgcgtattcacatcatctggagagcttttaaaaagtcctggctgggcgcggtggctcacgcctgtaatcccagcactttgggaggctgaggcgggcagatcacgaggtcaagagatcgagatcatcctggccaacgtggtgaaactctgtctctactaaaaaatacatgaattagctgagtgtggtggtgcacacctatagttccagctactcaggaggttgaggcaggagaatcacttgaacccaggaggcggaggttgcagtgagccgagatggcgccactgcactccagcctggcaacagagtgagacttcgtctaaaaaaaaaaaaaccagaaaagtccta

SEQ ID NO: 4861 - DNA, 1207 bp, Homo sapiens
acaaggagagacagaaaatttgagaacttctggttgctacaaaatactggagaacacaccttacatttttagaacataggagcttatgaggccttccagtgactagatatgtgaagcaattgtcctgatgccatccattcttggttaactgcaaataaaagtctttatgcccttctctttaaaatgtaggcatttctttcctttcataggttaagatatgccttttttgtttttttaagacaagatcttgctctgtcacccaggctggagtgtagtggctctaatatggctcactacagccttgacctcctgggctcaagcgatcctcccgcctcagccttctgagtagctgaaattacaggtgcacacaccactgtgcccagcaaatttttaaattatttgtagagacaaggttttgccatgttgtccaggcaggcctcgaactcctgtgttcaagaaatcttctcacctcagcctcctaaactgctggaattacaggtgtgagccactgcgcccagtcaagataatgcttttgaaaataaaagttgatatggcttgcttgtttcctcaggtctgacggtaactgctgtaaaagactcaggagaatggaatttggaggctggggcattagttcttgcagatgcgggcctttgctgtattgatgagttcaatagcctcaaagagcatgataggaccagtatccatgaagcaatggagcaacaaaccataagtgttgctaaggctgggtaagagtttctttaaaatctatgggaataatgagattatttaatatatgcttaggggaaaatgtgaaccttgttgagctataaggtatgtttggtcctctttgggatgatcagttaccacccttcaagacacacattagagtttttccttattagaccacagaagtgtgtgaggaaataaaaatgagctattgggaaagagaaaaggaaaagtaaagtataaatgtggttgactaaactagtggaagggatttttgaagagctttcaatgcaggattcaactcattctctttttcattcagtaaacattgtatgtgtactctgggcatatttctgtgttaggaattttgaaaagttcaaaaagaaaaaagaaatcatagtttccagcattctccttataaatcctcatggaaggttgattacagcatatggaatactaaatagtaaataatgtaagcata

SEQ ID NO: 4862 - DNA, 1231 bp, Homo sapiens
gtgcttagcatcaagtcctcttatttaatacccagcttatggctcttctactaaaactgtcctgaccagctacccttgttgggctttccttgctgtgcgttagcattgattgttggtacctcttacttgatacttaataatgcaaacttgcaaatactgtttattgtgtttataaatatactttgttttcataatttgactgtaaggttctcagctctagggactgtatcttttattacatgtaaccttaatatgaatggtttgcacatagtaccaaagcttaataagtatttactgaagaagatggtggtcataatgatacagcaagtaattttgttatacagcagagaaagacagtactttttaggaattgtatctgctactcttctgggttaatgatagatcatttcagctgagttaaattattcctaaatatgtaaatgtttattgactgccctttaaactgcttcaaaaagctattttatttcttaatgtatttttgatgtaaaaaatacaaatataatgttctttgtctacattataagtatttgacacttcagaatgtaggtaattaatatactagtttcttagcaaatataaaaaagccttgtgatcagtcattttatactaactctgcttttactatatccaaaaccagaatgtgtttatataacaccaaaaccagtgaatttttcaaataatactattttctgtacatgaaataaatgatttttcactaattggtttgtttgaattatctagatactctttcataataattctatattgcttatgacttgagtctttgaacaagaatggtaagtggcctcataaaacatagcaattggctgtgtttcaccttagcactagtacatgccaaatgcagcatctctttttctttgttacattgtagctttgccatgctgttatgcagtggcttggatgtaatcttttagtcatagtggagtggtttggattaatttgttgcattttactaatggacacaaaagcatagtatcctgttaattaactggtcacaaacttataaagggacttcctttagagttaaagatttagagttaaaggttaaaggtttaggttgggtgccctggctcatgcctacagtcccagcactttgggaggccaaggcaggcagatcacttgaggccatgagttcgagaccagcctggccaacatggtgaaatcccgtctttacaaaaaatacaaaaaa

SEQ ID NO: 4863 - DNA, 1226 bp, Homo sapiens
acacttgtcttttgaatggtgtgacaattgatgtagcatcttcaaagctgtgtacgaacaagaggcactataaggttataaatactaaaggaagatcatcattattcatgtgatggaaataatcattcagttaaacaccagtaagaacatcattagatttagaagtacatcgctatcttttcatgctatcttttcatgtgagagatcctttctacagaaagtaataaaggaatccaatttgtaaagaagtatttttactaatagaaccatttatttctggtctactgatataatgccataatcttgttatcataatgtagacaattttgttaacgtgatgattctgtcagcataatgggaagagtaaatactaggatgacagtataaatggagaaaatctctacaaaagtagatctcccatctctctttctgaggctgtgtttattagaaacataagttataaacataacctgaaaaattccacacagttattacttcacaataataatattgttcacaaaaggttcacagaaattacagtgttagtctacagccataccaccctgaacacacctgatctctcatctgatctcggaagctaagcagggccgggcctggttagtacttggatgggagaaattataaggttaaaaagtaatcgtgagtatctaatgatagaaatgttcctatctaagcctgttctcactttccctttttttttcataaaatgtgtgtggcataattatgctagcagtttacatgaatgaagtgaaatatttctaaatcataaagtaagtttatgcaatcccttagcaccagatataactggtagtcccattcaattatgtcgaattgaatcacctgatttttaagttcaaagatactgccttcagtacttttggcatctgcacattgcacattaaaaacatcaaattctcaagatacaagttcctcatatcagtgtcctttgtggcaacatggatggagctggaggctgttatcccaagcgaactaatataagaacagaaaaccaaacactgcatgttctaacttataagtaggagctaatcactgagtatacatggacacaaagaagggcacaatagacactggggcctgcttaagggtggaggatggcaggagtgtgaggatggaaaactaccttattacctgggtgatgaaacaatatgtacaccaaacacttataacacgtaatttatctgtag

SEQ ID NO: 4864 - DNA, 1251 bp, Homo sapiens
aaattcagacaaggcccacagaataagattttccatgcatttgcaaatacgtatattctttttccatccacttgcacaatatcattaccatcactttttcatcattcctcagctactactcacattcatttaatggtttctgtaaacatttttaagacagttgggatgtcacttaacattttttttttgagctaaagtcagggaatcaagccatgcttaatatttaacaatcacttatatgtgtgtcgaagagtttgttttgtttgtcatgtattggtacaagcagatacagtataaactcacaaacacagatttgaaaataatgcacatatggtgttcaaatttgaacctttctcatggatttttgtggtgtgggccaatatggtgtttacattatataattcctgctgtggcaagtaaagcacactttttttttctcctaaaatgtttttccctgtgtatcctattatggatactggttttgttaattatgattctttattttctctcctttttttaggatatagcagtaatgctattactgaaatgaatttcctttttctgaaatgtaatcattgatgcttgaatgatagaattttagtactgtaaacaggctttagtcattaatgtgagagacttagaaaaaatgcttagagtggactattaaatgtgcctaaatgaattttgcagtaactggtattcttgggttttcctacttaatacacagtaattcagaacttgtattctattatgagtttagcagtcttttggagtgaccagcaactttgatgtttgcactaagattttatttggaatgcaagagaggttgaaagaggattcagtagtacacatacaactaatttatttgaactatatgttgaagacatctaccagtttctccaaatgccttttttaaaactcatcacagaagattggtgaaaatgctgagtatgacacttttcttcttgcatgcatgtcagctacataaacagttttgtacaatgaaaattactaatttgtttgacattccatgttaaactacggtcatgttcagcttcattgcatgtaatgtagacctagtccatcagatcatgtgttctggagagtgttctttattcaataaagttttaatttagtataaacatagcttctatattccgtgtgatttgtttcccctgccgagatggagtcttgctctgtcacccaggctggagtgcagtggcgcgatctcgtctcactgcaacccttgcc

SEQ ID NO: 4865 - DNA, 1181 bp, Homo sapiens
gttttgttgtttttaaagactcatctaaatttaatcaagttgctcctccctgaaggcagtatcaggtcacagagaacttgtttgaagacatttggtttcagctaccaaactgagtgaagggacacgacctgagtgatcaggttagatacccacctcgacaaacacgcgaacacacacacacaccctcaagttaacatgatggaggctggagataagtagaagtagtaaagaaagatattccattttgctgacttaagcaagtcagatactaaatagaaaaaaacatagggtaaggagcaggtaatttagtggggattgggaagagaacttaataaatgcaggtttggataagttgaagttgagattccttgtgagccagcaaactggatgtataaatcattctcttaggtttatatgactggagatcacaagaaagatttgaattagaaatttttaattgagaggtttcacaatataaataatttcttcttggccttttagctaagatcaaatgtggtatctgttcttaacagcttaaaatctgatatgtcctctattcaaggacaatatattaaatgtatttttgagcagggagatggaatagaagcttgctccttccattccatacatctacctagtattgcagtgcctccaggaatggtacaccacacacacacacacaaacacacacacacacacacacacacacacacacacagagatagataatacagaagctgtgagaggagataaagattacttagtttacatagtttcttataaaaagttttacatgttatccaagtaattaatacttttttttttggagatagggtcttgctgtgttgcccaggctggagtgcagtggcatgatcacagctcactgcaaccttgaactcccaggctcaagcaattcttccacttcaggcccccaagtagctgggaccacaggtacacaccagtatgcctggctaatttttgtatttttttgtagagacagggttttactatgttgcccagactggtctctaactcctgggctcagcaatctacctgcctcagcccctcaaagtgctatgattacaggtgtgaaccacctagcccatccagcttcactcttattattgtatgcaatttttactatcatgcaaataagctcaggtaaataaaactaatgatcg

SEQ ID NO: 4866 - DNA, 1233 bp, Homo sapiens
tcgtgttggataagcctctacccacccagagtaagtacacacaagaaccagcaaatacttgttacctccacatttcagcatttctgtgaaatccacctgaagatcctcaaaaggagccgctccataagcttgtatgccaggtggaacagtggggccttgcctcttattgtgctgtcggcaagtaatgcactgttgtgctactgctttggcaagggctggcaagagtgagatgtagaagtaccggcctaacaatttttcaagtgactcttgtcctagatgagtggttttgtgcatggccaatatgattatggctcctagcaactgcagcacagctactcttccacctggcagtctgatccatcctccttttattacttgcccctcttctgtgtggaagaagtctttttcttccttagaataggtaggtaccaggtcaggtgtttgagggagtaagggggctgctactgatgcccggtaagaggtagatgctgcttttcgagcttctgaatcagctgtagtgcgctatgccaattgggtgtctgcactaagttcagcatcaatatggtgacctcccggaagcgggggaacagcaggttgcctaaggaggggtggaccggcccaggtcggaaattgagcaggtcaaaactcccgtgctgatcagtagtgggatcgtgcctgtgctgtcagcagatctgagctttcttcttggacaccttatacccacagtcctccaggtgccaaagcagggcatccgtccctttagcacacctgactgctgtggagtgtcccagcagaaggttgtccacgtacaggagcaagatgcagcctaagtctttagcaggaagcttttgcaggtctcgagccagggcctccccaaagatagtaggggagttcttgaacctttggggaagccgggtccaagtgtactgagtagtgacacgtgactccggatcttcccactgaaaggcaaacagcttctggctctcaggagctagtctgatgcaaaagaaggcatattttaagtccagacaggtaaaccagctgtcctcagctagcagcagccctaataatgtgtaagggttaggaactgttgggtgcagagtcactgtagcttggttgaccaagcataagtcctgtactggctggtagtccttggtccctggcttaggcacaggcaggaggggggtgtgccatggagactagcaaagaactataattccataggctttgaag

SEQ ID NO: 4867 - DNA, 1048 bp, Homo sapiens
catttgcagctgcatctgcatctcagacacgtaacattaactgatgttcataatgataaccctgagtcattaaggaaatgttgtattatgtctggtacagtacacttgagaagtaaagagatgaaatggagaaagaactgagacttactgaatgcttgctgtattgcagatactgagagagatgagctacttatgttactgcccttaacaacagaatcctgtgacataggtacagttaccttcattttacaactgagaaaaaaacatgttcagataaggatattttccatatttgaattaggaatccaaatccatcttattctagaatttttgctctccctttatatcaccaacctgtttaattttttttaaaagacatattcaagtcagtatttaaatgagatagccttaggtagtcagtgttagctagtcaaagactcaaactcaaaatattcacaaaagaaagaagagaactaatatttgagcacatgaccattcatgatgatttattccctgtgaactatgtgttattatccccaagttataagttaaggaaattcattaaggcaaagtgacttgtccaaggttgctcattgagagagatgtggctttaatgtgtttttgtttgtttgttttgcaggcttcttttgtcaatccactatgtaaatgttagttttcttaagtcagtcctgagctccctcattttcttctccttcagtttccttttgtaggatagtttcagatgtaagaattctgaaatttataactttagatcccaccttgctctcaagttccctacataacttagatacttttttcatataccgtgaaacactgaaactcaaaagatataattttttcatttcaacagtctccaagtatacctgcaaccccacatttcttgtctaagtgaatgaccccaattactcaagcaagaaatctatgtatcaccctacttgactcagtaggtgctgactggccacctcttgttgtccttgatatgaatctctttcttcctcttcctctaccacttctctaatttaagcca

SEQ ID NO: 4868 - DNA, 1211 bp, Homo sapiens
gagacacctgcatccttgtttacatcatgagccagcctagcccctctgatcttcctccttgtcttttcatatataggtgcttcattctccttacttaattgcaggtttggaatgggcagagattgtcttcagctttctgggctctcacacctgagttttcccatagttcctggtagaggcactgaggagcctggtgaagtttcccctacctctgcctaattgatgattccttgcctgagtctcatccttattctcagttgcacctggggtgacagagcgtaaatgccaagtggtccccttcagccccttcccaggacctggaatctctttctgctttggaatgaagtgtgggtcagatcgtagactagagcccccagtgaaccctgggatcaagctggggaaatgaatatactctcttgtcaatatgggaatgtatttttccctgttcttttgctttgcaggaaaattcaatcaccctgagatagtccagcttgtttctgaacttgaggcagaaagaagcactaacatagctgcagctgccagtgagccacactcctgagacactctctaaattgctgcactcctgtaacaaacattatttttccatttcattgtattgtgttttgccattgttggtctgttgatttccctagatgtgagtctgtttgttttcaattgtctgaacttcagcaagaaatgtgatacaacttgggcactaaaagaagccacagaacaggaagcggtcatgaaagtgccatggatgaacactggaggtggcagtgcctgtttatgaactaaataaataaatattaaacacctaaaatattagaatatttattggagatttaaaatcatcttattctgacttaattaccgatatccccgaaggctaggttcattgaataatagaaaatttcattatgattgcttttaagaacagattcttcagctgatttagtgataagaatccagaaaagaaaatgtactagtgatgtattctctccccagatgaaattgctgccttattcagatttactctcttgagccagattttgaatttcactgcagactgcttcagacttctaatcataggcttgtaaacctactaataggctctgcccctcttcccaatactttttgtcatttagagatataaaccggggcatataaaaatgcaacttgtattcctttgtatatttttccctgtctga

SEQ ID NO: 4869 - DNA, 1203 bp, Homo sapiens
gaataccatactacacaatgatctctgattttgctgagggaaggaattatatatgtgccactttttcctcaaatttcagatgccagttttcactttttgaagcattgcatctttttaataaatctatcctgaaagctatataatatatataatttatatcaatgaatttacaataactatcaaattggctatcagaattcactgtaatggaattttgcctctaataacataaagggggaagaaacataaagtggttctcttaataaaactagcagaaaatgttgctttatggcatgtttttgtatcaaagagaaatcagaggttaaactttgcttttatcatgaaaagggcctgatttgaaggtagagataggcttagatgagaaaaattgataacgcaatgttaatactattgatatttcataggtatattttgttagaaattggttttttggtgctaatctataggcacaatagtgaatatgaatgaagagtaggtgctgcaagttaatcctacattgtgccagtgtatattagtaccatgtaaatgaatatgaataaatgaacatgaggattaacgaactgttgaaaataggctgagatactagttttctttcttttttagagggggcatgatattaaagatagttttaagtaacaaattacttattacaaagttacaacatgtggaatcaatagttttatttgttcattaatttattcattcagcaaacatttgttgaacatttaatgtgtaccagatattgccaggatcaggaaataaagaactaaaaatggacattcagactgcaattgctagtacaggggtcaaacaaaatcagtgattagaatttagtgcgttaagttccctgatgccttcacagccagaagaggctgtgaagggataaacacttctgagagtgggtggtagtagaactgagtattcaagactgaatgttaggcaggtagacagtgactggttaggctgagaaacttacaagtattttcgttgagttctgcttccactattatttactttacaatggatatgaagttcagatttcatcttatttactgaaggtggagaaaggatgtggaagtaggggttatgggctctcaaaagtagatttagagagatttttttatcactgttttatgatatagttcactgagcacttacatagattaacagttacaagtttcc

SEQ ID NO: 4870 - DNA, 1117 bp, Homo sapiens
tgatggtatatttctaattcaagtagtgaaggaagataaatatgcactagagagtgagattttgcttaagattttgcttaaggtaaacaactgctttggtataagctaactaaagaaataatttttacattttgtattttccaaccaaacagaatcgggaccagtattcacatctgctaagtgatcattttctgccataccaaggtcataattccttccgtgagaaatattttagtggggtaacaaaaagaattgccaaggaagaaaaatccacccaggaatgaaaattaagattttgacaatgaagaaagaataagaatttgatttaaaaagacatctggatgtgaactttcatgtatgatccagaaaataggtacggttttaaaatattttatatagaaaagctacaaagtaaattgagcaatgcttttaaagttatctttgttttatagacttttttgttgtatgtattacagtctttataatcttatttaatgtatatttgtactttcaagtactgatggagatagactcaaaacagttatttttttacaattaatctacaaagggaattaatattgttgacttttaaaacatctgctggatatattatatgcaattaatagtagttaagaatttattcatttggtagatatgtttatttggtttttggttgtcatcgatttacattgccactaataaaccatattgagaatttctaaaattgtgtcatatctagttgtcttcatgggggatgtgatgagggaaataaatttttatttagaaattccagacaaggaaggaataacaatgctaatagtgatgataagaaaggctaagacctgacaacctagaaagattccaaactccttaaggcctgtctacatttgaagctcttttgtaccttggatttgctcctgcattcctaaccgttgactgttgctcaagttaactacccacaatttttggtttagaaagtaacggatagttaaaagcagtaacagcaacacaaatgcttgatggttccttaatggtattaagcctaatcagtgccctttgaaatagaagctatatttttcttgaaggagaaactttgctgagtccacattgtgtccat

SEQ ID NO: 4871 - DNA, 1151 bp, Homo sapiens
tgaaacaccatctctactaaaaaatacaaaaattagctgggcgtggtggcacacacctgtaatcccagctgcttgggaggctgaggcaggagaatcgcttgaatctgggaggcagaggttgcagtgagccaagattgtgccactgcactccagcctggacaacagagcaagacttcatctcaaaaaaaaaaaaaaaaaaaatagacaatagaaagttgtcatgggactaaagatttgagaatagggactgatttcagaaaggtgatttggggtgtcagttgcagtggctcacgcctgtattctcagagctttgagaggctgaggccggaggatcacttggggccaggattacgagaccagcgtgggcaacatagtgaggccctgtaattacaaaaataaaatgggccaggtgtagtggcacatgcctgtagtgctagctactcaggaggctgaggtgggaagatcacttgagcccaggagttcaaggttacaggaaactgtgattatgccactgcactccagtgtgggtgacacagtgagatgtggtctcaaaaaaaaaaaaagtgattttggcaatggagtgtaggatgtgtttgagacaggccaggaggtaaataaacagtccatgtgagaatctgaaccaacagtgggaatagacaatagagacagatggaagacattttactcatctattcattcattcaacaaatattttgtcctcattggtatgctaggcactacagggtcaaagattagaaatgataatccctacctggaagaagcttggaaccttcagtagttgtagagataaataatcctagcaaggcatcaagtgcagtgagatacagggggccctatgggaacatgcaggcaaggaatccagcctgccctggggctggggcgtgggagatggttccaagaggaggtgtttcctgaattgccttttgaagtttttatattgggtttaataactgtattgtgagatatattatttataccaaagagtgcataaagcataagtacagtttaatgaataattacacagggacatccctacagcaccatccctgaagtgagtttggaagggtaggtagtagttagccaggttaagctggggaaagatccgggaggaggtaatgatgtgtgaggca

SEQ ID NO: 4872 - DNA, 1236 bp, Homo sapiens
gacagtgttgatcctgtcctctttttagaaacattcctcacttggcttccaggatatcacactgaacaaagttttttttctacttttctgactgttcattcccattgtttaatctttcatttccccaaagattaacttgtcatgaaaaaatcaaaatatggcatttctaccaaataatattaactaaagtgcaagagcagataggatgacaaaactgaaagactacatgtcaggtttcacatatagcgaagaataactataagacagctcacaaatgagagtgaagtatatacttttcaaagatattcacttagcactcaagcaagtaaaatgattttaaactttttctgttttctgaaatattgttataaggttcaaacacctaaaaaatatgaacacattttaacttacctctaataattagggaagaaaatttaaaaacacacaaactaaattcatgcttattgaatttttttcaattatagattatatccaactctgtcaaaccagtttctatataagaaaggagaaaaacctatttgtaaactataataaatcaatatgcctgaatcaaatttcctttgttagaatagaatatgctacgtgataaaggactgaaaaaatagtttggaatgaaagaaattggaaaaaagatataactttatagacaaaacttcaatcattgtattttttgatcattgactcgtgaggttatattttcagaaatattttatttggtcatcttagatgatctacaaagattacctattgtgaatatgtattataattttttaaaaatatacctgagtatattttatgccattcaaatcagaatttgtaccagagagctaaatattctgtataagtgataaataccttgtccaagccatagtaattattgccattagccaagtgaacctagtatcaccttcattcattacacagtctatcatgttctcagaaaggacgcaaggacaatttagcaaggatgtgtagtttatcatgtttatagccaggaggccaggaaaatttatgcagggaaaatttggcaaagaaaatttagtgttagagttataaacacagtaattcctaacatgttagtccttaaatggattactgtaaagaaggtagtaagtttaggtcagagctataacatatagaaacaagaatgattcatatacttttaagacagtattcaaatcaatgagttactatctatttttcttcaacaactgc

SEQ ID NO: 4873 - DNA, 1194 bp, Homo sapiens
gaccacttagatttttttccaaccacttaaaaagtagaagacagattcaaaacactgagcagaaatatcagtaaatttgtacccttccatttgagatcctccaaatgtaccaggagtctgttttatgacttcagcctaccctggtcaccagcagattgagtgcaataaatttgggggcagtgaaaagcattttatattgtgataagtaaagatgacttcaaagccagcttgtactagtgtatctcaaaagccttgaaatatgtatttgtgttaatttagcaattcagccccaggacaaagtatgcaaagctgttacgtacaagcatgtttattataatgttatttgtgatagtcaaaaattggagataatctaaatgtgattagttaaataaattataatctacttgatggcatatcaggcagccattaaaatgacattttaggtgtgtactactacatattaaaaataatattagaatattctgtgtatagaatgattcattaaaaaatctatgcataaataaaaatttacaaagctgtccaacacaatgtagttatctctgggaggtgggatcatcattttgtgtgtgtgtgtgtgtgtgtgtgtgtgtgtgtgtgtattaatgtgttctgttttcaataatgactttgtagggcaattataccagttaagaacaaccaactaaccaggcaaaaaacaaccaaccatttgcaagatttgtttccatgtgcaagaaaactgtattacagcttttcatcattttttaaataaaacgataggcattaaagaaataattataagttaaaaagattcaatgggatgttattttcttcccattacagatattataagcatcttcattttcttctggacagtcaactataatttactgttcttgggctttcctctgaaacttctccagaaactgtggcaggtgcagaatgcatcacctcagctgttattgtatataggtgtgagagaagtggcaaggcccccatctgtgagctacattgcttgccagtttgataaaaagattcaggaccggattctctgccgttaggctatgactctctcacaccatggagggagagaaggtattgtatatactagaatccctgtgtactgcgttctttcaattcttccaaccactatagactatcctgacaagtccgcttagctctgattcttgcttc

SEQ ID NO: 4874 - DNA, 1164 bp, Homo sapiens
aagaattcagagatttcagcactgtcagcctggaagagaaattatctgcaagggattggtgttttgcaaaatattggcataattttaagagctattagctagggtaatccatctgaggtaaatgcacctaaaggaaaatggttgaacacatcttagggtaggccaacagactgtccctgaggctggactagcctacgggaaaagctcattttatttcccgtatcttcaggatctctagttctgcttcctttcttctctgttagctcctacagtggagcttgagaacatatgcattacgccttttgaaggacactgtgtcttatggtcatgttgccgtaactcttcggcaaatcacacctgatccctgaagatgaataaatttaacatgtatgtgtgtgcgccatagttttcattaacgtgcgtacttgtcactaaactttaaatacaaacctgttaaactgtcattcctgatcatgatttgagggagctaattagcttcttgatttgtgtaactttcacagctcttaaccatggttaattgggttatgcttggcaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagaggtaagccaagacatttctaatcagttgttgttagtcggcctgtttacgaccatgaatttaaaaattcttttctattaattctaaaattttaagaaaataaactatttattcttccattgtaaaaggtcagggttcttaatggtaaaattgcagtatatatacgtctggtctgtttttaaaaaaagcaaccatcacgctttttacaaaaaagaaaatgtgataaggtgtgggctcgttttttcttgttgaatcaattaagttgtgatcattaggaaagcaataagatgagttttagtgaacattgaaggatagttggtttatgtgagccgttgttacttgctttttgtagaaaatagtattgcagtctatgaaattcatctttatatgattatattagatatgcaatatttaccttttttgagaagaataattgcttctcacagaaacatctgaat

SEQ ID NO: 4875 - DNA, 1099 bp, Homo sapiens
caggtaggatttttattgtaactcaaattaagtgatggtagttggacttgaacttaccatttccgatgcctagtttagttctttttataatagtttcatagtgtttttccaacacacaatttaatgtctaggtatacttcatttatgcagcagatttattgctgaaaaagtcatgtgcaaataagtgtttagaacaagtgttattttaaatgtaactatagtggctttctaatttaagagacccagtggtgagtctcttaaagtaaataatggcttactaatttattgccaggttttttttttgtgtgcgaatatagtagtgctttttttttttcttttagagacagagagtctccctatgtcacccaggctggagttcagtggcatgatctcagctcactgcaacctctgcctcccgggctccagtgattctcgtgcctcagcctcccgagtagctgggattacaggcacatgccatcaccttagtatgtacaggaatcatcctgggaatttatgaaaaacacagattttctgacccccttgtttctctctgttattatgttggtttgttaagggctgtgagtttttcccattcattttggtattctctacagtgaccagcctggtggagtgtgtgtgtgtgtgtgtgtgtgtgtgtgtgtgtgtgtgtgtgtttccttattaaatgcttaataaatatttgcaggatgatttcaggaagagctttccagaagcgaatacctgaacaaaatgaatactgtgttaattgtggatggagaatactagaaataattcaatgctgtttctagtgtgtgctgaaattggttttcagttaagctgttaagcattatttttgaaacattctttttactggaaagatcatttaaaaacatgattattttaaaattccacagaataattttgctggaaaaggtataacagaaaataactgaatggaaaaaaatcacgttgtttcaaacaattatcccaagccagcttggaagttacagttctcttctcatagaagatttctttagccacaagctactgggaattgttcagcccattggcagctacacagaacattgcccttttcacc

SEQ ID NO: 4876 - DNA, 1198 bp, Homo sapiens
gctcagcctgcatttttcaactctagaatttctgcttgattctttttaattatttcaatatctttgttaaatttatctgataaaattctgagttcttcctatgttccagttttcttgtctttagaattggcttaatagtattagccctacctgtttttggataaaaagaccacatgaaaatttatttacccttgatctttaaaaaatatgaatttttcacatgtatgccaaatgattctgtcctcctctttgtgcattctaatttgatgcttgtgaaatcatagcaatgttatattgttaatgtatagtgcatttgttattgtgcttattttatgttttaatttttttattcaaaagtaatatatgctcattttaacaattctatccatatatatgtattatatttataactctggtctcctctatttaatttcaacccacatcccaaagtattctatactatttttccatgttagtaaaaacatatagatcatctattttctttctctcttttatattccagagaatcatattatagatgtaataaccatgtaagttctctctttttgcttaatggatcatggccatcttctcatgtctgtgtgtgtaattctaattaattttattatcttcatggtggtcatatggttatttatcaaccatttatttattgatgaaggttgtttccagtttgtgcaacttcaggaaatgctttaataaatatcttttcatagaatttcgtatactgatgcttttatttcttcgtattttcctagaattggaattgctggctcaaaatgcttgtatagcctaaattttaatagttgctacccagattattttccattgtagttgtggcagttcttattctgcaacaccattatttcttcatatattttctctaactccatctctttcccccttgttcaggaacttcagttacagacatattagacaactcgaagttgccccacagcttactgatattctattctctgttcttttttctttatgttttctttttcttagtgtgttttattttggcttctattgcattgttttcaaatttaccaatattttgctctgctgtgtctcacctgttatttccatccagttaatttttctcagacattgcagtttccatctgtatataaatttgatttggatttggatttaatagtttccatgtctctacttg

SEQ ID NO: 4877 - DNA, 1157 bp, Homo sapiens
tttccaaattggaaagtactcaagtgcctatggacagtagaataagttctggtttattcattcactggaatattagatagctatgggaatgaatgatccataattacttgcaacaatatggaggaatctcaaacataatgtcgagtaaaagaattgagactcaacaaaatgcacactgtatgattttatttgcatataaatgtaagtacaaaaatagacaaagctaatctatgctgttggaaatcaagatactgatcatccttggtggggtgtggtttggagaatttagtgaccacaggaagcacaagcatcctgataatattctgtttcttcatctgggtgatgactacacagggagttcagttagtgaaaatttatcaaactatgcttctgtgaaatgtgtgtgtgtataacagaagtaaaattttaggccaggcgtggtgactcacacctgtaatcccagcactttggaggccaaggcgggcggatcacttgaggtcaggagtgggagaccagcctggccaacgtggtaaaaccctgtctctactaaaatttatccggttgtggtggtgtacgactgtaatcccagctactctgaggctgaggcatgagaatcacttgaacccaggaggtggaggtggcagtgagctgagattgctccactgcagtccagcttgggtgacagagtaaaactgtgtctcaaaaaaaaaaaaaaagaaattaaaaaaataaaaaatgacagtgtctggctatggcccaaaagttacccaattattttaccttaaacacaggtctaaaaaaggattgcaatgcttttgaggtaaatgtagctatccaaaacaatggacaaattttgttttccattttcaggtttgacctgccaccagttatcttgttttctatggatggatttagagctgaatatttatacacatgggatactttaatgccaaatatcaataaactgagtaagtcttctgtaactagtggcatgcaaatgataaagacacctagttagtcaatctctagaggatgcaactttctttctgacttttaacgctggtggtttgtcttagcctagatcctctctgactttaccacatggtttctactttcattcggaagtatattttcacgcttgctggcttctcctacct

SEQ ID NO: 4878 - DNA, 1135 bp, Homo sapiens
aaagctatcacttaaggttcctgcttaaaaggattttattattgtactggacactaatgtatttgacattgtttaatttttaaaatctatttcttaaaagaaaatagttttaaaacagcctttaaggataggactgtaagtattgtcatttataaagtgtcatttattttaaacatgtaaaattattggccctcagataccttatatttaatccttttaacaactcttcatagtaagcagtaattttcaagttttacaaataagaatctcatggactgtagaggttaagcataggcaccagtgtttaaaccagtcttactctaaaatacagactgctccccctataccacacattgctcctctgattccacacattgttttctcaaatccttgaataagggttattattgaggctattaagaatgattgccaacattgacttgaactagaaatgtcagaatgaacaatagaatgaaaaaatgacagttttgttttttacttttttttttttatttttaaccactgggttagaatagcagaaggtagaattaagagaacaaaaagtaattttcagtggtaatatgctgactgtatcaagagtagcaggaatgatactatcaaggaagaaaagaataaatatttcagcagacaattaatctatctcagggctaacaaatctaaaacaaatataccatcaataatactctatttccatttcctggctggaaagagctacacgagcatataactttgaattgttttgtaaggccaggtgacctgcagctggctcatggttaactgctggagcctcactgaagatgtaaatactgttccgcagctttgtgatacatagctaaagaccataaatgtgtatgtaatgagtcagagagcagcagttcattacttggggcctttgtcacatatgcatcatatgaatactgaacgacaatgatttgcatggaaaatcagtttaatgacagagaaacaaatacatagtggttgtgagctttcaattttgtgtctaaaaaacggattctaatctcttttgtgccatttattggctgtgtctcttttcctatcagtgggatgtacataagggtcttgggatgggtttattgtataagctaaataaaaa

SEQ ID NO: 4879 - DNA, 1533 bp, Homo sapiens
tggcagagatagaaaactcgcagtacgtttgcctcagaaccgcctcaatccggaaacagaaactccccaggcccggcactgcgggagccacctctttcgagggtgggagtgcacatgcgcacaggggacctgaaaaacccttaaataccggcatgcgtgcggatgaggcctctttccctgccgccgccgagtcgcgcggaggcggaggcttggggtaagttgagcgaggcggcaggggggtgtattggttataatttgtggctcgttgcgttcttgctgggattcgtgacgagtatctggttctttaacaagtcaatgcttttgttttttagtgcgttcaagattcaacttcacccgtaacccaccgccatggccgaggaagggtgagcccaggggccggggttggagttggggtcggggtgcggctgaggcgtggggctagagctggcggaacaggactgggtcaaacgggtcgccgtaagcgcgtctgttgtacacttagcttttgctgagtgcaaggccttatgtggtgtgaggattttaactgatggttctgatgtgtcgcgtttaagcattgctgctggaggtgtaatggacgttaatactgctttacaagaggttctgaagactgccctcatccacgatggcctagcacgtggaattcgcgaagctgccaaagccttagacaagtacgtgtatcagtctcaatactgtgggttcttgcaaccggaacaaaactgccacccaagggaagaaggcatggagttcatggtgttagcgcaaaagttctgaatggcatccgtcctaccggaaacctaggaaaaggtatcagaactcagatctataaagcccacttaaaatgtgtgggttgctgtttggaatggggataagcactcaaaactacagtgtttgaatgatgactttaattgtcggataccccttcactccttttatgagtgaaacataagagtctgacaaacctgtaggttgtggagctagtcagtcttatacttatctggcagatagatgagatggagagccacattacatctggtagtttgcaaaacaagcattaatttaatggaatttcaaactcaggtttcagaagcatttggtcctagatgaatttagtagtataatagctgtgatttatttgaatttgggatatttgttaatgtatttgaatggatcgagttaatgtgttttttagggtggtggcattgacaaatcaacctactcttgagctgaatttaaatgcagttttaaggttttacaggacaagttcgttttggtgtaatctagccagttcaatccgatggaaacggcattattgtttaatgtatttagtaggtcctagtatgagtcttctgtatttctatttcggcattattgcatggcatttcataactgttccattaatgccacagtcttttttttttcttttttcttttttttttttgagacaaagagtcttgctctgtcccccaggctggagtgcagtggcgcgatctcattgcaacctctacctaccag

SEQ ID NO: 4880 - DNA, 1533 bp, Homo sapiens; identical to SEQ ID NO: 4879

SEQ ID NO: 4881 - DNA, 1196 bp, Homo sapiens
gggacagaggttttactgaagaccagttgtaggttaattgaagatgtatatgctccctagcaggttcttcagactcaagcaattttgtacgcatttatgtgttcagtggattggctgcttatgtttcgcaagtgttagtgcaaagataaccctcctaaaatgcaagaatgatggatttggatctgagttttagctccattttcattgtaatttgaatttcaggcgccaagcccatctttgtgtgcttgcatccaactgtgatgagcctatgtatgtcaagttggtggaggccctttgtgctgaacaccaaatcaacctaattaaggtaaggctgctaaggattgtgttgggactaatgttcagtgatgcttgtatatgggggtaaattctgtgaagtctcaagctgttcattttgtgcaggtgtaaacattacgtgcacctgatactgtcggccattttaaagatgattgtaggtagaagcattttatacctgcagaattgaatcctaattttgacgttggtatacaacaaagattagtagcaggcttgtaggtgatcttagtgctgtacatgatgacaactggctccctctactgaactgccatgaggaaactgccatgtcacccttctgattacagccaccttttgggtttcatttaattttggtagtgttaatgtctattaatgtgattttttttttttttaacctttctcccaataggttgatgacaacaagaaactaggagaatgggtaggcctttgtaaaattgacagagaggggaaaccccgtaaagtggttggttgcagttgtgtagtagttaaggtaagtcaccgtttattctagggatgaaggttatgctgggtaatcatataaaaccttgtattgaaataagttgaggatcttataaaaggaaaaaactgattcaacaggtttaaagcattttctgcatttcaggaaaaaaataaaagctgtaatttacaagccagccaatgaatctgcttacctgattgtgtttgtgcagacatactttaaaaactggcaatagtaaagccatgttacgagccttaaggacattgaagtcgttaaggtccctgagaatggctataacaaatcttagtgatgggaaacatttttataagacatagctaattgttgaagctccactataattgatactaatagcttggtgaaattc

SEQ ID NO: 4882 - DNA, 1196 bp, Homo sapiens; identical to SEQ ID NO: 4881

SEQ ID NO: 4883 - DNA, 1196 bp, Homo sapiens; identical to SEQ ID NO: 4881

SEQ ID NO: 4884 - DNA, 1190 bp, Homo sapiens
gcgtctcactggctggagtgcagtggtgcaatcacagcttactacagcctcaacctccctgggctcaggtgatcctcccacctcagactcccacgtagctgggactgcagacatgtgccaccatgcccagctaactttttttctattttttgtagaaacgaggtttcatcatgttacccaggctggtcccaaactcctgagctcaagcagtccacctgcctcagcctcccaaagtgctggggttacaggcttgagccgctgtgcctggcaatgtctattttattataaactcttacaaaattctgaaggagttagtttatcccagctttatatggcaaaggtataatcatacttctcactttatatttctataataaaataatcatgtgaaaccaattgatagtagacaaatataagatggactgttacttttaagtcttataaaatttgtaagtttctagatggacactcagaataatttttccttttgtattattatgactattcattatttctggttgcctcaccttgtacactatatatttttttctcacctcaaaattatgaaaattgtgttaatggaagtatctttttttgtacagtggacggcctgtttcatcttactatgaaaaagagaatgtggattatattcttcctattatgacccagccatatgattttaaacagttaaaatcaagacttccagagtgggaagaacaaattgtatttaatgaaaattttccctatttgcttcgaggctctgatgagagtcctaaagtcatcctgttctttgaggtatgaattgaatggaccaattcaaattaaacgatagttaatatttaatagcacaaatgtaagctattatttttagtagtccagtaaggcaaaaaaaaaagttgtgtgagaatttaatctctaggatttagttttccaatgctgtggaatcaagtgagacgcccttttataaacagtgatagcatatttgctgagtgtttactatttaaccatttggcctactttgtataatttaataattacaacagctctgtgactgttaactgtagtgaagtgatgaatccactcgatatgaatgcatttctccattttaaacccatttcacaaagcataaactcatttaaccatgtcaggcaccctaagaatatgtgtaccacctggataaataaagataa

SEQ ID NO: 4885 - DNA, 1164 bp, Homo sapiens
gatcagtggttgagtagggtcagagcatggagggaaggcattgactgtgtaacaggacatgtagaatgatggaaatgttcaatgtcatgattatggtggtggtcacatgactgcatacatttgccaaaattcatttaattatacaattaaaattggcaaattttattgatgtaagctatatctttttttttttttttttttttttttttttttgagacggagtctcgctctgtcgcccaggccggactgcggactgcagtggcgcaatctcggctcactgcaagctccgcttcccaggttcacgccattctcctgcctcagcctccccagtagctgggactacaggtgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctgatgtaagctatatcttaataaagctgattttaatagcagataaaccaaagcaaaaaaaaacctgaatcatttaaagaggtaaaaaattggcaaaggtataataggaacatgaatgaacaaatgtatttgggacgtttcaaaattcaaacataatttgatccatgaaactgctgaattccacaaaggagacttttttaaaaaaaatagtacagtacaactagaagttaacaaaagtttataatttacaaactacttgggaatttatcccataaagctgttagagggaaaaaggaaatcaaaaccacaaaatcaggctatttaaaaagtaatgaaaatgtcagtgtaatgctatgaaaggtagagatgctactgaagatactctggaaacttcattcattgctgtatttaaaaaacagaactaaagaaaaagacaaattaataataaagtcataaaattaatgttattagtgcaaaggctgacagatcagtggtaaataaacaaaaaacagccttttctgattagtttgcctggagtttcaattttaaaattttttccttgagaccataaatctttcttctctttctaattcttgattagctcttttttctaattatttctttcaggagtatcctcacaatttgtatatattggtgctacatt

SEQ ID NO: 4886 - DNA, 2272 bp, Homo sapiens
attttagtgaatgttataatattttaatgatatttttatgactttctgctgcatctttatgactaaggtaattttgggaaaaacttaattttatctcattgcatttggtgtaataataagtggacttggattgacataataaaaaaacaaaactcaggattctaaaaatcagtggtaatttagcagttgagatcttccaaatgattgtctgggtaaccttcagtgcttgggttgctaagtagtaagatgtagttattctcttgatgatggaatgtatttttgttgaaaaattcagttttactggttttgttttattgtgttttagaatattaccaatctcatatacccaatcttcagaagattaatactgtgatttatgattggagaaatgatcatctttacaagaaacatttcattgacaattgtttttaacctttctgtagcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggtataaaatttcaacttgtgattctgacagattttttttgatataggtttggtgggtgaattatttcatttttaggaacaattattaatatggttccttttcactctccgcatcttttgttaatctttaattttttctctctcttttaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgt

SEQ ID NO: 4887 - DNA, 1153 bp, Homo sapiens
cttgagtcgggaaatggccgctgtgtggttgcaacggagataaattcccggaaccgcgattcggcgtgtcaggtaggcctcgcaatgtattcaagttactccaggggcagtgaagaccgaggacaggccatatttttgactcttttgtgggtggtgtcgggttggcggcgaaaggagaaccaaggagacgttgcgccgttatttatgcgttttttcgttagcttctctcaggttttcgaggcactacgggccgaaaaggccgggcgggggcgctgagcagtgctaacggcgggcgcgcgcgtgtttgcgaacctgcctggagacccacagcccgcgcggcctcccgtgcgcgtgcgcatatcttcctcttccacccttcccccatttcttcagcccgtacctctgcgcgcgcccgactgaacgctccgcgcacgcgcgctcgttcatttttctctcccccgcctatggcgccgacggccgctggaggtgcaacttgtgtccgcctctcattggctgggactgccacctttcttcgtggcctgtggggttttgagaaaataactgtgacccgcagcaaagtgcgttgagtaggtctaccccttttcgcgtggtctttaaaactgccctccggcttcagaccacccgtcagttaatgcctcgtttttgtgatgctactaggttttagtgctctgttctgcctctcgctgctgaccctggttctctggagttaatttcggtacccgcggcaacctgctgttttgaagcgagcgcgcgctgttgactggtgctggttgcctagttacggttccctagcgagaggattgggtcttagctggtggttctgagcgtggccctgccccatccggctgaaagtgcggttcttcatgagtactagcgaagccgagtcttttcaagtgattcagcccatttagtcgtgtcagaaatgttgcagccacgattggtggacagctggtgtgagaaatgggtgggagtggcgaattggactttgccttcattttaaattcatgagttggcttgattcgcttttaagatttatttcttcagaatcaagctgaagtaccagcagctactttgctacctcagacttttttaaaaagcattttagaactggaaacaaattaagactgaagtt

SEQ ID NO: 4888 - DNA, 1108 bp, Homo sapiens
cgccttggtctcccaaagtgctgagattacaggtgtgagccatggcgcccggccatatctcaccttcatttatttatttatttatttatttatttatttatttatttatttagagtctcactctgtcgcccaggctggagtgcctaggttcaagcgattctcctgctttagcctcccgagtagctgggattacaggcgcttgccaccatgcccggctaatttttgtattttcagtagagatggggtttcgccattttagccaggttggtctcaaactcctgacctcaaacaatccaactcctctgcctcccaaagtgctgggattacaggcatgagccaccacacccggcctaaatcttaccttcttaatgagcttcccaggccttcctatctaaaattgcacgtccctgctacactgtaacttcctaaacccttccctggtttattattctccttaaccctgatcaccatctaacatactatagatggtattttacttatttgtgtttattgtccgtctctcattagaaagtaacctgagtctacagctataccaccctgaatgcgtccaatctcttctgatctcggaagctaagcagagttgggcccgattaagacttagatgagagcatgtaagctctcagtgatagcaggaatttctctccattttgttctctgccatctctccagcacatggaatggtgcctaccattcaatagctgtccaaaaatatgtgagtgcattagtgagatccatttggacccactgatgtggatgaagatgattttaggctgaaaacatcagaaaaacagcagcagcagaaaaaaaccttatctaaatttcttttgcggacataagcaatgcctcctaaaatacatctgccatttatttcctctccaggaggttaatgaccaaagaggagatagaccacttgcacctagaggagatgttgcataaacaaaaccttatcaaaactttctgttcctcacacttatttctcattagtctcccaccatacactttcttaaagtcttaaccctctttcttactaagatgatatataaacactcaactctagctgtttagggagccaattctttgtgtaagt

SEQ ID NO: 4889 - DNA, 1193 bp, Homo sapiens
tgagccaagattgtgccactgcactccagcctgggcgacaagagcgaaactccatctcaaaaaaaaaaaaaaatacagctcttcttgagctatgctacatagtaaatgtattattcttccagagaatgtattcttcaaaagtacactattatagttaataaagtaatgataaagctgataatgagagtgatgttgaaataattgattctggcaaggatcatcaatttgaactaaaagtattaaattgaaatgcttatttaaaaaaaatttacattttaccccttttacatgataccaaagctaactcatagataacttgttagtcacaaaggaacaaatgtacctgtagaatgggaagacccagctgtcagtgatccatccttgtatcactaataatagggtggcgagacatgtgcccttaggactttattatgataactgtgaagtgtacagcagctcttctttttgattttttaacttttattttttgagatagagtctcactcttgtcacccaggtctggagtgcagtggtgcgatcttggctcactgcaacctccacctcccaggttcaagcgattctcatgctgcagccttctaagtagctgggattacaggtgcgtgccaccatgcccaactaatttttgtagttttagtagagacaggattttgccatgttggccaagctggtcttgaactcctggcctcaagtgatctgcccacctggcatgagccaccacatccggccgagtgtacagcaactcttgtgaaatattgtcaccaaaaatgtttaacttgaatcttaagatctaaagttctcttaataggaatcacaagctctagagaaataagtcaaataatcccaagaagttacatcagacagatcagaaggtgagcacactagagcagcagtccccaacctttttagcaatagggactggttttgtggaagacaatttttccatggaccaggggtggggggtggttcagggatgattcaggcacattacatttattgtgcactttatttctattgcattgtaatatataatgaaataattatacaactctccataatgtagaatcagtgggagccctgagcttgtttccctgcaactagatggtcccatctggggggatgggagacagtgacagatcatcaggcattaggttctcataaggagcgcacaacct

SEQ ID NO: 4890 - DNA, 1201 bp, Homo sapiens
ttgtgggaaaattacaaaaaaaaaaaaaaaactacatgaacaatgcacacattagaatgggaaaagcaaaaatatgaaaataattgaaatagccaaggaagaggtaatacttactaccctccaaaatgattataccaatgtgtactcccatcaaatgtgaatgaagtacctgtttttacaccctagctaattgactgaaataagtctttaatctcggtaaaacactttacacattaaatgcatttgcatttctttagtaaatttgagcatgtttttatatcttatttatagtttcatgccaactcatcttgttctttgtccatttttttatgggctgtttatatctttcttactaccctttatctgccctgagttacagatttattttataatttcctgccttttgacttaccacacagatgtttaagttgtttataaagtcaaatttatttatttccttctatttttaaaaagcccttcccctttccccaaaagatagaagttttcactcatgttttcttctggtctttggtgatgattgttttacatttaattcttctatccatctagatttttttcctttgaggacagagatagagatccagctttatttttttgttttagtttcctgtggctgccgtaataaattaccacaaacttgggtggcttaaaacaacagaaatttgttatctcacagttcagaggctagaggtctgaaatcaaggtttcaatagggccagattctatctgaaagctctaggggtggagggccccttcctagtttctagtgattgttgtcaatccttgatattctctgacttatggctgcattattccaatttctgcctcttgtcacctggcattcttctctgtatgtctgtgtccagatctttataaggacaccagtcaattggattgattagtcccactctaatccagtatgacctcctcttaacttgattacatctgtaaagacactttccagttaagatcacattcataggtaccaggggttaggacttcaacacatctttttgaggatacaactcaactcatatatttcccttaacaaattagttatcccaaatactattcattaaattatctaacttttctatgctgatttcaaatgtcacatttatcacatgccaaattctcagcactcctggaacagttttgttgttcagtcttttcccgtcta

SEQ ID NO: 4891 - DNA, 1177 bp, Homo sapiens
ctaaaataatttgggagaaaatattttttaagtagtgttatagtttcatgtttatcttttattatgttttgtgaagttgtgtcttttcactaattacctatactatgccaatatttccttatatctatccataacatttatactacatttgtaagagaatatgcacgtgaaacttaacactttataaggtaaaaatgaggtttccaagatttaataatctgatcaagttcttgttatttccaaatagaatggactcggtctgttaagggctaaggagaagaggaagataaggttaaaagttgttaatgaccaaacattctaaaagaaatgcaaaaaaaaagtttattttcaagccttcgaactatttaaggaaagcaaaatcatttcctaaatgcatatcatttgtgagaatttctcattaatatcctgaatcattcattttagctaaggcttcatgttgactcgatatgtcatctaggaaagtactatttcatggtccaaacctgttgccatagttggtaaggctttcctttaagtgtgaaatatttagatgaaattttctcttttaaagttctttatagggttagggtgtgggaaaatgctatattaataaatctgtagtgttttgtgtttatatgttcagaaccagagtagactggattgaaagatggactgggtctaatttatcatgactgatagatctggttaagttgtgtagtaaagcattaggagggtcattcttgtcacaaaagtgccactaaaacagcctcaggagaataaatgacttgcttttctaaatctcaggtttatctgggctctatcatatagacaggcttctgatagtttgcaactgtaagcagaaacctacatatagttaaaatcctggtctttcttggtaaacagattttaaatgtctgatataaaacatgccacaggagaattcggggatttgagtttctctgaatagcatatatatgatgcatcggataggtcattatgattttttaccatttcgacttacataatgaaaaccaattcattttaaatatcagattattattttgtaagttgtggaaaaagctaattgtagttttcattatgaagttttcccaataaaccaggtattctaaacttgtttccagtttgtagtttttccatttttcaaatctggggaaag

SEQ ID NO: 4892 - DNA, 1140 bp, Homo sapiens
cttagattttaaccatttgatcagcagagccttgtttttggcctgttgtgctgcatgatttacagtgtgcatctggatttgtaattatgcctcacatagtttatattttgattcacttcaggcttttctgctttctcctctttacctgcctctagggccatatggagtggaagtttgcatgttgttgtaaaagcattttgaaatgttcatcagactttcatggtttccttacttcccttttaggttttgcattttaaattaggttatagaattgtgaatttaccaaactatattgtggattttattcaaacagtttctgtgggtatgaaatactggtcatgtgtatgtatcaatattttatatggaatcattatatttcttggggttaggctgacaaaaaacaatctgttagcttcattcatgagaggtattcagatttgaaatttttgactttggaataaatcagttttcctcaacttatattttaatgttctgtgatatatgtgatctaaagatgactttgggggtgagagtggggctaaaaaaaaaaaaagaaatagatgataaaaaagatgactttgagtaatttttaaataattaattttaaatatttttttcttgatcaattttggacatatgagttagaattcatttagaatatatatatatatgttgaatataatcataggtaatataacaaattctataatagtagaaagtaagttttagatttttttggtaactcttttcacaaatgttatattatttttcccctctggtttgaaatgaatagttttgagtctttgagaatggtcataccataaaattatatctgtgttccacaaaagttagtaattggaaaaggaatgaacatttaattaaaatatcactagcttaaactatcaataggagtctgtaactctaagtttacttaattttccttagaaaattttatgaaatactcccttgaaatcaaatcatattatagcaagttgcttcaagttagtatatgtgaactgctagttcacaacaatcatgactgattgttgagtctactttttcatttttactgaggtatggataagacttagacatgccctcttctttgacaagtttttccttgttgcaacagattctata

SEQ ID NO: 4893 - DNA, 1202 bp, Homo sapiens
acttttgagatcaagagatcctcttgcttctgccttccaaagttttgggattacaggcatgagccactgcatctggccatgctactttgtatctttttaaacatgtagatgttttcaaagaatttctagacctctctggctttgacattttttgtctcttaattgtattataaacacctagggatgtgattccatagtttacgtcctcctacacaggattaaggaggcagctgcttcttgggttttagcatatacaagtttcttcaaggtcttaaaggaaaaaaagtacttgttaggagggctacatgtcactgggcaacaggaacttttcagcttcattataatcctatagcaccaccgctgtatatgtggtcctataagattataatggagctgaaaagtgctagcgagcttcttaactgggataaaagtttgtttgtaaacgtatgtaaatgtatttacatgtgctagcccagggtcaacctaaaaggtagcgaaagtgtttagcccagaagtctacatagaaactagggttgtctacctccataccaccctgaatgtcccccgatctcggaagctaagcagggtcaggcctggttagtacttggatgggacaatagggctaaggtgagtagatttaatgctccaggataacgacctttaccgacaggtcattgtgtggcacgtggctgtatgtagttattaaaatgtaaatacatatatttacaaacaaactttttttcccagttaagaagctcgctagcacacagcattctgttgaaagccccctttatttcgcagtcctgaagggagtgagggaaggaagtaaaagggcagaggaaataatgaatgaatgcgagacgccgattgtacagggacttgtttccatactgctctctaccagaaacgttctcagtttccttccttctgctggacatgttccaagggccaaaacctcaaataatgtgactttgtagattggagagtgtgtgaccacagaaaggaaagggaggcagcacgtgccagccggcgacagaatgttaagtctgcagcatactccaccgcaatgaaacaaataatttgtgtatttcctccccttccttcgcccagagccactgtgagaatgggctacagaaagtttcgaggcagtaaagccagttgttcacccagaacatctgactgccataaaaattatggtgacg

SEQ ID NO: 4894 - DNA, 1163 bp, Homo sapiens
gggaggcatgtatgaatagcagggttacgagcaatcttcctccagagcgactaaaatcctttcaatacattctaatatagtaatgttttcacattctgttctttttctttaaatttaatttcttgcttacattctgttcttttactcttagggatttaaaaagatgatggcaaaataatttttcaaatacttttgccatgattattaccttaatgccgattatttttaaaggaaccatcagctgataaaaagcaattttcttctgagccaagatcttttctaactctaaaattctattattttcagatttttaagtgagggaatacatttatatatagaaagttcaaaaataatctaaaattttagattatttagatatttagatcgtttctttaaaaatttttacatttaaccatttcacatgttcaaggacatgactataaatttgttttaattttttcccataaatatgtatcatatgtctctgatgaacacagtactgataatgagaaaatttttcttggcattactttaaaaggtcagccagccttgatttattcacttcatggtaagtccatcatgggtgtgtgtgtgtgtgtgtctgtgtgtgtgtgtgtgtgtgtgtgtgtggtggagggatgtttggaatctcttctttgtgtattgtttacacagtaactgtggatgtatacctcctgatgcgtgctggagctgggcccattgtctaccattttgcaaggtgttgaatactacttaccttatctggatccatcatgtgctaaaaagtgttgaaacagccatttaaatgttctcttacttatagaatactgggaatggaagtattagtaaagggagaattttggagagaaagatggccaagtctgaagtatattactttccaaaactctttcagctgaaatctttactgttggtaaaagacagtaggcaccgaggccccttcgagcggacttcctcactcctaagaaaaaaatctttatcctcatttacctccatgatagcgaatgccacattttaaaatataaacttgattttagaatagttttagattcgcagaaaagctgaaaaaatggtacagagagatcttatatcagcatgatacatttgttacaaccaaggaacaaacactgatactattcctgtta

SEQ ID NO: 4895 - DNA, 1175 bp, Homo sapiens
ccatttttaaagaaatgctgcttagctttttggactagaatggtattttagtttaattctcatcagccactattagaaagaatacagatgtgaatatatgaatgaactttcagcatctcatctgtctttcagtaacaagagactaatactctttctcctccggttacacaaaaccttgtgagaagctgctattcttaggtatgagttttggatgaattttagcctttgtctttccaaaataattatttggtttacattacaaaatagacctaagtatttcttcgattcggcaccatctagatgtacctatagttgtgacagtatttgaaaaggccaggcatggtggctcatgcctgtaatcccggcactttgggaggccaaggcaggcaaattgcttgagcccaggagttcaagaccagcctgggcaatgtggcaaaaccccatctctacaaaacattcaaaaattagctgggcgtggtggcaaacacctgtggtctcagctacacaggaggctgaggttagaggctgcagtgagccgtgatcataccactgcactctagcctgagtgagagagcgagaccctatctgaaaaaaaaaaaaaattttttttttaagattttctttcatgcacacacatacaaaaaaaaaaaaagaaaagaaaaggaaggaaggaaagggcagaggaagttattttagaacaggaagctgccaatgtactgggaaagctttagaaaattttgctagtagaagatgattcattctaaagcgcattgttgcctcatgtaaaagattctccagagtctctcttagcttacaaaataattgggttttgatcacagcgaggctgaacacagatccctttcagatggatcaggcttgagttctcaagggtaaccatgagtccagcagttgctgtagctgtcattcctcaccccacagcagtgactgtaacgtgttcatctgccactctccaggagccttcaactttgttaaatcattgtttgttcaatttaaatgtagcacttcatgcccacatcatcatccagcaaccccagatccaaggctggaactgaggcccctgactgcaaacatttacacacatcctcaacctaatttcgtcaaagtagtttgtataacccggttttattaaagggtgattcgtgtaccctgagaac

SEQ ID NO: 4896 - DNA, 1152 bp, Homo sapiens
cattaccttctgggtgctgtgatgcaaaacaatgagtctcacttttccaggaacttgtgggattgagaaggcagagaagcaatgggtggtcaagatgtagtatgctaagcactctagcgggatcgtcttcaggtccccatgggacagacgtgggggcaaggaattaaactgaaggtccatgaaagcttcctgaaggagctgaggctgtagctgacacttgaaggaaaaaataatttgcaaaatgtagttttaccctatttgtttgctaaatgtatcagataccaagcgtttgcattttacagatgaaaaatgtaaaaccttgagaattaaggtttcatttcagtgactttagcctggcctatgtcaagtgtctgctttcctcagcctgaaggaagcccatgaaactagagctctttttcttagtgtcagtgccgccaagggttgctctgagcttcacatcactcccatgcttttctgcctttaacagtttcacaaccaaagaggagctggggaagacagtgcctcagctactgactcctgggctgatgggcgaatcttcagaatcctttagtgcctcagaagatgaaggccacagggaataccaagccaatgactctgactcggacgggcctatcttgtacaccgatgatgaggacgaagacgaagatgaggatggcagtggagaaagtaagactgttttcaagaggcagggaggagcgtgggtgataagcagaagcagctgcagtttataaagaataaaagcctcattaggaaccagacatctgatgttttctttcccctcatcctcctttctcaaattagaaatgtgtatatcctaaagtttagcttttgatgggaggcctttccagaagatgatgtcacatggctggatctggcctttgtcgatgagctagatgagctagatgtgctagatgtgcatattagtatttgtgctgagaatcaaagctttctaataacagagacctttctcactatgaccaaagagagcccttccactctgggcctgttgttgaagaaagaaagtcagtgcagattcataggcttactcattggaggtgtttgaaattttcactcgcttttgtactggggtttatagaaaggggaaggaggaatgagtcaagaatgccaaat

SEQ ID NO: 4897 - DNA, 1187 bp, Homo sapiens
tacttagtcgttgtgacgccattcttctgcgacggcgcggacctggagcttccgcgcggtggcttcactctcctgtaaaacgctagagcggcgagttgttacctgcgtcctctgacctgagagcgaaggggaaagcggcgagatgactgaccgctacaccatccatagccagctggagcacctgcagtccaagtacatcggcacgggccacgccgacaccaccaagtgggagtggctggtgaaccaacaccgcgactcgtactgctcctacatgggccacttcgaccttctcaactacttcgccattgcggagaatgagagcaaagcgcgagtccgcttcaacttgatggaaaagatgcttcagccttgtggaccgccagccgacaagcccgaggagaactgagactctgccttaccaccgcagtgcggggcacctctcccagcgtttctccggtttgccaatcctcttaagtattcctgtctccaaaggaccggctctccatggctcctgcgcctcgtgctttccgcgtacagaagtgcttgcccggggagtcccgcctgacctgccttcatgtggacccttagaacagcactgggagaccagcaggactcctgagaactgtgctggtggagaggtcctagagccggcgagcgtttgagaagagggcatggcgctggagtgagatgggatttggcgtctcgtttttggctaattgattgtcattggctttttccataaagtttagaaatcgttcagtctcttggtgtgaactttctgtgttagggtggaaggctccggaaagagctgagcgggaagtgggtttgggtgagggagcgcatgccagtgtccatggccaggcacttagatccgccgtgtctacctttataattaattccccgactgccacttttcccaagagcgttattttcaggcccacaatgccttcagtattgaaatttgtggttattgtatcccatcttctttttctcctgttttaaaactctttgcagtctttgctgtcattgtcctccctagcctctttaaaatgcatccttttttttttcttgggaatttgtggccatgtctccagaaatgacaagctggcaagcgagttcatccattctacattcaacaaatatttgttgagctctatgtgacaggcattttcccgtgttcttggggctta

SEQ ID NO: 4898 - DNA, 1319 bp, Homo sapiens
cggccaggcgcagtggctcatgcctgtaatcccagcgctttgggaggccgaggacggcagatcacctgaggtcaggagttcaagaccagcctcaacatggagaaaccccatctctactaaaaatacaaaattagccaggtgtggtggtgcgtgcctgtaatcccagctactcgggaggctgaggcaggagaattgcttgaacctgggaggcggaggttgcggtgagccgagattgcgccattgcactccagcctgggcaacaaaagtgaaactccgtctcaaaaacataagcacataaataaaataaataaaagttaatctgcaaagaactttagtatgtctgtagaattaggttcatggtaaataatgggtaatagggggatttaaaaaagcatgctagatctactaatactggcatggaaaggaattcagtatatttagctaaggaaaaacaaaacctgtaaacaatataaataatatcatcttgtatttattaaaaataggcaatataaattcatattttaatactcacgttagtaaatgcacataaacaaaaaaagtcagtggggagagaagaccctgttgaacttgactctattctggcacagtgaagagacatgagaggtgtagaataagtgggaggcccccttgcagggatgagtcaggggactggggacagtgctaggtggggagtttgactggggcagtacacctgtcaaacagtaatgcaggtgtcttaaggtgagctcagggaggacagaaacatcccatggagcaaaagggcaaaagctcacttgatcttgattttcagtacgaatacaggccccatgtaagtctgaaatccaggaggacagtcaaatcataaagctccaaaatgatctcctttgactccatgtctcaaatccaggtaatgctgatgcaagaggtgggttcccatggtcttgggcagctccgaccctgtggttttgcagggtacagaccctcctggctgctttcacgggctggcattgtctgtggcttttccaggtgcacgatgttagctgtcagtggatctaccattctggggtctgaaggatgatggccctcttctcacagctccattaggcagttccccagtgggaattctgtgcgggggctcccacctcacgtgtcccttccacgctgccctagcagaggttctccattagggctctgcccctgcaacacacctctgcctggacatccaggcatttccatacatcctctgaaatctaagtggaggttcccaaacctcaattcttgacttctgtgcacctacaggtccaacaccatgcataagc

SEQ ID NO: 4899 - DNA, 1177 bp, Homo sapiens
acatggatgaagcaggaaaccatcattctcagcaaactaacacaggaatagaaaaccaaacaccgcatattctcactcataagtgggagttgaacaatgagacacattgatacagggaggggaacatcacacactggggtcgaggtgggtagatcacaaggtcaagaaattgagaccatcctggcgaacatagtggaaccctgttgtggggctaggggagggatagcattaggagaagtacctaatgtagatgatggtttgatgggtgcagcaaaccaccatggcacgggtatacctatgtaacaaacctgcacattctgtacatgtattccaaaacttaaagtataataataaagaaaaagaaaaaatagttggaaagaatgaacaagacctactatttgatagcacaactagtcaataataacttgattgtatattataaaataactaaaagagtgtaattggattgtttgtaacatgaaggataaatgcttaagaggatggatacctcattctccatgatgtgattatttcacatagcatgcctgtattaaaacattttggattggtcccatggtgtaatggttagcactctgggctttgaatccagcaatccgagttcgaatcttggtgggacctttcaaaggagtacattttggccaggcgcagtggctcacgcctgtaatcccagcactttgagaggccgaagcaggtggatcacctgagttcaggagttcgagaccagcctgaccaacatggagaaactttgtctctactaaaaatacaaaattagccagctgtgacagtgcatgcctgtaatcccagctagttgggaggctgagtcaggagaatctcttgaacccaggaggtggaggttgcagtgagccaagatcgtgccattgcactccagcctgggcaacaagagtgaaaccccattaaaaaaaaaaatttcgggccgggtgcggtggctcacacctgtaatcccagcccttttggaggccaaggcgggtggatcacgaggtcaaaagatcaagaccatcctggccaacatggtgaaaccctgtctctactaaaaataaaaaaattagcctggcatggtggtgggcgcctgtagtctcagttacttgggaggctgaggcaggagaatcacttgaacccaggaatcggagattgcagt

SEQ ID NO: 4900 - DNA, 1173 bp, Homo sapiens
agcctgtcaacactcttgtcctggttagggctgaattttctggcttactttctacctagatctgaagcatctggccatgcctaccataggaaacaattgaaagaacaaaggcaaacaaaacaaattcgtttcaaatgacatcatgtggcttacagagagagaaaaatgtgtctagcatagccctgttaaatactgatgtctgctgatttaggaaaagctccttgtaaggaaagatagaatagagatgatgagactttgttggctttcctttataagttgacacgtgagtaggcgaaacattagtggctaaaagataaaacaattatccagtttttagataaactttgtaaatattcatttgcctttgggtttcactaattactgtccaacaagagaacccagggtgataagtaatcaataacacaacacacttaaaagcattttcttcattaggttgcatgtaacctaatgaagcgtacagttcttactctgttttttgggttttttgtttgtttgtttgtttttgttcttgtttttagtttcctcaccaaactgctaaaaatttatctctggcattcatttactggaatttagggcaattacctgagcataggtcagataataacttgtgtctgtccatatttaaatacaatagatgttacttatcaggcaccaaataaagtcagttttctattatgcaaattaactatcaaacttgttttaaaatatttaacctagtacatttaatgtactagggctgccatagcaaagtgccagagattgggtggcttaagacagctgaaatttatcgtcccacagtttaggattctagaagtctgaaatcaagttgccagcagggccttgctctctctctctgaaggctccaggggaggatcccttcttgctttcttggttgctggaaacccttggcattctttggcttagagatgcatcactctaatctccgcatggactgtcacatggcattctccctatgtgttccgtttgtcttctcttttataaagacaccagtgatattggactaaggtccgccctaatcccataaaacttcatttgaactacatctgcagagaccctatttccaaataagatcacattcacaggtgggagtggtggttaggactttgacatatcttttctaggaacatagtt

SEQ ID NO: 4901 - DNA, 1099 bp, Homo sapiens
ccctctatcacccgatgtcataaatggtgattttatgtttttagtgtaattgaacaataggatgtgggtgttggagatttcaattatgttagcacaactttatgcatccgtttgattgatttgcttttaaaatgtgattgtaaaatattcccttgtctcacaggcaagactcggaaagctagcctcctatctgccaagtcatccaccgagcccagcttgaagtcttttagcagaaaccagttgggcaattacccaacattgcctttaatgaaatcaggggatgcactgaagcagggacaggaggagggcaggctgggtggtggccttgccccagacacgtccaagagctgtgacccacctggtgtgactggtttgaataaaaaccgaagaagcctcccagtttccatctgccggagctgtgagaccctggagggcccccagactgtggacacttggccccgatcccattccctggatgaccttcaagtggagcctggtgctgagcaagacgtgcctaccgaggtgacagaaccgccccctcagattgtacctgaagtgccacagaagacgaccgcctcttccacgaaggcccagcccctggagcaagactctgctgtcgacaatgcattgctactgacccaaagcaagagattttctgaacctcagaaattgacaactaagaaactggagggctcaatcgcagcctctggtcgcggcctgtcaccccctcagtgtttgcccagaaactatgatgctcagcctcctggagctaaacacggtttagcaaggacgcctctggagggccacagaaaaggacacgagtttgaaggaacacaccatcccctgggcaccaaagaaggggtagatgctgagcagagaatgcagcccaaaattccatcacagcctccacctgttcctgccaaaaagagcagagaacgccttgctaacggactccaccctgttcccatgggccccagtggggccctccccagtcccgatgcgccatgcctgccagtgaaaaggggcagccccgccagccccaccagccctagcgactgtcccccagcactggctcccaggcctctctcagggcaggcgc

SEQ ID NO: 4902 - DNA, 1224 bp, Homo sapiens
aaaatgtagccagtagttatctctgggtgaagagattatgagcaagtaattttttttatgtgtatttttaatatattctacattgaataggagttacttttgtaatatgtaaaaaaaaaagttactaaaaataagggtgatgtttgtgaaacacataaagaaacgtacgcaaatcataagtgacagcttactgaattctcacaaagtgagttcacctatataacccaaaccaagctcaaacaggatagaccaggtccccagaaacccccctcctcaccctccaccgcctctaactgcagaggggagtgcctgttttttggaacttcatatgcagtcatgtgttgcttaacgatgggaacacattctgagaaatgttatgtgctagactttgatatgactgacagtgcagcgggtttgtttccaccagcatcaccaccaacaggtgagtaatgcagtgcactacatcacaatggctatgacatttctaagccataggactttttcagctccattatcatcttgtgggcccatcattgtatatttggctcatgactgcaattggaataatatagtatgtctccttctgagttcgtggctgcttctgctcaacattatatttgtgaatcattcatattgtttcttttggctgcagtttgttcaatttcactgctttacagagttccattgtttgcatataccaccttccattttactgttgattgatggacttttgggttgtctctggtttggcactattctgaatagtgctgctgtgaacattgttttggttaacatcagcgcatatttctgttggggagtacctaggaatggaaatactgatttgtatggtatgtttctgttcagctttcatagacactgccaaacagttttctggagtggttgtaccaacacacacttacacttctatattttccagtgctgatcacaagatttctccaagatactttcaactttcctgaattatttgatgctgtcatattgggaataatttttatctctgttagttgaatatcaaattgatgttctagaaaactcttgagtcattacctacattttttaggtgagtggtgtttgatggctcaagatgaaccttctctttcctcagaacagctttaagtttcttatacttcttgtgattgaagagcaggtgaccatgtttttcttctagtaactgcattatttgaattttgagagtatcatact

SEQ ID NO: 4903 - DNA, 1219 bp, Homo sapiens
aattaaataattatagattatacggtattcatgatcaagaagtgctttggaattttatgcacctaatgaatgtataggtggggaaagttgatctataaatgcacatgtatactgtaagggatatgaatctttactttcactgaaccaccagaccttaaaattttataggagcagagcatctcaaagtcttgatgtctgtaatttcataaagtatcattaacacattaagtttcaactaaattgaaattaattgtttcatttggggagattagcatttttctatttcagtggcagaatactgatgtttcaagggaatatattttgaggataacagtcataatattaatagttgttgttattatatttaacactcattgggagcttcttgtgtctcaggaatcttgttaagtcctttagatgtactatttcatttaatcctaagaacaaccctgtgaggaagatactattattatgtccattgtacagataaggaaaccaccaacttagagatgattcataacgcttctatgttactgagctggtcgctagcagcactcaagtgattgaacattcaacccaggcccaggtgacttgcaaccccgtgctcgtaagctcttaactggtctctctctctctctctctctctgaaaagggcaaaatctaaaacatgattatctgagggagatggggtagctagaaaagtaggattctatgaaatgttattctgctgaattctcaagaacacagtgtttctggaaagcttagtggttctgttgaggtgatgttcattgatattctaaatgtgttactttgttttatttttttgttggtgggggaagactttactagttggaattactaaaatcgctttaataaagtgcttgcaaagactcaatctggttaacagtaaagccatttgtttcagtcatgtcagcaactttggttttcataagggttttaatgaatcggagagtggaatttaagaaagcaaacaatccaaggaatactccttatttttctaaaatagcaaagcaaaaatgggaaccctttccagtttagttacagcaagtatctattggagttttagaaattcttagagtacatcatttatcatatagaacaaaacttgattaatgaacactttttaaaagtctttttagggtcctattattattttagttgtttagatataaaaatattttatgacatattcactgtt

SEQ ID NO: 4904 - DNA, 1354 bp, Homo sapiens
ctaattttcttttttccttttagtaattaagcacgatcatgtccctttttaagccttacctgagaggaacaatgccttaaaataaaaaagcattaatgagatgaaagtatgcacagaataactttcctctacttattctgtactttgccctcatgagttccaatgttgtgtgaagacaggcagatgctgcacagtgaattgcagatgatattacagaagtgatgtctgtaggtcacattaaatactgacttgagcagtgggtgacacaacacagtgtttgtcttccacagggaagcttaaaacaaaagatatttttaacccactgacagaacaacaaggttaagcttcatctgcttggtgtcccacagaacttgcacaagcagttgttattgggaaagtacagtctcaaaaccagcaacagcagcagtacctacagccctttttttggagagaagtttaaatgctttactgttggggcagtccatttctaatcctgacttggtgacagtatcatgtgtatttataaaacaaggctagccatatttaggacaactgaagaaaagctggaaaaaaaaacaagcaaacttgaacactgaagcaacctcaagcatctctttattttgatgatatatttttgtaaggaaaatattcagatgatcaggaatgtatataactgaaatcaagaaaaagaacagtatgcatttaaaaagacagaattatgaaattatatgagtgcttagaatggggctaagggaagtgctgaaatagagcaaaggatggaagataatatagactaccacccactgtaaatgtttgcaagtggctgtgttttaaatgggattattacagttgatctctatgaatgtcagagccctaactttcaggctttgcattttgtatatgggaagaaatatgacaatcctaggtaattaaaccatagacccaaagcccttacgtttgatgcaatttatttttaaaataggccttgtttttcagcttcatctgcagttctatgtgaagattgataaatcagtttttacttgttttattaataaaacgtaatttggatatcttgagttgatggttttgtgatttagctgggtaaactatctttgtaacagataagttatttataaaaattaaaaaacttatattctaatgtggattttgtgacttgttttcagtttgtgggacaggagataatttatacatcagcagatcatttaagcattaatggaaatcagggaaaacttcttctctagagtctccttgtgacattgtgatactcagctgcatttcttggactgtttttatcaatttccctagacttcttttttcatagtttatgatagtt

SEQ ID NO: 4905 - DNA, 1169 bp, Homo sapiens
cccgctcagcctccctagcccggagagccagttctccccgggcgacctcccgcctccgcccggcctgcagctccagccgcggggcgaacaccgccctagggacctgcacggcgacttgctttccccgcgcaggccacccgacgacccgtgggcccgtccaccccgctccgaccgcttccctgggcgctccgtctgggcggagccggcctggggcgacggcgccactgggggactttcagtgtacgcgaccgaggacgacgagggggacgcgcgcgcccgggctcgcatcgcgctctacagcgtcttcccgcgtgaccaggtggaccgcgtgatggccgcgttcccggagctctcagacctcgccaggctcatcctcctggtacagagatgccagagcgcgggggcgcccctgggcaagccctaagggaccaacacgcacttgcagggaatggcccagcctcgccttgcgtcttggacgggtggacctgtggttgccagcctggacctgagtgggcccatcatggtgcccccttttctttaaagatggtcagggaagcctgcttcctcctcctgagcggggttgtgggggcctggtggcacttggtgatcctcactgaggccggggcctgctgcggggaggtccacccacttccgtggagggaatgattttccatgtgcacggagactgcgggtccaagctgcagtagaacccacaagtgggtcacaaaatcaatttagtgggtcaccaccacaaacacagtggactgggacagggcaaagcgcaccctgtgccatcaggctgagtctgaactcttgttacctatcctgtgtccccacccccttggcagccatgtaactaacctcaatgtgggtcgtagtcagaagtttaaaaaagactatgaatgctcttgaatttcattgcttcaggtaatgtttgaaatatgtagtcaggtggccaggggaggtttgctatctggaagttttcatgttagctattgctaaccccacccgcaagggcagcccagcctccaggtgtgggctctcctgtgctctgaattgtgtggctgtcctatgctggggacaagtggtaggagcgctttgtcccagggccaccttctggggccttcacacacatacccccaccacacaaacacacacacacacacaca

SEQ ID NO: 4906 - DNA, 1207 bp, Homo sapiens
ggtctaatgaggggccgtaccttccaagatttcactccgcccctcgacgccgcgcggcgctgcgcgtgcgcaaacgcctttccctggcgagccggatctcggagcgtccccgcgcctctccgcggccgcccggggaggggagggcccgtcccgcccctccccgtctctccccgcccctccccgtccctcccgccgaagctccgtcccgcccgcgggccggctccgccctcacctcccggccgcggctgccctctgcccgggttgtccaagatggagggcgctccaccggggtcgctcgccctccggctcctgctgttcgtggcgctacccgcctccggctggctgacgacgggcgcccccgagccgccgccgctgtccggagccccacaggtagggcagggcgggcctggctggccgctttacgactccgactctccgggaggcccgggctgtccacagtgacgcttcccacatcccaccggcgggcaggggcgggggtccgggcccccgaaggaggtgtggggagaagcaccccaggaaatgggggcggcgtgggaggccgaggtaagaggaaagggacccactggggctgcgtcgctgtgagtgagcctcgagccactccacaccgactctccggcggcccaagccggcgcgcgacctgacggggctttgccgtcgaagcgcgcggttgccggtgatcaggccttcgtaatggcgccttcccggggtagagccagcgcttgggcaaggaatgtttgtgtgctcgggaagtgtggaagttgcccacttcgcgcatttccaggccacttgtgcctgctcggcctgcgatcgcgagggtccgccgttccgaggctgcggggctccgccgggctcaggtgggcagagggagagacctggccctcgcgcgacgtaatgtttttgtcggatgttggaggagaagttctcacggcggggcgcgatcggcggtgtccgcatcccctggggactcagcccggcctctgggggcggggcccagcagtccgggttggagagtcctgcaggtgcttctgatgccagctgaggtgggagaatcgaggcatcctaacattaaaacgtggctgatgctcaccattcctgccgtagagtcgtgcctacctaggccagtatcagccttttttcagtagaatggtagggaaaagtttgaatattttaaagagcaagtgttctg

SEQ ID NO: 4907 - DNA, 1218 bp, Homo sapiens
gtcgttgggttttattcttattgtattattcgggctccaccgacccaaatattagtcaactgggttgggcgaggtaggacggatgaagcccaccgtctaacaatctggacatctataggagcagatccgccgctcgaaacagctgacccagcgacgactgcggaaccactagcagcgtctgcacagatcgaccccgccatcccgccgtcccgctcggtgaccggagacacagccgggaacgcgactgatcaggctaccgagccgggccgcagggcgaaagcggtgcggtccgaggcctcagaaagggacacgcagcagcggaagtggcgctgactcagcccggcctccctgcagtcccctggcagcggtagcagccacaggggcgggcggctgggccacacgcctcccccgccctcggccccacccggccgcaccctaagccgcgcggcgtcacagagcgcatgcgtgccgcgggggatgccgggagcgcgcagtggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcagtaagtgccacctccgcccgttgtagggcagctggggcaggctgggcctggaccgggtccccctgggccgtccggaacgttctgtctgtccccgcgcgcctgttggagggcttcggcgcagagttgccccggtagtcccgaacggcgtgcgcttgcagtcgcctccctcgggacctgtcactcgtcgacgacgtggactggaaggggagagaaagagccaggggccgctgctggtgggggcaggggcagtcgtctccctgcaggccctgggggagggagtgcagtacaggtgatgctgctgtcactcaggtccgcgtccgggtccggcttgtgaggggcgtgccttcggggtgggagcgtgtgggctaggccttatggagagtgggctggcgctcaggagaccccaccctcgtcccctgcatttttctcaccttcctcctccataatcaacctcgctgcaagctttccctcttatgcagcctcccccgccctccgttttttcccctggaggg

SEQ ID NO: 4908 - DNA, 1197 bp, Homo sapiens
ctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaacttagtttgtgaattgattttgaggagtggtttttcttttcttggacacttaattctgttctgatattaatttatcagattgcttttgtgcattggataacaccaccattcacaagttaagattcttggtatttggatatctgttagatgctactaagaaaatagagatgagctttctttttaaagcttttgatgtggtgtcatagaatagcatgttgtagatacaatcagctgctttgttaccttaaaactaggcatttgtaaatattaaaccataagatggcaggtgatgtcctgtaaacactcagctgttcagattggacataactgacttagttcttcccttctctctctctcaaaattataggagacttgtagtttagtgtggttttctgtttctaatttgctgctgataatgtatatgaacttaacatgctgtgtaagctgtgtcctagttcttgaacagtttatgcagtgctgctttgccaaataaagttaaaagtaaaagaggcattggttgtttttgaatatagaaggaagaacagcaagtccaccagatagggagtgtttacgatcatgggaaaaagactgtttctctggttgtttccttttgcgaagtctgagtaagtaattagcattaatccaactgtacattgtagaatgtgactacactgctccagggccaggaccgtacttcagtcgtcatttctctttgactccctagcccagggcttgccctgtagtagctatacagtaaatgctggtgagtgagtgagtggtgaatgaatcgacttaaagtcaggaaagaacaggattgagggtgaacagaccaaaacccatctctcacctatacaaagatttattaatataatgactatagctgaatttctaagaaggcagtagcactttgggatcttatttaaatgttgtgatttataacttttataagaagtagttctggaactgaggaaatataa

SEQ ID NO: 4909 - DNA, 1148 bp, Homo sapiens
tttctttccctgggcctcccgagggaggtctgataacgcaagaaggatgagaatgtgggcgggagatgagggcgggaggaactgcccggacctgtcagccttgggtgtagcacctgcaaggaggacatgattctcctgcggtgacagcctgaccgggccccccacccaccaaggcaggaccacggcgacctggggagcatgctgccagcagctatggtgggggctttggtcagaggatggaggaatcgaagctctcctcaaagggctgagtcaaaacttcttatccgaccgagccaagatggaattgcaattcagggtatgtttgacaccttgatgtgattgtgtggccctttgtaaagggttcagagggtgatcatgagcttataagcttttctccaccttcaaatggaattgacaaatccagaatctgtttttttcctcaggttatcataaattgtgactaattttacttgtgggaggtctattttcctttcctaatcaaagacttcagtagtcacgtaataccttcagtagtcacatagtaaaagattattactaccttctttttttccagagcttttactttaagatggaattcttgttctgtggtatttgtgtttgcctagtaggatgaaaaaggtatactggcttttggcaaattttagtctaaattgcatcactttattatgtctggaatgggagatgtggagagtacttaatttctgggttttctcagtaattctttttattttctgttttgttactatcgttttgaggcaacaatagaactagtgacaaaaatatagctttcttgttaacttagttcaaagggttattatggcctttttctgaaataaattttcattagaatgaaatactttggaaatacctgacctcgttctcttctgtctggaccttggactccttaatggtacttactagaagggagctctttggtcttgccgacgatggacccatgggaggaacacagtgccagctgaggaagcaagtctgagcatagaagtcatagactcccaggggctctcagagctggcctgctgcccctccatgctctcatctgaccccacgccctgagagtctcctagggagtaaacacgagtgttcttgcatttcaacaaatatgtatt

SEQ ID NO: 4910 - DNA, 1194 bp, Homo sapiens
ctgatgtaacaaatgggaccaaggagaagctggtcttccgtcttaggctcagaaaacagtatcaaaacagcaactctgtggctcagagtaatttatagcatcattttaagctaatgtaattctatttagtgtggaagaggggaagagccctgggatgctgatgtgctgggggtcccgagggaccttgagactttctctcgtatggctctgaagggagacattagaacttactggaggctgggcgtggtgtggctcatgcctgtaatcccagcactttgggaggccgaggccagtggatcacttgaagtcaggagttcgagaccagcctgagcaacatagtgaaacctcatctctattaaaaatacaaaagttagccgggcatggtggcaggcacctgtaatcccagctacttgggaggctggggcaggagaatcgcttgaatccaagaggcagaggttgcagtgagccgagatcacgccattgcactccagcctgggcagcaagagcaaagctccatctcaaaaaattaaaaaaaaaatgtagtggaaagaacatggactttggagtcaggattaacctaactcaaggacaagggagctgtttttgtaaaaaaaattcttggccggatgcggtggctcacgcctgtaatcctagcactttgggaggctgaggcaggcggatcacctgcggtggggagttcgagaccagcctgaccaacgtggagaaaccccatctctactaaaaatacaaaattagccgggcatggtggcgcatgcctgtaatcccagctactcaggaggctgaggcaggagaatcgcttgaacccaggaggtggaggttacggtgagctgagatcgcgctccagcctgggcaccaagagcgaaactccatctcaaaaaaaaaaaaaaaagaaattcttaattgcattgcacttacaggctgtgtgactttgaggaaataagctctctgattaattaataagattcccaatttctttgtgggtaaattgggagcaaggctgttgggaggaatgactgagatgatacctcggggcagtgcctctttgatggtagctgccaataaatgctggtccacttcctgcattcctccctccacttccttgttgccatgtcacctgcacacaaaacagctttcagactccatcttggcacaatatacatttatatttgaaaa

SEQ ID NO: 4911 - DNA, 1214 bp, Homo sapiens
ttgagaatctggtaaattaggaattcaaaaatagttttaacactttttacttcaaagaaaatcacagtgcaagcaatctgagtggattcatcaaaagttatacatgaatattctgcagagtctggtgttgctgaaagttttgatttgtgttctgctgagacacaaccatgaaaatatgcacttgcttgtattccgaagaggatagttccagtgagacttggacaatgagcagaaaaaatttttttttgagacgaggtgtcgctgtgtcgcccaggctggagtgcagcggcgcgatatctgctcactgcaacctctgcctcctgggttcaagcgattctcatgcctcagcctcccaagtagctgggactacaggtgcccgccaccacacccggctaattttttgtatttttttttttttagtagagacggggtttcgcagtgttagccaggatggtctcgatctcctgacctcgtgatccacccgcctcggccttccaaagtgctgggattacaggtgtgagccattgtgcccagctcagaaaatttaatagtactagatctcgtgtgtgtgtgtgtgtgtgtgtgcgcgcgcttaggttgaaggtggaatttaacattgatttaaaaaaaataatagtaggaaaaaataaatgcggtttgagtccaaagcagcatttttcactaattttatgaaggaagtccttttgagtaatgtcttaaattaggaaaatggcgtacttttacatgttagacattaaactctagggcagataaccatgccctgtgtgttgtgtatcaagcttagcatatacataggaaaagatgtattgtgagagtgtcttacatttcgttggtttggtcataaagtttatagaaaatgcttgttttatagttggttgttattgagatgagagtccctcaaggaactccctatgctttagggagctttttgttttaaacctactggttagacttgtgggttttaatgttttcagctgtggttgtaagaaacacattttaaattgcacctagtatagacatacatgtaaaacaaacaaaatttttacgaagtagtacttgtattaagagtgatgtactctgctatcttctatttcatttttttaaagttgatattgctgccttaaattgattttttcaaccactaatgagtcaggacccactatttaaaaaatactggtgtgttctcttgctgt

SEQ ID NO: 4912 - DNA, 1400 bp, Homo sapiens
ctgtgccacggcactccagcctgggcgatagagagacactctgtctcaaaataagtaaataaataagccacaggtggtggtacatgcctgtcatcccagctactcaggaggctgaggtggaaagataacttgagcccaggagttggaggctgcagtgagctatgatcgcatcactgcactgcagagtgggtgacagagcaagacctcatctctaattttttaaaatttttatgtatatacactacctgatgaaattataaattaaatagtttaaaaaggaagaacatatagcagattttgaacttgttgcagtggtgaaattattgatagtttttctcttgttcctctgcattctgattttcttgaaattgacttctattcgttgtgttactaaaagaatattgatttatatttttaaagtgtgaataggagttgaaaaaagtcttaactcctattcaagtctttctagaaatattgctcaagaagaagaagatagttttttttttcgtctgggctgccaacatgccatccagactgaggaagacccggaaacttaggggccacgtgagccaccgccacggccgcataggcaagcaccggaagcaccccggcggccgcggtaatgctggtggtctgcatcaccaccggatcaacttcgacaaataccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatctggctactacaaagttctgggaaagggaaagctccccaagcaggctgtcaccgtgcaggccaaattcttcagcagaagagctgaggagaagattaagagtgttgggggggcctgtgtcctggtggcttgaagccgcatggagggagtttcattaaatgctaactacttaaaaaaaaaaaaagaagaagaagaagaagaaaaatggaatactggaaatgtgagaccaaaatgagaaatcccagagcatattggtgtggtgataatgacccagcagacagggaaagcaggtgaaggagagagaggaggtaattgctgtgtgaagtctttgcggaggaaagagacaataggatatcaagaacgggtcttccctgggagcatgaatatttcacctcatccatttctacaggagtgaaggcaggatatgtaagttctgatatagttaagtggatagatcctgtagtggaagatgaagaatttcaattctgatagtctgtatttccaaaatgacatttgagactagctcatcagctaatggggaatgggagaatgagagagtatgga

SEQ ID NO: 4913 - DNA, 1238 bp, Homo sapiens
gtaggctcggagactccagcccagccacgtggtggaagatttatggacagaaaaaggaaagtgacgtacagaaaatggatgtgaggtacagaaacaaccaaattggttgcagcttggtgggcgtttgccttatttgaacacggtttgaacagttagcccttgattgcccaaaacttggtggttggcacaaaagtaggcttcagtctgtttacatcttcatttaggttacagttcactatgtacagagaaacctttaggctgaacataaaatacgtaaaaaggcagctttaggctaaacttgatttaacaatataaagacttgaggcaaagatagtcccacaacttgctcaagaccacagaaatatgagaaactcagaataaccctcaagtactcgggctccagactggatgctgttaacctcccccagactctcatgtctatattgcttttggcctatgacttttttatgtgtgtgcatgaaattgtgaacttcttttcagtgataatctcgtactcttattttatcacactttttagttccttgggaatagctcttgagtacggccataccaccatgaatgtggctgatcttgtctgatctcggaagctaagcagggtcgggcctggttagtacttggatgggaggaatacgtcttaaattttataaacaggactcagacatctatttttatgcttatttttaaatgtcttgataaaatgttatactactattacattcttgggaaaaatctcacttggtttttttttgtgttatacttttaatcaccagattttgtttgctaaaatgttatttagaattttgcatgtatttttcattggcctgtgattttttctttttatataacatctttttaaaggtctttattaatattacactcaagtgttcttctgttttctatgcgctgaatccaagcagttaaaatccatgggaaatatttttccttgatattttctaagaactattcatgtaatattatattgactgctcactcagcccctttccctaaagcctggtaacacaattaactcatgattccccgataaatgctattttctcattcctccatttttatctatatgtaaggctcttggctttgaatttggtttctatctctttgtttggttaagttcatcttggtaaaacagtaacactctcagcatttgttctcagttctgtgagttagagttgataaactttctcagtaggacagacaca

SEQ ID NO: 4914 - DNA, 1173 bp, Homo sapiens
caggagtttgagtccagcctgaccaatatggtgaaaccctgtctctactaaaaatacaaaaattatctgggcatggtggctgtaatgggaagctgaggcaggagaatcactggaacctggaggttgcagtgagccgagaatgcaccactacactccagcctgggcgacagagtaagactcagtctcaaaaaaaaaagaaacatcacaccgtaccacattaatatgtacaattgttatatgtcaattataggtaagaaattaaataaaaataaactataaactatcttgtagacaataatgtatcatcaaactgaatattctgctctcatgtacttcctatacttatattgactcagtttgaatctggtcccaaaaactcacaaaatataagactgtcaccaacatcacataagcaaaaatcattaacttgtacatgtagagtaataaaatgacgtttcacattaaaaatattattcatatacacacacatacaaagattcaaaagaaaacaaaaagctaatggaaaaaataggcaaaagatctcaacagatacctcaccaaagaaagtatatacaaaaattaataaattctgagcagccatcttatgttaaagaaaagaaggcatataaatagcaaaaaagcgtatgaaaagatgctcaacatcatgagtcattagggaattctaaattaaaacaataaaatgttactacccacctactagcatggcgaaaatccaaaacacagaaaacaccaaacgttggcaaggatgtgaagcaacaggaactctcattcattgatggtgggaatgcaaaatggtacagccactttgcaagacagtttggcatctcttatacagttaaacatactcttaccatacaatccagcaattgtactcattgctatttaccccaaagagttgaaaacttgcatccatgcaataatctgcacccacatgttgctagcagggttattcataattttaaaaacttggaagctacaaagatgtctttcaataggtgaatgaataacaaactgtgatgcatccatacaatggaatattattcaatgattaaaaagtgacctatccaggagatcgagaccatcctggctaacacggtgaaaccccgtctctactaaaaacacaaaaaattagctgggcgtggtggcaggtac

SEQ ID NO: 4915 - DNA, 1210 bp, Homo sapiens
aaccgttggcgaagcccccgccgcgccgccccaccagcagcaccaccaccaccaccatgcccaccaccaccaccaccatgcccaccacctccaccaccaccacgcactacagcagcagctaaaccagttccagcagcagcagcagcagcagcaacagcagcagcagcagcagcagcaacagcaacatcccatttccaacaacaacagcttgggcggcgcgggcggcggcgcgcctcagcccggccccgacatggagcagccgcaacatggaggcgccaaggacagtgctgcgggcggccaggccgaccccccgggcccgccgctgctgagcaagccgggcgacgaggacgacgcgccgcccaagatgggggagccggcgggcggccgctacgagcacccgggcttgggcgccctgggcacgcagcagccgccggtcgccgtgcccgggggcggcggcggcccggcggccgtcccggagtttaataattactatggcagcgctgcccctgcgagcggcggccccggcggccgcgctgggccttgctttgatcaacatggcggacaacaaagccccgggatggggatgatgcactccgcctccgccgccgccgccggggcccccggcagcatggaccccctgcagaactcccacgaagggtaccccaacagccagtgcaaccattatccgggctacagccggcccggcgcgggcggcggcggcggcggcggcggcggaggaggaggaggcagcggaggaggaggaggaggaggaggagcaggagcaggaggagcaggagcgggagctgtggcggcggcggccgcggcggcggcggcagcagcaggaggcggcggcggcggcggctatgggggctcgtccgcggggtacggggtgctgagctccccccggcagcagggcggcggcatgatgatgggccccgggggcggcggggccgcgagcctcagcaaggcggccgccggctcggcggcggggggcttccagcgcttcgccggccagaaccagcacccgtcgggggccaccccgaccctcaatcagctgctcacctcgcccagccccatgatgcggagctacggcggcagctaccccgagtacagcagccccagcgcgccgccgccgccgccgtcgcagccccagtcccaggcggcggcggcgggggcggcggcgggcggccagcaggcggccgcgggcatg

SEQ ID NO: 4916 - DNA, 1177 bp, Homo sapiens
agtgcacacggatgtcctggctgacattctcaagagcatcaacaatgccgaaaagaggcaaacgctaggtgctttttaagctgtgctccaaggtcattgcccgtttctcactgtgatgatgcagcacggattatgcggggtggagttggggggacttcctgggccgggggacttttgcaagagaccccggtgactcaggattttgagttcttaaccagtcgagtgaaggattcaaaattaaccactccaagggaggattgaaaaaagaaccactctcagtggacaaaaagaaagaaaggggagagggtaacacagggatataagccctagtcacccgagccagcaacggcaacccttctgggtccccttccaccacgtggaagctttcctttcactttgttcagtaaactgcgctgctgctcactctcctggtccgtggactctttttaagctgtaacactcaccgtgaaggtccgcagcttcattcatcaaagttagcgagaccacaaacccatcggcaggaaaaactcctaactcagttacattggcaaatttgaaatcattgatgatcacagagctgggaaaattgttgtgaacctcacaggcgggctaaacaagtgtggagtgatcagcctcagatttgatgtgcaactcaaagatctagaaaaatggcagaataatctgcttccatcctgccagtttggtttcattgcactgacaacctcggctggcatcatggaccataaggaagcaagatgaaaacacacagcagggaaaatcctggaattctttttctagggatgtaatacatatttacaaaaaaaaaaaaaaaaagatttttctctctccttggttttaagaaatttaattatgatgggactggtgtggttttctttgtgtgtcttttggttgtgttttattgactttcatatctgtagatttacagtttttatcaaatttggaaaaaattcaagtcagtttttttcttcagatatttatcctgtctcctctttttttttttttttaaacagcagctctaactaaatatatatattagacctaccctgaagtctctttctctttgtgttttatttttcctttgtgggctgtgtcttcaatttcaggcttattcgttttcatttaaaaattaccattaaatctatccagtgaaaaagtg

SEQ ID NO: 4917 - DNA, 1176 bp, Homo sapiens
gaaaagcttgcacccctggcagagtgcagatgtctgcttccccacctccttggtggtactgaggattaccatgtcaaaaatctttgctgatggctggttattttccaagtactgggatacatctttaaggtgccacactttattttccccctcaaatcatctttagataaaaatgccaaggtgatactaaggttaaggaaagatgaagactaaaacgccagagcagggcagctagcctgcaaatccacctgctggtggccacattcgcaggttgttggtgttgactgtttacaaagagccctgggggacagcagctggggactgggggctggagatgtggacatctgtcccaggctaactggggactggaggccgggggtgtggacatctgtcccaggctaactgtcatccctcttttgttcctaacgcagacctgtgctggcgatcgtggaggtggaagttcaggaagtcgatgtgggtgctcgggagagggttttccaggaagtgtcctccttccagggccccctggatgccactgttgtagtaaaccttcaatcaccgaccttagaagagaaaaacgagtttccagaggacctgcgtactgagctcatgcagaccttggggagttatgggacaattgttcttgtcaggtaactgctcccctggctgatgtgggttccaggggatgtcgatgaggatccgtgagagctgccaggtcgttcttggcattgacttggagtatcatttattccaggatcaaccaagggcagatgctggtaacttttgcagacagtcactcggctctcagtgtcctggacgtggacggtatgaaggtacgctgtacttggccacactgtggagtggggtctgatcaatccctctttttatgtgggcatgtcttcttcctcctcttgccctgacctgtgccttttttttttttttttttttttttttttttctctgagacaaagtcttgctctgtcattcaggctggagtacagtgatgcaatcacagctcgctgcagccttgaactgccaggcttaagcaatcctcccatctcagcctctcaagtagctgggaccgcaggcacgtgccaccacacccagctaattttttttaaattttgtagagagaggatctcactctgtagccccggctggagtgcattgggacag

SEQ ID NO: 4918 - DNA, 1983 bp, Homo sapiens
ctgccagccatcagggacgaatgagttttaaaggcccttactgctttgtgtcttgagggaatatcttttattaatcgtgaaaaaatcaatccagataacttgcctgagtcatttcagtctcctttttgaggatgcctgcttaaacagcgaccatggtctctggaggggtagagtctcacattcggagttcagtctcttagaaagtacagttcagtgtggaagaatggcagttatgatttcattcagatgtgcccagctgctgacaaattgaatacaacgatcagtggcaggcagaactctcatttgttgtgtgttgtcttgagtctggtgaggtgtatcctttcactattggattttaccattcagtgcagtcagtagctccatttgatgtaagtgtaaagatgggtctctcatttcagtttcagcaattattcttaaaacctttattttccagtgttttaaagtttttaaattttatatctttttttttttttaaacagatttgtaagactccagggcctcccagccgtgaataatctgatggttcctgaaatgactggggaagcagacgcttcgtatggcagttgaagagtgtgtgtctatgtgcatttaaaaccttctttctgtacttacacattcacacgggaagacaggctcattcttgtgcacacttgagagttttacaactgatgaaaattaatttaagaatcagatggagcaacttgacaccagtgggctcaggagcccggggagaaaaatacatcactaatggccagttttccatatggtctgcacgggtaaagaaagtctgcaaaaagaagaaaaaaaaatttgcgcagattaaaccacaaaaatattctccagtttaaagaaggaactaagtgagaaggtgactgagaaagaagtgtgatttcaaacattgcagcggctcacacagtgtttgttgcactttatttttcagtgggtttggtgatttggacggattaaaattctagactgaaaagtaactcctactgtggttatggctagaggaaagcaagttcaagtatgatgggacaagtttgaataatgaactgattcctttgcctatcttaattaactgtatttgagaaattttaatttattattcccccccttttttcctgcatctataggataatattgtaaaatagcaattgaaaccaataattattaaataaatatcaaggaaaatccaagcaaagctttctttttgttggactagtggtgtggtgtttggagacagtctctgaatgtgaacaggaaagcacccatcagcaaaacactatcactctctagggagacagctgggggaatctgactctggcttctgcttttgttttaagggattaacttccctgtcaagtccaagaagacttgcgtatgagaagattacctgatggacttaattctaagattagcttttttcatcaagatggaaaaagatctttaggagcagaaaaggggagtgctaactgggggagcgagaagggagacgagcaaaagaaacaaaatcttgccacgtggctctgttttgtcagcaagaggatttaagactcacccagggcaaacactgggaccactgtaagagcgctggaacattctgcctcttgagtgaaggggccttctttctagcctctatggcactgaggggtgcgccggctggtggaggagcagtccgatggagccctgcgttccccggggacacagggccaagctttgaggtggaaagtttctggttctgaaacaacaaggagagagtctgtttttcttcctaaaatttggactcttgtctgcacaaactctggtctgttttgcacggtttgtgtgcctttttttccctttatgcaatctttttcagctttagcagcagaaatttgtctagttcaggaaacatgctagagggtggcttcagaaggaagatgatcctgtgtattctgtctctgcatccgaacttttgaagag

SEQ ID NO: 4919 - DNA, 1213 bp, Homo sapiens
gtccttcaggaggtattcctgaagaaggcattgttatcataggagatgacagctccgtggatatgttactgccccttgtgttagggttctctagaggggtggaactaatgcggtagatgtatatatgaaagggagtttttgaaggagaactgactcacacgatcacgaggtaaaatcccatgataggccgtctgcaagttgaggggcaaggaagccagtggtggatccgtctgagtcccaaaaccacaaaagttgggaagttgacagtgcagccttgagtctgtggccgaaggtccaagagcccctggcaaaccactggtgtaagtccaagagtctaaaagctgaggaacttggagtctgatgttgagggcaggaggcatccagcacgggagagagatgaaggctggaagactctgcaagtcattcttccatcttctccttcctgctttattctagctgcgctggcagctgattagatggtgcccacccagattgagggggggtctgcctctcccagtccactgactcaaatgttaatctcctttggcaacaccctcacagacacaccaggaacaatactctgcattcttcagtccagtcaagtttgacactcagtattaacgatcacacccctgaagaccttccagtgggacaaggtgtggaggcagaagacagtgatatgaatgatcctgaccgggtgtaggcctaggctaatatgtgtcttagtttttaacaaaaacatttaaaaagaaaaaaaaaattaatagaaaaagcttacagcataaggatataaagaaaaacataatttggtacagctatatgtttgtgttttaagtgttattacaaaaggatcaaaaaaagtatcaaacttcttgaaaaactgaaaagtttaaaaagtaaaacagttacaataagctaaggttaattcattattgaggaaagaaccatttttttaatgaaatgagtgcagcctaagcatccagtgttgataaagtctacagtagctacaaggtaatgtcctaggccttcagtcactctccactcactctctggctcacccagagcaacttctagtcctgcaagctccattcatggtaagtgcccttttatagatgaaccactttttatcttttatactgtattcttactgtatgttgtctatgtttagatagctttagatacatgaatacttgccattgtattacagttgcct

SEQ ID NO: 4920 - DNA, 1195 bp, Homo sapiens
tttagaaagcaaaaaattcatattactacgtatttgtctagaaaatggtctggaaggatagacatgaaatatgaattacgattatctctaggtgaaattctcagtatttaatgctatctttatattttatgatttttttaaaatgagaatataatgagaaaaacctataatcagaagaaataagaaatctatttctatttttggtatagaatttggtaagttaaaaatgtatgtgagaaattaaaaatataagttcattagccatgaaatatttaccctttttttgtgtgtgaagtgaaactgatgggtctgaagtgcaggttttgacatagaccccctgggtgctgggttggaatctaatggaaaggcttttactttgctgggcaattaagagattttcaaatgtgctgaggccaatgtggcctaaggaccttaagcgttttcctggctccaaggtcattacagagccaggaaggcacctttgtaggtgtgatgtgcctggcatggtctctaacactgaatttttttcttttgtagaaacttctattaagacaagctttcccatgactgttaaagtcgatggtgtagctcaagatggaaccacgatgtacattcataacaaagttcacaaccggacaaggaccctcacatgtgcaggggtgagtgtgtggggtgagccccacagtcagtcctcaggctgtgtacacgtttaattacagagccactttccagtctaaaagatagcatggtaagaggcttcgagaaattgttcttaagtgaaaaaaatggagtcataccaaagatggcatgaaaaaacttacttatttttacagttggatacccttaaaaattcttataaacgtacacatgcattcacacatccgtaaacacacgtgtacgcacatatgcatgcacacacatatactgctagccaccctgagcatacacggtacttgtttttactgtgtgtgtgaccttctgcccagtgtgtccctaatgaatgttatgggctgcctcctcatacgaacgtctgccacaggctgtggtcactgggtttttttgttttattttgtttagagacaggtttttgctctgtcaaccaggctggagtgcagtggcacaatcacagctcactgcagcctcaaactcctgggctcaagcaattctcctgccttaacttcccaagtaactggga

SEQ ID NO: 4921 - DNA, 1198 bp, Homo sapiens
acatctgcacttggtgctgtgcacacagcctttgctttgactcggagtggagggtggagagagcaggatggagaggaaagagggctccatgtagagagtgacaggttaaaaggagagaaagaagaatgtgtaattcactctgttcattattataacaatcgcaaaattgggccagggaggacaaattaggccgcggcatctgcattgacgtgtcttagcttacgtttcccctgtgctctagtgttatatatttatggaaatgtcaggcttgcgttgcactgttaactttcttacacggtgacttattttcagtcatccaaagtagaaagattctaattggtgtaaatcatatattatgtttccaaaaatacccatttggttcattctttctaggaactgtgtttggctggcatctgactttctctgggcttttggcgagttccctggagacaatgagttctgcccatctgctgttgaaacgtgttacttcatgggttatttggcgggagcgtgagtctcgctttctttaaaggcaaatctttctgtgtatttgcagaaatgtgcggagattattgtggctcaccttggctacctgaactacactcagtatacagtgatagtgggatttgaacacctgaagctccccatcaagggaatgaacttcacagtaagtataccagctgactgcacgtttccatggctcatgttctagttcccattctttgttcaatgattgaaatacatctcagcatctaaataatgttaatttggacagtggaggacttgtaaagtttttaaaaattataggaaaactacagtttcttaagtatatagaactaagaatagcttaaatatcatagagattgggcaaaccttaggtgtctgagatttagaatagagagtatatagtgtgttcagctgcaaggcagtgaaggggttagcagacacagcacccccttctctggcccctgtgagtggtcgtcagtctctgcccgaactgccggtgagtgggagggcactgttctaattgttagactgtcctttcttgtgtccagctgaaatctcccctttccactcattaggagtcagtataaccagcatagtgatgaggagtgggggtttagactggacggtgagctgggttctcacgctgcctccatcattgactcacgtgattttgttgagcctcagttttctt

SEQ ID NO: 4922 - DNA, 1165 bp, Homo sapiens
aagcctttttattcaggttaaaagttgtactcccatttcctaaaataaggactgaactgagaaactctagctacagctacttggttttccatagagttaagttggctccttagatgctgaagtctgtagttatgaccttgctttcattagtaattagcacctgggcaggtactaaccaatgaatgccctttacacctggcaagaaggaatgggtggggaggccagattgtttcaatctaaagggcactacgttgtggtgggttacgttttttggtagacagacactgcctacaggcaactaagtcattccattaactgtcattatcaatccatgtgtggccaagcttgaattgtcctgctggtttagcttcctgatggggaacaacagctgtcgcaacgcacagtgtctgcagctccatcatgggccccaggacgtcccacagcagctaacactggtctgtactcggaactctgccacctggccagtgacttttgtgcgtcatgttcctgggaatagtatgactgtccatgattcctaggaaagctagaggaataactgaggatgaggagctagcactttgacccctgtggggagtgctggttatagtggttatcagggttgtgacaagtggactcttgtgagttccaacactggatgattttattattcctattactcaggcagtaaaagactagtacatatcctggtgttatataattatatgaaaacttatcagaatgagttttataactagcgtacccatgtttttgttattgtgctgcagataaaatggcgcactgaaatgttactgaattatgtgacaatttttgttacaattctgtgcactttttacaagatttgtggagcttagatagatggctggcctttggcatctgaacattttcctgagcccgatagacaagcagattttttttgtttgtttttggagacagggttctcatgcctgtaatcccagcaccctgcctagttcaagaccagcctggctggcaacatggtgaaaccccgtctctaccaaaaatacaaaagttagctgggcatggtgatgcacgcctgtaatcccagatactctggagactgaggcaggagaatcgcttgaacccgggaggtggaggctacagtgagccgagattgtgccactgcact

SEQ ID NO: 4923 - DNA, 1192 bp, Homo sapiens
ctcagcctcctgaatagctgggattacaggtgcatgctaccatgcctggctactttttgtatttttagcagagacagggtttcaccatgttggccagggtggtctcgaactcctgacctcaagtgatccgtctggctcagcctcccaaagtgctgggattacaggtgtgagccactgcacctggcctatataggcttttttcttaaacctatttagtaatgttttcccaagtttattttttatttttaattttttccccaagtttatttttctatttttttttcatggaaaaatggggtaacttagcagtttcaatattgaagactgaagtttaaaaaaaatttaaattcaaggtacttttaaaattcagttagaaaagtaggctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggaaccttttgaaagatgagcttttgaatataagttgtctgctagatcatggtttgtattgaactaacaaggtttgcagatctgctgacttatataaagctttttgattcctactaagctttaagatttaaaaaatgttcaatgttgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaatcccagcactttgggaggccaaggcaggcagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcat

SEQ ID NO: 4924 - DNA, 1152 bp, Homo sapiens
ccggacagctctgccgccggccccgccgcgctcctagtcccgccgcaacccctgcgctcccctttatttgtgggtctcgctgccacaaaatggcgctgagggaggaaaccaggccccgccgcccggccccgccccgccgcacggctccgctccgccctgccccgccccacagccggtccgaacgcgccgcaggccagcgccactgcctcccgcctcccgcctcccgcctcccgccagcctccccgctccgccatgttcgccttctggcccactcacaggagagtcgcctttcaggcgtggccgcagtcactcgcccgccgccgaaccccgccaggagaggaaaggtgaagggagggaggccgtcggcctagcccgatcggggcctcgaggcacaatggagcagctgctccccggtaacactccccgtcctttcccaggagcctggcgcgagctccgcgggccccggagctcagcaagctcagtaagggaagcggccgaggggaggggcgggccagcgaggtcggaggtcagccccagggcatcacgggaagggaaggtggaagtactcgccggggccacctgcggctgcggggctgcctcgtgcggagggatctgggcgaaggcggcgcgtgattggccgctctgtgttcgtgacgctcatccgtgatgcttccgcgtgtcggaggaccaggtgccacctcaagagagaggccgtgggcggcgagccgcgggcgtttactcttagcagaagctcacctgtaagttttgagaacttagaaaccgatgccttccctctcatcagtcgtgaggcgcagtctcctggccgctgggttcgttcctccttgacatctctggagacgcatcgaggagctattgttctctggcgtcggaggttgcgctgtgtccgcggcgttgagggccccttgctaactggaacacggggaaggcggccctgtgaggtttagtgaactcaatcaaagaggtcctgcaagtggagtagactccctgaagtaagactgccatctggaccgccgagtaatggcggtgttacctggagaacgtgaaacagtctctaaacacttactagaagagcacgtaattcttttgattggtctgtccttagccggctttatcaaacctgttcatccccaa

SEQ ID NO: 4925 - DNA, 1235 bp, Homo sapiens
tgtgtcttcgttaactgtgattgctaatctctccctgcttcttttggtagaaagactacctacaagatctctagtctgatttaaaaatcaaccttaatacttgaatgaaatgctggagttaataggccacctaatgaaattgtaagcggccgttaaataattctttcttaattgcaggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttgagtattacacattaaagtaaagtacaagctgtaaacttgggtttttgtgatgtaggaaatggtttccatctgtactttggtcctctgatttcacatattgcaacctagtactttattagtttaaaaagaaattgaggttgttcaaagtttaagcaattcattctctctgaacacacattgctattcccatcccacccccaatgcacagggctgcaacaccacgacttctgcccattctctccagtgtgtgtaacagggtcacaagaattcgacagccagatgctccaagagggtggcccaaggctatagcccctccttcaatattgacctaacgggggagaaaagatttagattgtttattcttctgtggacacagtttaaaatcttaaacttgtctttttcctcttaatgtatcagcatgctaccctttcaaactcaaattttcattttaactgcttaggaataaatttacacctttgtgaaaattcatccctgcctatcttacctcgttccttttatgccaagtaagccaatgtctttttttttttttttttttttttttaaaccttgggaagtaatgaactcagtcctagtaactagtatttctttaactattacccacatggccaacacctagaagatactatcttaaaattggattgtgaaattcactggtaagctctcagggttacttgtgcatctttaccttctctgggtttaatccaagttctttaactattgcagcagagacagctgcaaaggcttcattgatttcaaatatgt

SEQ ID NO: 4926 - DNA, 1240 bp, Homo sapiens
cataaaatacttttattatccctgatcctatcaaaggtctttttacattggaatattgacagaaaacagctcaaaaacatttatattctcttaatgctttgtgctaccaacacatttatagagccatttttcatgtaactggagaaattttgttggaaatttgtgaactgaatttgttcatttctaaaatgacagttccatcttaggataaaaggagttaccgtgtgctgcctaactaaattctaaacttgtaatatagcacttttaccacaaatgctactgagtccaaggatattaaaatcatgaaagagcaatattcacagatcctttgtaactctcttattagcaactattctgtcaaccctggccaatttggaaggtgaagaaacttttgaagctgcaatgttgggacaggcagaagaagtggtacaggagagaatttgtgatgatgagctgatcttaatcaaaaagtaagagccactttctaaaattgtaaagttataccgattttgttaagtaaaagtaggttttcttcccatttatttgctgcttgtagtctcacagtgatacgagcagttatacgcatgggataaaataacattgggccactgtaaattgagatgaagtaaccattttcatctcttctgcagggactagacattgtttctgtatagtatatctaaatatcctgtgtaggcaggacttaagggaactttatgtagacttattttattaaaatgccattttttttgagaaattgatggtcttggcaaaaaaaaatttttaaaaatgctattacaagaattgtacttttgttttgaacagtactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggtaagaacagtcatttcttgtcttagaggcctgagagcagtagctgtggacttcaattttttttttcccttttgtgaagtcacctaattttcttcttttcctaggggtctcgggaacagcttgcgattgcagagtttgcaagatcacttcttgttattcccaatacactagcagttaatgctgcccaggactccacagatctggttgcaaaattaagagctt

SEQ ID NO: 4927 - DNA, 1240 bp, Homo sapiens; identical to SEQ ID NO: 4926

SEQ ID NO: 4928 - DNA, 1134 bp, Homo sapiens
ctctgacgtctccttcatgggcacctgggctccttcttctgtttcagggctccaaggtcctggccaagaaagagctggcctatgtcccaattatcggctggatgtggtacttcaccgagatggtcttctgttcgcgcaagtgggagcaggatcgcaagacggttgccaccagtttgcagcacctccgggactaccccgagaagtattttgtatgtaggcaccagagcagctgtgtcccaagggctcctgcaggactgtgaccgtgggacccccatgtgacttccacaggacacgtgactgtgtggtcctgtgcgactccagggctgtgtgtgaccatagggctgtgtataacctcagggatgtatgtgaccatggggccgtgtgtgaccgtggggccacgtatgactgtggggccgtgtatgaccatggggccgtgtgtgaccccagggctgtgtgtgaccccagggctgtgtgtgaccatggggccgtgtgtgatcatgtggccatatgtgaccctggggctatgtgtgaccccagggctgtgtgtgaccccagggctatgtgtgacctcagggctgtatgtaaccatggggccctgtgtgatcgtgtggccatatgtgcccctggggctgtgtgtgaccccagggccaggcatgacaccagggctgtgtgtgaccccagggctgtatgtgaccccagggctgtgtgtgacctcagggctgtatgtaaccatggggccctgtgtgatcgtgtggccatatgtgaccctggggctgtgtgtgaccccagggccatgcatgaccccagggctgtgtgtgaccccgaggctgcgtgcgactcctgcctccttccttccagttcctgattcactgtgagggcacacggttcacggagaagaagcatgagatcagcatgcaggtggcccgggccaaggggctgcctcgcctcaagcatcacctgttgccacgaaccaagggcttcgccatcaccgtgaggagcttgagaaatgtaggtaaggaagagtgcgtggccctgggcctccccgtggcagcgaggaagacaagccccagctccggatgggcagagcttgcttcctgccagcacttcccagctgacttgaggctaggagctcag

SEQ ID NO: 4929 - DNA, 1176 bp, Homo sapiens
tggaaggggtaggctccgggggcggggggggagtgcaaggcgggcgggggaaaggtgcagggggcgcctggagggaggcgaagagaggctctgctggtacaaaaggaccctcgctttgtgctgggccgggtgagcgtccctttctgggctgtgatttcaagctgctgttcctggcttcatttacccacccacccagccccctcccggggctaaagcattttctctgctatagacgaagctgggcggggggtggtggtggggggaatgttcctattacatattgctctcttttgtgtcatgcaacatgttcttccgtcgctgacgtttctatggcaaccacaaaaatactacacaatatgcagccccgatatacattgatttatttgtattttgtgtctagtttgcagctttctgctctgcttcttgctttggtttgctaaaatccagcatggcttgtggctacccctcctcactttcattttggtttttccctatcacaggaggggtgggggaggggagttgtcaaggaaacaggcattggtaattacctctctatttacctaattttcggcctatgaatttctccatatcgaggaattaaaaaaagaatgctttgatgtttatgtaagtcttcagtgtctggtctttttttagaaaacctaaacacttcttaagataagatattgatcctgtggtcaagctaagggggaattaattccttacaggaggtgagatcattgaaataaagttttagagagcattggagaattcgcactgataaatgtgatattgcctgcccaggtttgcctaaaagcttaaatatttaaaagatgggtctttgctctcatctgcacttatttagctccaaatcttaagttcaacaagtatgagtaacaaattaactgccgggcaggattctccgtttttcgttttcgtgcattgttcttagatggattagccacgctattcactctcttcaaggtgagggttgctagactttttcaaaactgtggaaggattaactcatctgtgattagtcaacgactctcagttggaaaaaaagtatcttgagagaagggagaatgtgtgtgtttgtgtgtgtgtgtgtgtgtgtgtgtgtttagggaaatgggaggcgggcagggagaacagggcacatcttgagttctacgttaa

SEQ ID NO: 4930 - DNA, 1178 bp, Homo sapiens
agagttgtcaggtccacgggaggagagtcccggccccaacacgctctcctgcctgagatgcctgaagagctggaggctgttagaaggcaacgaaccaaacattctcccaggaaacactaacttgggaaactccattaaaaaccacctgagtgaatcaggaaatggttaagaggtgactgagatgatgataaaactatcattaccagtctttcttcacactaaatacctgctttcggaagcttgaattttatgatgcaacttgccaggctcagtaacaacaatggtttgtgttacttcctaggtacacaatagctagactgtagaactgactgtagaaattagcaactatctcagacaaatacatgacgattatactgatagaacaacattcaccttagccgcagagagcatgagacattgactcaggcagactgactctctccacgcacccaaggctgaatgacagccataaaaccaaggctctgaaataaatagctgcggaggcctcgtggttcagccgcaccgccatcggtctagggctgtgctctggccgttggcatgtggagcatttgctgccaggcgtagccactttgcacacatggcgcttgagtgaactcaggccagatccaagctctttccgtacccagcatttgtcggaatcaagccgactgcagaaatcgccttgccatgtgttccccactggggccaggtaatctcgctgaagcaacactgagtggaatttaaaaaaaaaatgctgacagaagaaatcaaatagtttctttctggaccagaaaaggcatatttttgattctcaaatgctgaactaaaaaatttcaagagctttaaggcccaagtaaaaggattttcacctattaagacctgtaacctttgacgtcatcagtcacagctaaagctggctttcttctgattgggttgcagtgatgtcatccgctgtggtgagagagaaagcgagccctggcggcctggctcaggtcttggcaggtttgtgcaggtggaactcactgcatttattattatcatgtttcttgacgacactaagccatcacagattctctgttggatgattctgaataaattttccttttttttttttttgagacggagcctcactctgtggtccaagctgaagtgtagtggtgcaaccttggctcactaca

SEQ ID NO: 4931 - DNA, 2060 bp, Homo sapiens
gtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggacccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccaacctactaactctggactttgtctgtttattaacctttatatgtttaattaaaataaacaaataaagacaaaagaatgtaaagtcttgagttactggactaaccctgaagaacgtgaccacagataacata

SEQ ID NO: 4932 - DNA, 1177 bp, Homo sapiens
gtaacttttgggttgtggggtcattgctatgaaaaggggcggtaatgcctgggggttgccatggcaatagtaaacagacatggcacactgatgggtacatcccctgacctccgtccctgtgttagcagggtctcagtttggtccagtatctgaaccctgcctccagagtcaagtcccgtctcctacctcactggggaggttgggccctgttttctgatctctgtccccagctacatctagatgacaacacctccttatagactcctccagttatcttgggttcctacaagagcgtgtctgggatagggtccaagatgaactcctgcacggtagccccttgctgctgcctggtgagctctgggtcctgagaagggaaggggaggtgccgtggctgttgtaggcctgcctgggggctggaaccttagggaccacagctgccgaacaccccaaggacctctcgctagctgctctctcctgtatctccaggctgtcccagcctcacccaccatgtggtcggacgagattcagctaccagcgtatcagcggtggagtgaggccctggatgcgaaaagctccagatgtgtttcccttctgtgttctcagtctgatgtgctctgacatatttgcgcctacctagttatccagagacattgatttccttggcggggaagcacgttgggaaaaggaacatttactgattaatggaaggaaatatttgagtcacacattgtccttagatgaatcattgatttattcccagtaaaatctgacttatttaaatggccacacaagtaactaataaagtaatttaaaatcataatttaaactaatgagatactttaaaaacatatttctaggtctctagagtggaaggaatgtggtctgtagattataattgatcatggggagcaaacactttgcttcctgtttactcactgcttgcttggaaatacattggtacatttctggctcttgccaaaatgtaactctgagttaggagagcatcacttcatgtaattgataaagttaaaactttgtgcacttttggacatctgcaatatgcaatactctccaacacagaggcacacgtaggtatgagttgtcgtggaaatgcatgtgtttccatggttaagggcttgcccctgccctgtagaaagagtcatgttgcatgttgtga

SEQ ID NO: 4933 - DNA, 1196 bp, Homo sapiens
tgctccagctacttcccttcacctcagatttgcaggagttccaaagcttgattccaggctttgttgacaaaacacacactctcatatagtgcccttggggtagaaaagtggaaaaactcttgaggaggaaaattggccttataggaaaattatagatgcatttaccctttaacccagagctcccctttctagtaatttaccctgaagacctaccttcataaatacagtaaatacaagattattccttgcagcattattcatacagccagttattgaaaacaacctaagtgctacccataggagaccagttgaataaactacaggatatctatgcatggggcactgcagagccctagaaagaatgagcacaatctccatgaaattcaggtaatttccaggatttactttaaagatttttaccaaaagactataaatgaagtatagtatactcatactgtgccctatctacacacagttgaccttaaacagcatacatttgaactgtgtgagtccacttatcaatgcagatggaaaacacggtacttgcgggatgcaaaacccacctatagggctgactttctgcattcacaggtcctacaggagcgactgtggggcttgggacttgagtagttgcagatatgggtatatggggttgcagagggacatgtcttggaaccaatccccaacagaccctgaggtacaactgtatacatgtggatatatttatgtgtaatgctacctttcatgtaagaagtgagggcaagtaaaaataaatatttatatatttgcttaccttgtaaaaacaaaacaaaataaacaaacaaaaaaccaacacatagatggaattcctcggaagagaacagaaacccctcttatagggaagaagaatgagtagcaatggggtgcgaaagctaaggttggcatgaagactcctcagaaggcaccttcaaatgatgttgtgggcttctgagtggcgtgtccatgtgctaaaccccagaaattcccagctctgtccactgaaagggtttcaaaggctgacacccccatagtcataagaaaacatgcatcctgagcttggtgtgtaagccacactccccgatgaagggagccagggagcatccttggagcagtagctggctccaggtctggagcaggcgacatacaagatgagcctggggtattttgttggtccagga

SEQ ID NO: 4934 - DNA, 1126 bp, Homo sapiens
tattagtcttgagctccagccaagagaacttaatgaccgttgtagtgctgtgcaataggtccctcacttttatgaaaagacaaaacttgttttagttttttgttataaatgacttgatttgtttcctagggctaatgtaatataagtaccaatattgggtggcttaaaacaacacatgtgttgtgtcacagttctagaggcttaaaaatgtgaaatcaaggttcgcggagggctgtggctcctgttctagcttctggtggctgctagacccagatgctgtttggcttgtagatggattactccagtctttgcctccatcttcacatggacttctccctgtgtttctctgtgtctcttccccccagcaaggataccactcattaggttaggacccaggcccaccctactctttgaatggactcatcttaactaaatacatctgcagtggacactgtttccaaataaggtcacactctgaagtactgggagttaggggtttcaacatatttcatttgtgggatacagtttgacccataacttttgtgcttgtccagagaatgaattctaaggcattgccatggtatgtgtgtgtgtgtgtatttttttttgagacggattctcgctctgtcaccaggctggagtgcagtggcggcgattacagctcactgcaacctccaacttcctggttcaagcgattctcctgccccagcctcctgagtagctgggattacaggcacgtgccaccacacccagctaatttttgtatttttagtagagacggggttccactatgttggccaggatggtttcggatctcctgacctcatgatccgcctgcctcggcctcccaaagtgctgggattacaggtgtgagccactgtgcctggccttatattttttaaatcttatttgttagtttttaaacaatacttaaccttagttatttagcttcattttgaatcttcaacttagccaaatccaggtgatacaaaacccaagtaactgaagtttatgtacgtaacataagttcgtcttaactcatgataagggtttttaaagcagattcccgggtatacatacgtatacagatggtccccaatgttacaacagtttgatttatgctttt

SEQ ID NO: 4935 - DNA, 1197 bp, Homo sapiens
ctggaaatcaaatttcgattggctcttttgttttgattttcctcaatcataatttgtgtacatgactagaaaatcacttacataaacccattctgattctccttggacacctattgtgggccagcctctctctggacaagggacagtcacatccccagccctgcctctaggagtttgctctctgctgggaacaacaattacctttgttagtgccattgttaccacaacacatgaccttccaagaggaagggacctggtttccagaaaagagagatttgatcctggcaacaaggacccgtggatggaaggccactgcagagtgtgagctggcagatgcgttttcattttcggttctttgcttcttaatggaattgacttttagtaatctggtatccacattgctctgagtttataaaaatgggggaaggggcaagaaagaacatttcataacatgtgtgtgcttggagggaaaatcgctttttgaaagatcataaggtatttttacagctcgctgaactcagaagctgaaacgcaaatgcgataagaggtcccagctgttggtgccactgtgggcgtgcctcgacttccctggctgcgccgttggttctccaggtggaagatcgggatgcgggagggaattcttggaatggtcagctgctgccttgcttgccctgccacttaccctcccctgctcttgctcctccctccttccacttgaataaatgaaaggtatggacgtcttcctcaacccagagctcagctgaggaggccggcagaacagcaccctcttcagctctcaaaccgtgtcgagctgctgaggtcaagaccaacacagcaacactgacttagagaaagagactggattgaatttaaaacgactggagcaaaatacctatttcacatgaagaacacgtctggctatggatacactgtctcctcgggactggccctgggttttgtagattccaaagcccaactttacccaaagttggtcaggctcgggggagaacccatgctgacggtctcaccagagacgtatcgatgaagccgagcatctgcttgccagtctcccatgaatatcacacatggtaggaagattgttctggtcatgtgggactgctttatcccatgcagggccttatggaagcatcatcgtcatcgcgaggctggacaaggcgttactgtacagagtaccac

SEQ ID NO: 4936 - DNA, 1169 bp, Homo sapiens
atttgggtggggacacagccaaaccatatcagaggtcaatttaaacatttacttgcactgattaggtgcttactgtgtcacagtcaccatccttaagtgctttatgtaatcatcacagccttaacaagcggatacctcattaccttcctatcgcaggtaaggaaactgaggcataaagaagttaaaatgcctgaacaaaagcacacagtgggtaagtggacacgcaaggcttcgcacctcattgatctgacttcagattccatcttcttggcatggtgcccacctacgcaccacagagctgtataagggcagaagagaggagtgtgttctgctgccaccagcaagcactgggaatcatcttgaagaaaagcggggtgagctgtacggagcctttcggggcagattcaagagcagaaagccgtgtctttcttactatggacactcgggaactggagaaaggtttccttctcaaatttattgactagaactcagttccaaatcaacatttcaaaaaagtttcttatttctgtgagaggcaacatatattatatttctactaatgtggcattaatgcttgtttttttcttttttagtccctgagtggtttcaaatgtgtgttttcatgtacaatttatagttctgaagagtgtgtcatttccagatatttcctgactgtctcatcaatgcccacatcattaaagttaatttcatgcctaaggaatctacactaccttccatttggaaaatgttctgcagattctagcaaagtcaacagccaaaccgtgaatgtaaaggctgccgtacagactacagaagtaggcagcttgccattgccacgctacctactttacattcaagtgatttatataagagccaaaaaaatgtgctccacatagtattgatctttcactgccatgcagggatgagctgtccagatgataaattaagacaatgagaacataagggattggcttcaagatttgtggttgccgacggaatttcttcagcagaaagagaaggaaactgaactacggaactggtaggatattattatttttactgtaaacgatccaagcctgtcaggcctgtaacttccaagtgcaatgtattatgatctacagtgtaaaacaaaagattctgaatttgagtcagtaatagctggtttattc

SEQ ID NO: 4937 - DNA, 1309 bp, Homo sapiens
gccctggacggctcctgtgtggcatcccccgtgcccgcacgctgcccgcgccccggagaggcgccctggacggctcctgtgtggcatcccccgtgcttcttgtgctcccctttcctgtcatctttacacactgttgaaaaacctgaagatgttggcctttttcaaaacattttttaggtgagccttttaagttcatttcacaaagcctggataaagttgctgtttttataatttgaaaaagataattttgaaaacttagattttttttttccttttgacaaagttgaccgctgttgccttgtcttctcacccagggcatgtgggacgtgctcttggctgtgaagctgtggggtgtgtgcagagagcctggggcctggggttcccagaggagcatcttggggaggcctgcacagtaggatcctgcccatgtgccctgagctgatgtgccagccgtgtgaaagtgctctgacaccgtgggccgtacggagggcctccagaggggatgttgaaggcaggagacagctgtgccgggagcctctgcaggccgtggagggcccgtcctgtgacgtgtctgccctccctgctccacctctggtgttgctgcttctgcgtcaggacccttgctgcagcgccatgtctgcatcttctttgcttttgtagctttggatcttcagtttgatggatggacaccattatcgtcgtgtggcacgggttgacctaaggaagaagacagagactttctccacaagaagggttaagtctgggctgtgcagccagccaggtgggttgctcagaccctccctcaggcctcccacttggcccagatctttcaccaggcgccatgtcaagggccctaggtcacacaggggagagagagatcccaatgtaggagaagccaagggctgcaacctcagaaaaccactgaggccctgcaggtcatgtgaggggtgggccatcagcagatggaggcacctggtgtgggtggggacgggggtgagaggctttggtgaacagaagagcagaggcaccaaggcagcagctttgcagctatgggttgctttcctgcagtgggtgaccaaggagggcaggtcatgctgatcagaaaggtacactgcatgactcagatgccacctgcacctacccagcaccctccacgtccccacctggcctgtgaatcttagacgccacctacacctgcccagcaccctcacatcctcacctggtctcctgcgcatcacagatgccacctgcacccgcccagcaccctcgtactcacctggtctcctgcgcattgcagatgccacatgca

SEQ ID NO: 4938 - DNA, 1121 bp, Homo sapiens
tcttatctttggctgtttttcaagtagaaaagtaagtgtactgtgagccttttatttgagatgctgagagctattaggatgagtatttcagttttcttgtcaatagtgatactctgatgatgttgcagttatttgaagtagaactgattgtctaaaccagacacacataggagtgtgctccattggtcttgtggagagtgctgcacattaacccctccctcaactgtgcaatccacttgagactggcttctctaagccacagttgttatctgctgtgtaaagtcctggatgccagcactgtggcttcttagagagggcagatgctttgtatatcgagctgcagcattcatcgtagaaaatgctacaaagctgtctctcttccccttctctcatgtttccctcttttcatcaagatgaaggctgttgggtaagaaaaactaagtgatttaacaaatcattatgatttaaacttagaaataaacctagaattttttggtgtcccttttatcataggtgtttaatgtatattttaatgattgtagaacttgaattgctctagaatgtgaatgactacccttgtgttttactccttttggcttttgttttgtaaagaatctcctgtgaggagttctgtttttagaatttaatattgtttggttacttccctgactttagtgaaagatattagagtatttactatgccagtatctaacttaaactattagtattaaataagtatatcttttacatttagtacaggtaccataaccaagagatttcttagttttgatggattaagagagagcattctgctgtatattatggcaggtacagatatgatcataactgaaccagaatttggattatagaagtgcacttcctagctgttttttatttaggtataggaacacacaatgagaaccttatgtttagaatgtagcagtaacaacagagggtaactacactgcaagacttaaatggtttgagcatgtgacactatccttttgttggggggagcagggtataaaaatatacatacaggagattagtttaatagtaaagttttatatgtatgtttaacttccatgatatttattattttgtagagacatttgtgattg

SEQ ID NO: 4939 - DNA, 1099 bp, Homo sapiens
aaggaaaattttagagtaagctgatgagaaagttttgccaagtgaaattgttaaacaccttgtatgtcagaactgtgattgtggtaaataattcacaagaacaggctgaagtaagtcacctttccctcaaactaactagaacacgttctaacatgttcatttacctttcttcaagtaaaaaaagcgacattaagttagtgtatttcatattttattaggaaatgcttttatgtaattaacttaaaaattcttttttttttttgtagcctatagcaagcaaattttaagcttaattcagcaagggttggcttccaagggtggctgcaataggctgcagctatgtgatttttgtacttgtttttacatatatagcttatgtaatttctttatataaattaatgcttaataactgaaagcaagtgagctccaaagatgaaatttcagaagcagtatacatgaatgagtgtgttctactggtctgctaagagctttaaatggaagtggccgctcaaagcacagtgtcctgttaactcttgagtgctaagtagatctttgcaacagtaagcttgattgatcatgggttaaaaagagagaatattgaaatagatgttttaatacaggctggaaatcagctattcaacactatcattgatttagtatacaagaaatcatatggattaactgaacttaatagtactcaagtaggatatgcaaaatttatattttacataatctgtgaacatttttagtacctaaaaatgtttcaggtatttcaaagatgggaacaaccagtatctagtcatcatacattaatgtgaacatgcttattaaaagttaacctctttataaaaagtattaataaaccaagatgtgcctaaatattagggtacttcaagctaaaggtcatagtttatatataaaaagtacgagattcaaggaagtaatgtatctgatgctttgcttaataagattcactagtgcttgcccttaattcatagaacagtattgtttaggttacattaacctgaaatttaaagcataattattaggattccggcctataaatacaataattaaaatctatactatattattgcta

SEQ ID NO: 4940 - DNA, 1116 bp, Homo sapiens
tgaagctgtgtgccgtaatagtagctgaagcggataattgtgtttttgtgacttatgtcagaaaacaaagttgatgaaggcactgatatggaatcagttttatataatatacttagaagaaggaggaatgatttttaacataacttactttagtctccactggaaaaagctttcttacatttagaatgatctttttatttttaaaatgataaagctttaaaactttctttgaatattttccatagttttcaaaatccagactcaaatttgtcttaattccaaagaatctttgtttttgccttttaaactccaggacagctcctctggcaatgtatctgaaggggaaagccctcctgacagccaggaggactctttccagggaagacagaaatcaaaagacaaagctgccactccaagaaaagatggtcccaaacgttctgtactgtccaagtcagttcctgggtacaaggtagaagaaaaaagcccctgactcagcttctttactgaccagcctctccctgaaatattttaacttgactttcacgattgtggagcttctgcctgctgtacctcactagctgttcttctatggtgtgccctttgtccgctgctttcttttttgctttatttccttggtggcttttctgtcacttttggctatggtttaccttctgttttctgtatatgtacaatttataagtctttttttttctttgaaagaataaccaggcaagtatgggtttttaaaacattatttcataggcagaagtttatattttctttccttggagtaaagatcataattatttggcattttaaatgccccagcatttagtgtagctaaagctgctgagctataaagtatgagtggatatactgttagactaagttgcattttttttagtgcctttcattaagaaagatctgggtttaatctaaggattatttgatccatatgctaaatttagctaactctgggatagaaaataataaaacctgttacttacattgtagtgatttttagcataaccttggtaaagagcctatatgattctatggcaagaattaaaacatacttgttaacttgttgatctgattatcctcagagtaaaggag

SEQ ID NO: 4941 - DNA, 1242 bp, Homo sapiens
gaagaatcttcaggtcaccaaagaattgaaattttaagccccagattgtactgagctgtacctgtgggaaaaggaatggccagggtattgatgatggaaaagattcaaatgaggagttagaaggcaagccctctgtgggcagccgtcttccagaaacctcgaacttatgtctgtctccacctgagaaaggagaagaaaagctggtggtgacccctgctcctgctgggccatgccatggctctgaagatgccccgtgttcttaggaggtgctcacccctggcacctaaagacatttccttctggttgttgctctttaaaaacaaaataagcccctgaacgtgcttgcaggccagtttgtgtgcctgcacttgacgaattaccttgaccaacgggccaaaggcacagagctccaaggcatcatctttccttaaaatcctgagtgtttattaaaaagggacatggtctctaggtatcttattacatttgtatttcttacatttgaaatatcctaaccgctcccttcggtttcttcttaagaacatttacatctaattatttttcgtgcaagtcttgtaggacccacatgttttcctagctttggaaatcgatttttttcattcctcttatgaggatttccctatgtcagtaaacattaactttctatttcttccatttttgctcatttgaaacccctgctgcttctagatctatttctttgcacttgtataactttgaaataaattcctcatcccttagactaagagagtgggtgtctgtgaaaattgttttctccttcataatacctaaattctagtttgtcagtaaaatatttgtgtttggttaacaagctcttatttaagccattgagttagtataatctttattacctttgaaaaaccagagagctgaattttttgtcattctaagttgtaagtaacactgcagtcaagtcttctgatgaaatttccatatatcaaattgaaaataaagcaaaatatatttattactcataactaatatactttcacatttctctgattatttgtaagacatttcagcatgtggatgtggggaagggtgagcctgccccagaaacatctccctgctgccaccatggccacggctcggcagtctcccttcactgactcctgaaactccacgtaaatctaccatcacccaccccttctttgaccgttccctgcaccttcttgctcacagaaagctggtgtttcccccattcct

SEQ ID NO: 4942 - DNA, 1100 bp, Homo sapiens
ggtgcagcaactaatggaactgtcatctcgcctttctggctgagcaatgtcattggtacaaattatggctgcgtcttattgggaataagcatgagttgttttgtgtggcagttcaaacacgggtaaaggaaatcaatggaagcgagtaggaggactgtgcctactgtttaccttagtctctcgactcattgtctatattctgttctgtaatgctggggctaaaactacatttctcagtctagtttgtgttgctgtaacagaatatctgagactggataatttacaatgaacagaaattcattttcttaccattacggaggccagggagtccaagatccaggcaacagcatttggcgagggtcgcgttgccgtgtcctttaatgatagaaggcagatgggctgagaagggaggcagggcacagacaagaggggtcaaacttaccctttcatgacaacattaattccgcccatgaggtcggagtccgcatggcctaatcaccctcaaagtttccacctcttaatactgtcacactggcagctcaattttagcacaagttttttggaggggacaaacactcaaaccacagcactctgcaaactgcacttgcaagatagctggcttttattacttgcatttcccttcatagcaggcttcttattaggttctgccaatgggagctcctaggagtttgaaagatgagaagagaggagcgacttcctcatattctcctgtttctgtcaattggctccagccccagttgagtcccacccacttcatgctgagcaccagtgccaaggaaccctgctctgagcactgcttgccttaggttctggtaaccttccctctctttttttgcaccatcatccccagccacggacgggcagcttctttagttcctaatatcggggttgtttcacctcgcattttacccttccagacttccaacacctatgtaaccaattcatctggttaaattccctctgtttgaattaccagtgcagtttttactttcctgtctggaccctgactgacacaaatcccatctcacactgtgaatcttagagcctgagtaacataagcctacttaacaaatgtctga

SEQ ID NO: 4943 - DNA, 1211 bp, Homo sapiens
cgataggctctatcatgttataacctcagtgcatagttaggctataccagctaggcttgtgtctgttgctctgtgatgttcgcatgatgatgaaattgcctcatgatgaatttctcagaacgcttccccatcattacgtgacacgtgactgcatttcaaaagtaacaagaggctgggtgcggtggctcacacctgtaatcccagcactttgggaggctgagatgggaggattgcttgagctgagatgtttgagaccagcctgggcaacatagtgagacctcatctccactaaaaataaaaaagttagccaagtgtggtggtgcatacctgtggtcccagctacttgggaggctgaagtgggaggagcacctgagcccaggaggttgaggctgcagtgagctgtgatcaagactctgtttagaaaaaaacagtggtgaaatacacattaaacttcaaattgcatatttgtaccattgcctgataacagcaggctgagggtggagtagggagatttcaggccgcgtcacagcatcaggccagggtggctcacacggtgatgtgttggctccgcttcaggtgattcccaaggactacaaaaccatgactgcgctggccaaggccatctccaagaacgtgctcttcgctcacctggatgacaacgagaggaggtaggcagactcgtcccctgccccggcatcaccgccgccctcctcggcctccgggaggtgggcaggtcccgccacttgcctgggcatcactgcctccctccctggcctccaggaggtgggcagcccccgttgctcgcctgggaatcacagctgccttctccggcctccgggaggtgggcaggccccgttgcttgcccaggaatcaccaccgccctccttgccctccgggaggtgggcaggccccattgcttgcccgggagtcaccaccaccctccttgccctccgggaggtgggcaggccccgttgcttgcccgggaatcaccaccgccctccttgccctccgggaggtgggcaggccccgttgcttgcccgggaatcaccaccaccctccttgccctcggggaggtaggcagcccccgttgctctcctgggaatcaccgccgccctccccggcctccagggaggctttgccgtttctctgactcatgggccatggaatacagaacgctcggcgccaggagaagcgtgtcacagctctcagga

SEQ ID NO: 4944 - DNA, 1362 bp, Homo sapiens
cggcttcgcaggcgtgtctctctcatcatatggcgatggcttcgcaggcgtgtctctctcatcatatggggatggcttcgcaggcgtgtctctctgatcatatggcgacggcttcgcaggcgtctctctctcatcatatggcgatggcttcgcaggcgtgtgtctctctgatcatatggggacggcttcgcaggcgtgtctctctcatcatatggcgatggcttcgcaggcgtgtgtctctctgatcatagggggacggcttcgcaggcgtgtctctcatcatatggcgatggcttcgcaggcgtgtgtctctctgatcatagggggacggcttcgcaggcgtgtctctctgatcatacacgtcagcacgtgtggcaagtgtgttgtttgcatctctgtgtggctctaaatgtttgttttttgagacagggtctcgctctgtcacccaggctggagtgctgtggcgcaatcctcccacctcagactcctgcgtagctgggaccacaggcatgcaccacggcacctggctaatcttcctgttttttatagagatggggtctttgccatgttgcccaggctggtcttgacttcctgggctctagtgatccacctgccttggcctccacagggctaggactgcagccgtgcaccgcctctgtgaatgttctgaacgacggggcatttgtcagctttgcgtccaccccaagacttgttttgaaatggtgaggttgaaactcacaggtgtcccttaaatgtgatgtgcggtaacttgagttgttgaggttttgcttgtgaatttctcattcttctttccctttttcgttccagagcgccgccctgtgctgggctgccgggagctcgtcttcaggaacctctccaagatcctccctgccctgtgccacgacatcaccgactgggtggtggggacccgagtgaagtcggcacagctgctcccagtgctgctgctgcatgccgaggaccacgccacgcagcacctggaggtcgtcctccggaccctgttccaggcctgcaccgacgaggaggcagccgtggtccaaagtgtaagtggccgtattccagtcgtggtcgcggagctgtaactcgagcttaagatcccgcctctgtggtgtgcggggcccgaggctgtactgtagccaagacagcgttcccctcacccccgggccgcaggccctccccacacccagcccctgggaacaactgatctcctttctgtgcccgtaggtaacagcgtgttgagggtgaacccttcatgctcattttcaagcacactcgggggtgcagtgccaggtgcatgttgtgtagacgtgttgtgtagacgtgccgtgcaccagacagacaggg

SEQ ID NO: 4945 - DNA, 1133 bp, Homo sapiens
aacgtgtagtgactagttccaatggggagatgaagcagcaggtagtaatcttataactctgtttttataaatgcattacttttgtaggatgtttgaacaaagacaatccaaaaacttcagtgtgtttccaagaaagctctaagcagtgaagcagccagggttagagagttcttagagaatgctgcagggtgaggcactggcgctcagacttggctgacgtggagtctgggcagtgggagccccagcctggctggcgagagcatggggtcccaaggctgtgcatggagagggaagcatggtaaggggcgcccagccgctcatctgcattcggtttatgttctggttggcccttttgagacaattagaagatccagattagttccagagatcacatgtgctaattttgggaagccttggtattggtgtttgttctgttttgctcagctagtgagagtggttaccaggcaacagagaggcatctgctgctgctgaggcttgtgccttgctgagcgggctgtgagaagatagatgggctttcctctccttccctcatgttctgctttcctccttaggccaggtgctgtgtgtgctgccgtctgtctgtattttcttcaaggataagctttcaccttcagtcagaagatggtatctgcatatatctggaggcattttaggaaataaactgtgaccagtgccataatgctgatttattaaccattgtaacctttacattttttaatgggttttgttcttatttgataagctgagctcaacagcaaaaatgtgtgtgtgtgtgtgtttttttttttaggtcttgatgatgatggtgatcttaaaggtaattattttagtccttttatcttcatatacttttcaaaatagaagttttagttaaatatctgcagactgtgataaacaggttccatctactgtttgaaaactttaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatgtaagtc

SEQ ID NO: 4946 - DNA, 1213 bp, Homo sapiens
tcttcttacccttctagcaggtctgatgcttattccagccgattttgcagccctggctctgccatgttggcctccctcaattgcttgtcaccaagacccctgtggtttttgacaaggcgctgggcatggatgggtctttccgagctccactgtgaatcacctcgccctctggtccttgggcctgtcctggcttggtggactcagccgctggagctgggagtggggcgccctggagagtggcagccccgggctttggtgactcagactctgctgttcctacctgaggtcaggagggtttttttttttaataaatgtgacccgggctgggcgcgctggctcatgcctgtaatcccagaactttgggaggctgaggtgggcggatcacgaggtcaggagatcgagaccacggtgaaaccccatctctactaaaaatacaaaaaattagctgggagtggtggcgggcacctgtagtcccagctactcgggaggctgaggccggacaatggcgtgaacccaggaggcggagcttgcagtgagctgagattgcgccactgcactccagcctgggtgacagagcaagactcctactctgtctcaaaaaaaaaaaaaaaagtgacccgatttgttgtgcggccttggtcagcttcaagagccctaaaacggttgtttcttttcctttttttttaattttttttttgagacagaatctagctgtgtcacccaggttggagtgcagtggtgcgatctcggctcactgcaacctctgcctccccagttcaagcgattctcctgcctcagcctccccagtagctgggattacaggcgcctgcctgtaatttttgtatttttccccggctaatttttgtatgtttagtagagacaggattttaccatgttgaagaggctggtctcaatctcctaccttgtgatccgcccaccttggccttcctaagtgctgagattacaggcgtgagccaccgcccctggcctaaaatggctgtttctaaccacccgtctagcttgtcattgctcagatggcctaggaaccacacccctcccgtgtttggtcctcaggagaattcagtgaggccagaggacgggttgtgttggatggaggtggcggcaaggctgctcctgggatgctgcagggcccctgcacagacctttcggttcttggtccattctgcgccctcccatggcccacacatctgca

SEQ ID NO: 4947 - DNA, 1192 bp, Homo sapiens
aggtgagtggggagggcatgtccacctgttccgtgttcgcacctgcagactaaactcaccgcaccccagggtgtggagcgactgcgtgctgagctgcaagtgaaatggagtgttacactgtagcctttacgaaaatgagcagtgaaagagttttttatatgcttttaggaaccacgcaggaatggggggcctcaggggccacgcgtgtcggctggattcccaaggtgatcttcaggccggtggttttcagcctgttgggattaggaccacttgaagggtcttaattcttttattggattaaggtattttaaaattgtttaaaacaaatacatgcttgtcatgaaagtttaggtaatgcagatatatggaacttctgtcaatatggtggattggtcaacatgggaaatcgtcccttctgcctcacacacataaaaatactggaagaggctgggcgtggtggctccgagcactttgggaggctgtggcgggtggatcacctgaggtcaggaatttgagaccagtctggccaacatgttgaaaccctgtctctacaaaaaatagaaaaatgagctgggtgtgatggtggggcgcctgtgatcccagctacttgggaggctgaggcaggagaatcgcttgaacctgggaagcagagttgcagtgagccgagtttgcagcactgcactccagcctgggcgacagagcgagactccgtctcaaaaaaaaaaaaaaaaaaatgcctgggagaaatatcacagccgaattttctagcatagttaattcaaaagcaggtggtaaagaagagacccagcagccgctccagtgaggggggtgcacactggatggcccccatcggcatcaaagcgggtgcacacggtaggggcgtgtgtgtcagcagtgacacggcaacccgggtgatctcagacactcaggcggcagagagtggaactcaactgccctcctagccgagagccacttgtccttaaaatgggaggtacaaaatccttttagctggcggagacacatggcagggaagctggggtggatagaaagccatccgcacagaatcagaaccccaggcagatttgcactgcccccgcctcatgggaacccccagttgacaagtcagcacacccgtgcgtttgggccgtgagattcgtggagtccgcagcagataggtgcaaagctgcccaca

SEQ ID NO: 4948 - DNA, 1199 bp, Homo sapiens
aggaaaattgggccgttttgaagcactatcgagttctgcctgtcttgctaaatcatctgtgttccaactgtgctctttgaactgttgaaggccagaagttgttttgcgtttgatcacctataaccgccaaccccccatgtgtttctgcctgtgtttaactggtcacagggagcttggggctcctccggttcccatccttgggagaggcaggcccatccactcagtacccacggcaggcacctggttctcatctctgacgccccgactttcccttctcagcctgtgtcgcctttcctgtgatttcctctccttgccttcctgggatcctgctagttccagcccatccccactgccgctacgccacttggaaaccctttctcgtgcagtggccaccttaccgtccctggcttcacttttgcgtcttgcaactattcttcactccagcacttggagggatctgcctgagatgaagcaatgaccacgagaccctgctcaaagctgtttgtctgtccctgccgatgtcacgatgaagtcctcatgtctccatgtggctgaccagaagcctcctgccattgcctggctctcccgcttctctgtcaccctcgcctcagcctctgcaccagccacaccgaacatgagttctgtgctttctcccactccctctgccctcccacttgccctcccctttccctgttacggcccactccagccccgaacacttagtggctttgaacagtgcttggtaatttttcaggattctgcaggttgcctggggccaatctggtggcagttggggatgggacatccaggatggctttatgtgcacgtgtgctgccttgttaatggccaggaggcagggctgccttctttcctcaggggctctctctggctaggacgagctgcttcacgtggctgccaaagcccatagggacaagccctggcatgcaggttccttaagcctgttggttgtggttgcagtagctgtggccagagcctggcccgggtgtttgtggaagggacgacctgagggcacgagtccgggaggcagggccccttcggatgcattcatcatttagggtttatctgcatcctgtctcgtctcaggaagccttccgcaacccctccacccagactgtggtccagcccctgctccaagtgcccccggtgggcctttgtgctctcagtcctggccgacccct

SEQ ID NO: 4949 - DNA, 1219 bp, Homo sapiens
catcacattaaataaggtattaaatagccccatttatatagcaatcaggcaagagaaataaagtgcatctggattggaagagaggaagtcaaactatctctgtttgctgatgatatgatattatacctagaacaccctcaagactcctctagaagactcctagatttgagaaaagaattcagtgaagtttcaggttacaaaatcagtatacacaaatcagtagcatgctatctgccagcagcgaccaagctgagaatcaaatcaagaactcattcccatttacaatagctacaataacaacaaccaaacaccctaggaatatagttacccaaggatgtgaaagatctctacaaggagaacaataaaacactgatgaaataaatcatagatgacacaaacaaatggaaaaacatcccgtgctcagggattgggagaatcaatattgtgaaaatgaccacactgccaaaagcaatctacagagtcagtgtgattcctaccaagataccaacgtcatttttcacagaattagaaaaagatccaaaaattcacatggaaacaatgagcccgaaaaggcaaagcaatcctaagcaaaaggaatgaatttggagggatcgcattacctgattcaagttaatctctaaggctgtagtaaccaaaatagcatgatcctggtataaacgtgcacacagacccatggaacagaataggaacccagaaataaagctacatttttacaagcagctgatctttgacaaaacatacaaaaacatatcactggggaaaggacgccctggttaataagtggcgctaggaaaattggatagccacatgcaaaagaatgaaactgggtcgctcgctctcaccatatgcaaaaatcaactcaagacttaaatctaagacctgaaactataacaactctagaagataacattgggagaactcttccggacataggccaaggcaaagaatttatgcccaaggccccaaaagcaacagaaacacatttccttttttttttttttttttttttttttgctgggattacaggcgcctgccaccatgcctggctgatttttgtatttttagtagagacagggtttcaccatgttggccaggctagtcttgcactcctgttctcaggtgatccacctgccttggcctcccaaagtgctgagattacaggtgtgtgcctccgtgcctggcctcttttttttttttt

SEQ ID NO: 4950 - DNA, 1232 bp, Homo sapiens
gactgtggtttcagcagttctgagacaagagccttccaagtcgggggctggggagcagagtgcgggagctcctgagtcctgggggcctccgcgcctcacagcatgggcacatgtgggacagaaggcctaatggggtgcctgagggtggcctggttgctgtccccccagggtgggaccatgagcgagtaggggtggcacacgggctcagctctctgtggccggggtggctcctcttgcgggactcaacgtcagccccaaggcgatgttcagggggtccctcagccttttgaggtggtgccgtttagggccgccatgcctgtctatccaggggacggactccgcctgctgttcccgcgctgagctacaggactcccgagtgtgagccgcggttcctctgttgcagcgcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaccggtctttctcctctctttgaatgtagatagagaccttgaacttggtgcctgcctccctccccagtggcaagggcctgcttgccaagccagacctctgcagggcgctgtcccgtccggtcgtcacgcacactcggccaccctgtgtccagcgatgcactagtcatgccacagtctcttctgttgcgttgttttctgtgaaagatgctggtcattttccctggtgagaaccctgtgacttttccttggagttagacacattgggaaacttgtattgagaatggtcagttctgcccgttttttcattttgagatggagtctcgcactatcactcgggttggagtacagtggcgcaatcttggc

SEQ ID NO: 4951 - DNA, 1174 bp, Homo sapiens
gattaccaaactgaatccaggcagtgccatgaccctgggtgtcccttggttcacatcacccaccagacagctgcggagagagtgcagggaggggctgggaccaaacaggccagaaaccagcagaaaagaggcagaagtgaggtgggtgtgcctggggcacgaagccagcgccggggggatttcagtggagccttacagccaggctccgtgcggactgtgatgccagagaggcgtgcagcctctgggcaagtcgggagagggcttgggtggtccccacaaggcagaagaggtggaagggccagagaagaccaccaagaccaccgttcccgcaggcctggggtgagtgacctgactgagactagcgggcagagccaagcagggctaaactccaacccagggcccggtgttggacaaagtagctttttctttgctcgtttgtctgtgtattaagaagagactaaaatagccaaacgacgctggtcgcatgcgctggctgtggtctgtctgctgaatgtctatttttgtctcctgacgagacgtgaggaccatgcccttgatccctccgatggaccagaaacccccttccttgcaaaaaaaaggcaattgaattaggaaaagatagcccaacctagctcagatccaccaagataagcacagcaaagcttggctgcatttttgaggaataaaaacctgcagaaagcaccgataaccttcaagatctgaatgagattctattataacccgtctaaacgattgcaaaattcctcctttggttttggaagcagcgtttgctctcccgtggctcggattctctgaggaccagggagttgacacacaaaccccgccatgggtccgagccagctatttctcaaggctcccacctcgccaagctcccaagggcctgctggcagtgcctacgctgtgccaactaccctgtctggtacagaccacggctgggtaagcacccttaaaagcaacagaaatgacgtctggaagctgaaatgtgaaactgtcaagatggcttaggagaggaaggagtggacccgctggtctttggcattttgtatttagaattattctaactttatacataatgtataggccgatcttttggaagggataaggttttcattcttgtgcaactcattattctcattattggccttttaaataa

SEQ ID NO: 4952 - DNA, 1582 bp, Homo sapiens
agccgaggccggagcagctgtctgggagtcaaggctgcagtagcgtttcttcatggggtgctccagggggtgccacagaccgacaggcagcccaagggcctggacacccctccccaggcaggtgctgccccaggaggactgtcctcgggaatgaacctcccgcgggctttggactgaggtccctgtggcctcggtctcctccccatgaagtgggagcgaggctccccaatggtgcttttggctttagtgtacgatgtttgctgtgcttcccgccgtggagggcagagccaccccacatcaggatcggacgtgctacccctcccggtcccggccctggcccagccagcccagccctcgaggctcgatgcctgtgccaaggccaggggcagccagagggcagctggatggccacgtgcaggggtcaaggctgggccctgcagtggggcgggccgccagccccagcagtttacagacgcatggctcttcctcccagagcagccggcagctacctggaccggaaatgtcctcatcccctccctggggccaggctctgccctggccttcctctgtgaacccctcctttctttgtgctggtgtctgggaccaaaaagggggaatatgggagggcagagtggggaggggagtccatgggcctggggccccaagccggggcgtctgagctccccaggcatgaccaaacctcagtggaggggcctctgcttcaggccccgcctggctgacattctgagcccccctcggaggccccgccacagccaacctgcccagtctttcctctgggcttgacccgccaggggagttctccaggcctagggccaggagagaggccctggcaccctggcgtgggtgcccgccaaacgccctgcgaccgctcagaagcacaaatgctgtccatggccgtgaggctgcctgccaggtgaatggacatagcgtgagaggcggtgaggccagggcttccagcctcgtgctgtctcgggactcctgaccgtggtgtgcgtgtgtgcccgtctgtgactttctactcaccaaggttgaagaaaggaaacggggaaaatcaaaaggggttcaaaccccacctcagtaggtggaggggagcgcctgccattggttgtatttttgttctgagttttcggtgccgtgttcctaactactccatcccatgacctcgccacacctactggggcatctggctggtgcctgctgccatggccagcccccactctcaccctgcacagggggtcttgcagcccccaggcccacagcctcgttgggaggacagggtggccctggggacaagagggaggagcccaggggcttacctcactgagagtgctccccagcaggcatccactaccccagggccccccacatgtcatggcaaggttggtagtgaatgggcctggttgggagcagcccctggcccattgcccacccacccatctcactatgcaattcgagttccaagcaacatttgctcctgccctggggccagctctgccccagccctgagaggggtggtgaggcagccccctggaccccagaaccccagacaagggggcaggcg

SEQ ID NO: 4953 - DNA, 1190 bp, Homo sapiens
cgtgtagctcgtctgttaaagtctgaccagaagtggccgggcgcagtggctcatgcccgtaatcccagcaccttgggaggctgaggcgggtggatcacgaggtcaggagttcaagaccagcctggccaagatggtgagacccgcccccccactccccatctctactaaaaatacaaaaaattagccaggtgtggtggcaggcgcctgtaatctcagctactcgggaggctgaggcagagaattgcctgaacccaggaggtggacattgcagtgaactgagatgacgccactgcactccagcctgggcaactgagcaagactgtctcaaaaaaaaatctggccagaagtccagtcgagggaaagtttatcgccgcagagacagatgtaggggtggtcaagagcgtggccctctgtgaggaggatgtaaagtcctccaggcccagctccggggctctctggtactagctccaggcgcagagggagtctctgagaacagggttgctggggacagccgcggtgcctgacctgcaggcctccatcgttgctgtctgcaacttcagcctctgccctgaagctgtggggaaagctgatctgaatcgtccccgagagcttggggagcgccgagggggcatgcagggctgtggccagcagcgtgaacccctcgagactgtggcacccctcctcctcctcagtccgacagctggctcccaagggatctcccgcagcctcggggtgatgcaggagatcttcgccaccaatgtgtttcccatctgtgctcctcaaagaaggtcagtacaaactaggccgaggacacttggtcaggtaggagactttgaaactcgggcatcaagaactgaaccagacctgcatctggaaatcacacgaatgaagttggttctttgtggctctcccgctcacccaggctgtctggatgcacccgggtgcatgttgccacattcccctgcaaacaggtgccagcagctcttgtgacttagctgtgggtgacaggtgctgagcacgcgtctgcagcagggcccccacacagcccacaggcaccgtgggctgtacactctgtggtgctttcttattaggagtcaacctgttcaatttttttttcttcttttataaaatgtactcaagtcacatataatttctacaccactcacaggttgtacaactgccatgcaaat

SEQ ID NO: 4954 - DNA, 1113 bp, Homo sapiens
ataaataaagttgtgttccagaggcttttattcaaaacactttttatttttaaagcatggcatggcagcatatacacctaaacacatgcatgtgagcatgagaggcctcgctctccaagatcagaagctgggaggggaaggaccttgacgtgctctggagaccagcggtgcccatggggatggcaggtggaggttctgtcctcacaacccctggggttatcgttccagccagaaagcgaagagaccactcacaggaagcaagggcaccgtccggtcctcggcgtggtgtgaccagagctctcatgctcaggcctccaccataacttgctcttcggcatcacggggcatctctcttcttgcccaaacaagcagctttctggaaagaggagtggggatgccacttagcaccattagcccatgtgtggctggtgggggcttgaactgaccacaagtgggaaaggcagagagtgcgccagaaaaacacctgccctgagcacacagtgtgctccgactgtaggctgagctctgggagcctggatgtcctcacgtctccatgctggatgatgtagtggctctctgccctggggacacagtcgaatcacctgaggagctctcacccgggcagtgtgctgagccgccaggcctgagacaccaactcatacaggtttctccatgtcccaggcggttctgatgtcagccagggttgacagtcactgaagaggcaagctgggaggttccttccaggtttggggacatccatgtttaatgtggtgaggattgtatttcaccgtgtaacgtgccaccaaggtcttctcactgtggccagcaacctgcctcgagaattgcggggatggtgggttttctttggtgatttaagggcagagatgaaatccttgctaatctttcctcacgcacatgcagcctttccaaatctggtagtgccatttctctgtaaggtgcatcacatgtgcttagcagtctctttccgaaatgattgcttgaaattcaggaggctttgctttgaagaggacaggccactttaagacttgcttaatttgcacagcagccccggggagagatggtcctgaaatatgggatcctggtgtttccttg

SEQ ID NO: 4955 - DNA, 1211 bp, Homo sapiens
aaaaaaaagaagcccagacagcaagcagcccatgcagagtccacgtggacaaggatcaaggttcccagccctccctggctgagatcccagccaatagccggcagcactttgcagccacatgagagcactgtctgggaagtggatcctgcggccccagctgagctgcccgagttgaccccgcgtggagcagagacaagctttctctcccaggctctgcccgaactacagaatccatgagctcaagaaattgttgttgtttgaagtcattaagttttggggtggcttttacacaacacacaaccagaataacgtctctgtggcctggggcaaatgcttaacctctcccgacctcggtttcctcgtctgtaaagggaataggattcaaagccttccaaagtgcatttcaggatgtgagggtaatctggctgcaacagctgtcacccccattgatcaccagagttgatttggctgatctggttggctaggcgggtgtccccttcctccctcaccgctccacatgtgtccctcctgaggctgcatacttggtcaaagaggatgaccatccccgagagaggaagaccggtcttccatcaagggtacagaagtagccgcgctcccctgctagaacctccaaacaaactctcaaggtgcaaagtgcatttcagctcaaatagtcaatgcactctttcaacaatagtgaatcagtttcctggttttatcataacacgtaacgccctttctccagtttatcaaaaaattccctaaaaggaccagaatgctttgtcagtccttcttaaacatcaatgtctacatgactcagctggagatcctgttcaatgcaggaggtcacagatggggcctagaaatctgcattttaatgtgatttttcttttttctttgactcaggacagagtctcactttgttgcccaggctggagtgctgtagtggtgccatcatagctcactgcagcctcagcctccctgggttcaagtgaccctcccacctcagccacccaagtagctgggactacaggtgcacacctaccatacctagctaattcaaaaaaaattatttgtagaaacgaggtctcactatgctactgaggctgttcttgaattcctgggctcaagcagtcttcttgcctcagcctcccaaagttctgcgattacaggtgtgtgccaccagcccagattttttgcttttttttttt

SEQ ID NO: 4956 - DNA, 1199 bp, Homo sapiens
ttggaagccacactccatctgtttcacaatcgctgttgttaaacaggtccatcgtattcaaagtgggagcagggatatgcaaaggcagaaataccatgaggggagcatccttgggtgccatcttggggtggctactatggttctctgtgagactttgcttgatattgtgccctcccttggccaccttctcttcctggtcctgcttccctactttccaattagtttttcctaagagcagtttctaccaggggattttcactttcacatgaattcttccccaaagatctgcttctagagaacacagcctaagacataaaatatagatgagcagcccacccattttctgattagccctctggctttctgctggaatgggagcactgctgtgagcctcaccctccttggctgtggccctgacccactccatgggggcttcattctctcctttgtctcaaaagtcattggctagggccccattagaatacagccaccacccagaaccaatgataccctttaccaaacactcagctgacatcaccccatttaacataacttccaactcatcctttatagcagctactattgtctttattctacaggagaggaaactgagatttaggcaaattaagtaacatgtacaagtttgcattgctagcaccagagccatgacttgaacccacatctggaaggtccaaagctcatgaccttcactttcattgtgtttgctttttggtcattctctgcacctgctgccaagctgtgtctgcacgtctgactccccacccccccccaacaaaggatagaatcagatggggatggagctgatgttgaccacaattcttcgcacaaccatccatccaaccctgttttcagggtcctctcccactcctcacccactactcctgacttcctgcccctccatacccacagtggaaactcttagcatgcatctgtgcttcctgcctgaaccagcccaaagctgtggtcaccctggtcagggcagatagatggagtggttaaccccaccctttgccacgttgccacctgggttcaggaagtcaacatccctcatgccaccaggctcctggcctgcctgtagcagatggaaaggtatcttcttggtcaaaagattttgctcccctgaaaatgcacttgagcctaagcaggttggcactggggtttttctttgaggacaaggt

SEQ ID NO: 4957 - DNA, 1179 bp, Homo sapiens
gaaatacaacatcacaggtagtaatcgaaagcctggatgtctctgtttctgatcacactgtttgctctccctctccagaggtaaccatcatcttgcgtttagtatttttcattttcatttatgtttttataccttcccaacatatatattttatgtagccatcaaagatacattgtgttgttttgcaggcttttaaactttatatgaatggcatcgtagagttggaactcagcaactcgctttttcgggcaagagattttgttctgagaattatccatgtggattcacgtagctctatttccttcattttaactactatatagtgctccatcgcacaaatacactgtaatttatttatccattctcctaaagatatttaagttgagtgacaaagactactggttgcttcccaaatactttttccctcctttagtaacagatacgcaaagcaacaatgtgcccagctaaaagcctacatttctttacctcttttgcttccaggtgtggctacacatatattctggtcaccacaatataaacagaactttcaggggaggatatatgagagcgcttctccaaagagggacagactggggcattcgcttttgctcttcctccctccctcgccctcttctgttgattggaatgtggatttgatagctggagctccagcagccacattagaccatgcagtgatgctgaggatgaagcctccctcctcagtacgacagagcaggaagacagaaggaaaccaggtccctggtgactttgtggagccttcatcccagccttggattgattgattgattgattgattgattgattttatttatttttttgagacggagtctcactttgttgcccaggctggagtgcagtggtgtgatcttggctcactgcaacctccacctgctgggttcaagcaattccctgcctcagcctcctgagtagctgggattacaggcacccaccaacacacccagctaatttttgtatttttagtagagatggggtttcaccatgttggccaggctggtctcgaactcctgatctcaatccacctgccttgggctcccaaaggggtgggattacaggcgtgagccactgcaccaggcctcaacttttttttttaacttgagagaataaacctttctagagatacacttccatcactagcag

SEQ ID NO: 4958 - DNA, 1151 bp, Homo sapiens
tctgtaactactgtgcaatatgaggaagtctattagtctctctgagtctgttttctcacctataaaaggagggattagactagatgttcagaattgttctactctgattctctgatcttctatatgttgtcttcctttctgcccttcactagagtctgcatgtgtctcctgtctggggattctgtaactccatatgtcttagcttagaacctaattttcttcattttacttttctcagagtatttacaatgttgaagacaactaagatgcaatgtagtatttctccttaggtgctgccgtctaacacatgatatatttactctagcctaaaaatggttcatgttcaaaattttaggttctgtaaaacaaattggtgccataatttatcagtataagcctgaaatttggagaaataaattttcttaaaatgtgagatgcttatttatatacatggctggaagaaggggcaaggctaacaaatctggaggtaattaatgcagtgagaaacttaaaaagatatgagaaaatggcgatggatgagaatgtttatatttactgtacagtgaccatcagtaatgaaagagattagtagatgtctgtttttgtgcttaacataatgttatgttggtttaattgtcttcattaggggcttttagtaaaacaaagggtctttaaaattaacacagtaatttttcactttaacaggcttaactggcactttattgatatacagacaatgtctagtgaagataacagctatcaattaaatagtccaatttcttgaaaacagatagtcaggtaaatctatttctgatttttggagattaggtagatgaacatgggtaagactatagtttctgcagtgtttttggctttggttcattttcaaaaaaattttttttaaatggataaggctaggctttagagttgtgggttcaaagaatgggctagaccctggggtccatattattacgtagaattagtctttgtgcagtgtttggttgccttttctcctttctataactctccatggtattctagacctaattctttaccttgagggggttggaagctctcaagtgtgtaagcttaattttacaacgatgaatagtctttccaatgagaaaaaaatagagggagataaccacgta

SEQ ID NO: 4959 - DNA, 1197 bp, Homo sapiens
gcccagggaagacaggctttggggagcccccatcacaggctgaggacaacagatgcagctgccccctgagaaacaacagcctccacgtgtgcacctcgggaagaagtgagtcacagtcttctcagtcacacccagcacctgcttaatggccacttcttccagagccagcctttgaatatgaaaaaacaataatcaaatgatcttcttcccaggagttgagtcggtactcctgattagctcagggccaacactaaaactagaaagctggaggctttctgggagccaggctgcgtggtggctgatgtggccacataacattgtgatttttgacccttccttttctaagtcatgctgagaacccttgaagccccctgctgttcttctgttttccattttctccttccagtactcattaaaaaataaataaataaactgaatgtgtaattaagcactatgttttgtgtcctttttatgacaggttcatcaattctacatgcatttactgaatgcttactaaaggcagggctgtattttacatatcattctttgtgaagctactgttttcacttcggttctgcagataggttgggtgttgaagaatttgtagctgaggatagactttgcctctgcagctatccttcctgatcagactagacatatacctgattttttttttctttttttttttgagatggagcctcactctgtcacctgggctagagtgcagtggcacaatctcggctcactgcaacctccacctcctagattcaagcaattctcctgtctcagcctcccgagcagctgggattgcaggcgcctgccaccatgcccagctaattttttgtatttttagtagagacagggtttcaccatgttggccaggctggtttcgaactcctgacctcatgattcgcccgcctcagcttcccaaagtgctgggattacaggcatgagccaccgtgcccggctcacatacctcatttgaccctgtggtgtgaagttgctattcctactgttgttaactgatggcagaacgtaggtttaaggtaaccaacggggctagcatgcttgttgctgaagtatatgaatgcgggaaaaactcctggcctccccactatgcccttggctctggtcagtgctgggtgcagcgtgcctgccatttgcaaagcaaaacctgtaatcccagtccgcatcatt

SEQ ID NO: 4960 - DNA, 1194 bp, Homo sapiens
gccaagcttttgcttcctcccctgcgaaacagagatgatactatttacccagcagagcaaaaaggaagcccacatctaccccagacagagaggggactccatcatatcctgtggactccccttccaaggccctgacttcacaagtgtgtgaccccccgagattcggggcagaaaattctttctcatccatggggtgactaggactggtgagcacagccactctagaaagggagatgggtgtacatgtatttgtagtaggtacgtgaggtacaaggcaattttgttccactgatgtattgcacagtggtgaagccaaagctgggagtgcgtccgtcactggagtgatgtaccctgtacccgttaagtaatttctcatcgcccaccccacacccttgtgagtccccattgtctgtccttccacactctgcatccatgtgcacatgtgacttagcacccacttattagtgagaacaggcagtctttgtctttctgtgtctgagttctctcacataactcagtggcctccggtgccatccaggttgctgcaaaagacacccttttattcttttttgtggccgaatagtatttgaataggaaatgttacctttttttttttgccttttcagctctgggtccccttttcctttgccattcaggtcatcccagccctcatccccatgcttcaattacaagctgcccactgtcaccgtctcatgtcgggcagcacaggtgattacacaaaaccttctagcagagacaggcttgtcaaggcagtttcgttaagaaaagctgtgtttgtattctggcaactatcaggaaacgaaaaggatcttttctcttttgtttatacccatccgtcctaaggatagtattttctcctactccctaagagctcggagggtaagaatgactaccagttttgcaaatcttcaaaacagctcctaaaagagagatgattttcactgtaccacaggaaaaccaagccctggaaagcatggttaagtacagtgccaaaggcactgggccactcaatgaaatgggatccttctctggtgaagtcattgcccagtgtgtggcctgtggaagttactcattaaatactgggtacctaacttacctaggtccacatggtaatggaggcaggacccaaacgcaaatctgtcagccaccaaagcagccacctggctcttgcca

SEQ ID NO: 4961 - DNA, 1116 bp, Homo sapiens
tgggagcaggcgatcctgaccgggtgtcacgccgcctgggagcaaccctgggcctatgcactcttccctccatccctccgaggccgcggtaattatgaaaggaagtacggcccgctcgttctctgtgtggtttgaggagccaggaagaattacattcattcatcctttcctcattcagccagcatctgttaattacctacgaagtacagagatgcgtaagacatgacgtgtgcctgcagagtttctcatcagggaggccatgttagcgacgtgtctcccaaagcccactgggtcaccccattaaagcaaaaaccatgcactgatcatgcccctggggaagctgtgctgcttctcaccttcatggttttgagagcaaatccttttttggtatagaatcgttttgaaactgtttacttttgaagctgacacgtttgatacctttcctaagctgtgacggactgtaaatctctccctttcctccctggttcctctctagaccttcctggtgccccatccaacctggtcatttccaacatcagccctcgctccgccacccttcagttccggccaggctatgacgggaaaacgtccatctccaggtggattgttgaggggcaggtacgtgtgtcgttagactgggagctggcatttgcgaagagcagtgttggggcctgtgaatgagtggtacccctgcagatgatggcttggggtgtcggggagatgggtgtgcttggagagggagaaccaggggctggagatagcccagataccagggcagaatgtaggaagacaaagaacaagatgtcaggccggggtcctaccaggtgataagacaaggataagaagggttaaaatgaaagttgtgattcaaaataggtacccaaaattggatagtgtcgttgattgagtttttaaaaattctatatcacaattagctactaaatatactaataggattaattgcttggtacagcttgtgtgtcattagctatgcattcattcaacaatatttttagagacgattgttctatcagcaggcactattctgagcacgggggctattgcagtagacaaagctggctgagtttctgctgtcgaggagaaaagtgctgtctg

SEQ ID NO: 4962 - DNA, 1148 bp, Homo sapiens
tttaataaatatgtgtcatgccactttggacatgtgtgattctttggccagcctcagtatgcgagcacgtaggctagcgctcagcacatgagtctatggaacccaggggaagcaattgcagtttcgtagtagtttgtgtcttaattaagggagcccctagaccttactctttcactttacctaggagtttggttcctaaactcaccattcaaatccagcaacagaactgactgaaaggaacctttgtctttcgtgtgaatgctcgtgaggggccatccttagagtggaaatgctcctgaggctccagcgaatcaagaccctcagacccccgggctgtccccaccccatgaccacatgttccgcaggcaccctcagcgctgtgccctgcgtgtcgcccaggcaggtgtttgtttttgagcgcagattctgcctgtggccatagccatgtggagatgttcacgcatgtacttccctttgtgatttcagccgatacggaagatgtgtgcattgtagagagattgttctccagcagcctagtggccatcgtcagccttaaagcaccaaggaagctaaaggtttgccactttaagaagggaactgagatctgcaactacagctactccaacacgattctggctgtgaagctcaacaggcaggtgagcgctgccccagctgggtgtgggcttgtctgttgctccctccagcactctgggacaagcccaccccaccggcatgcccctccgtcattcccttgctgcctggccccacgttgccgggcacagatccttgcctacagagaccagctctgtttcctcacccaccagctttgctcagcccattccattcacgacaaatgcccgggcctctgccacactgctcccatacaggcgtccccggccccacccagagggtggatggcagtctctttcacctattacctggttttgcttttataaatgttacttaaaaaaaatatatttggccgagcacagtggctcacgcctgtaatccccacactttgggaggccgaggcgggcagattgcctgaggtcaggaatttgagatcagcctggccaacatgatgaaaccccgtctctactaaaaatacaaaaattagccgggcatggtggcaggcacctgtaatcccg

SEQ ID NO: 4963 - DNA, 1323 bp, Homo sapiens
ggccaatgggctcccctccggcggcagcactaagacccatgcatgagatcctccagccacagccttggctatgtgagccaccttcttaaaaaagccaactcgcactccagtgggagagcctgtggttttgcacccacgcagggctgtgcctgctcgctgccactcccatctgtgaaccggcacttccagttcatgagcccaccctgagagtctcctagtgtcattttttttcctggtgttatttttgagctcttaaccagcttgagagagtttgtggcccgtccatgagggagcctctgtttactgtgcaggcatcattttgacatttatgaatgtcagagaacaaatgacttcatctcgagctgcctaaggctgcaaagagttcattagaaagcaatcagaattcagaacgtcttagtacaggcttcagtttataaatatacaccagtgtttccaaaacacagtcctcagtgtgtgtcatggggtctgtggtgtgtccccagcctttgaagggtgacttcgtcgtctctttgcagcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggccccacctggaccattttccctccgttttattttgttaattaaattctttccaaattggatcgctctgggatttcttccatggtggacttttgtttctgatcttgttttccctgtggatattggaggacagcgaggttctttctgatactaaaaac

SEQ ID NO: 4964 - DNA, 1088 bp, Homo sapiens
tgctggagcatcagcagccctgcccagtgggtcagccctgtcctggggcctggggtcgggtgcagcagcccccgggctcacccaagcccctcctctctcccccacacagcactgggaccagaagtccagccgcagcctcccggcggccctgcgggtctccagccagaggaaggacttcatggaggtaggtggtggtggtggtggtggtgggcgggttggggatggctgcttccttccgggcagctcagacagggcccggctcagcatctgctgctctgtcccccatggtctccctcagcctctgacctcctgtccctgccactctcagtgcctggctcctgttctctgtctctctggtctgtgcgtctgtctctgggtcttctctgctctcccagtgtctgtctctgagtctctggccattcttgccctctgactctctctgggtctctcccaacctctatctttcagtctctgtgtctctctgggtctctctcgatctcggtctctgtctctctgcgtctttggatctcttggtctgtctatccttgtctctcatttgctctccatctctcggtctctgtctctcttttgttggtctgtctcttactcagcctctgtctctgacttggtctctgtctcagtccctggggctccctctgcttctgtctctgtccctgtggctccctggggctccctcggcctctgtgccccccacctgccatcctgatatccccgcgtgcccgcagcgcgcgctataccagtcctcgcatgtggacgaaaatgacgtgcagacggtgtcgcacaagtgcctggtggtgggcctggagcagtatgagcagatgctgaagaccaagaagtaccaggacagcgagggcctgtactacctcgcgggcacctacgagcccaccacgggcatgatcttctccacggacggcgtgcccgtgctctgctgagcccgccgggccctgcgggccacctgtgccccgagggcggccagggacccatctccatcactgccatggcgcggagaccacgtgcgttgtgtgcatgcgagcgctcctgcaggcgtgtgcatggggccaggtgtg

SEQ ID NO: 4965 - DNA, 1135 bp, Homo sapiens
cgagggtgtcacgtcacccaaaagcaagaaggctaaagaggccctgctgctccgggaggatccgggggcggggggctggcaggagcccaagagcctcctgagcctgggcagctatccccccgcggccggcagcagcgagcccaaggcaccctggcccaaggccaccgacggggacctcgcccaggagcccgggccggggctcacgttcgaggactctgggaaccccaagagcccagacaaggcccaggctgagcaggacggggccgaagagtccgagagcagcagcagcagcagtagtggcagcagtagcagcagcagcagcagcagcagcagcggctcggagacagaaggggaggaggaaggcgacaagaacggggacgggggctgcggcaccgggggccgtaactgcagcgctgccagctccagggcggcctcaccggcctcctcctcctcctcctcatcctcctcctcctcctcctcctcctcctcatcctcctcttcctcctcctcctcttcctcctcctcctcttcctcttcgtcttcctcctcttcctcctcctcctcttcctcgtcctcatcctcctcctcctcctcctcttcctcctcttcttcctccaccacagacgaggactcttcctgcagctcggacgatgaggcagcccccgcccccacggctggcccttccgcgcaggcggcgctccccaccaaggccaccaagcaggccggcaaggcgcggccctcggcccactccccaggcaagaagacgcccgcgccccagccccaggcgcctcctccgcagcccacacagcctctgcagcccaaggctcaggccggggccaagagccgacccaagaagagagagggcgtccacctccccaccaccaaggagctggccaagcggcagcgcctgccgtccgtggagaaccggcccaagatcgccgccttcctgccagcccggcagctctggaagtggttcggcaagcccacccaggtgagcaagctcgcgcccgggcacggccgaggggccgggggccttgtgtctctctgctgggcccacggcttcatgctgtgtctccgtgtgtggtaacctcccagaaccccagggtggagggctggcgtcccactttatggatgg

SEQ ID NO: 4966 - DNA, 1135 bp, Homo sapiens
cagaggcaggtgaaggattggagcccaggctgggcagagcatgtgcactgaaacccactatactgttttgtcagatcttttaacccatgacccaccttccctctccagctaaagattaagaagaagaagatggccagcgaccaggagcagttggcaagcaagctcgacaaggccctctccctcaccaagcaggacaagttgaagtcgcccttcaagttttcggacagtgctggggggaaatcgaaaactagcgggggctgcggcaggtacttgactccttacgacagcctgctggggaagaacaggaaggcgctggccaagggcctcggcctgtctctgaaatcctccagagaaggtaaacacaaaagggcagccaaaaccaggaagatggaggtggggttcaaggccagaggccagcccaagtcggcccattccccgtttgcctcggaagtgagcagctactcttacagtaagtagcgtatgccgcgccacctctggtccgctgcttctctccttttctcccctcttctctccaccgtcctccttccccccccgcccctcactctctctctcgctctcgctctctctctggggcgcactacagtgcctgagcttggcatggcctccaagccggaagtggggggggaggccgcctgaagcggatatgcctgtgactggcgggtgtgatgccaggcaggtgcttgtgattggtgggcgcccgtgattggcggttgggagccgacctccgccggccctgtcttgcccgcccgccatttgcctaccggatgtcataggcgaggaagccttgtgcgtcatagagtttgcggctgtttggcctagagaggcctggagcgcgactgctcttgagggtcctagaggtgaccggactcccctacccacaggaagcatgccgtctgttgcggaccacggctttgtcgcgaagtgttggcggaagcagtgtttatggagcgcccaccgtgctcggctatggatgcaggggttcattggcgttactgtgtctgtggcagctctgacagtggtacccccatgttgttactggggatgatgtggcccgagagccagaggggagtgtgtgcgctcgggtgcggagaggcgactcggggttaaacctggt

SEQ ID NO: 4967 - DNA, 1170 bp, Homo sapiens
gctgtgggaggtgattctctggctggagggtgggtgtcctctctgggcctgcagagctcagcatatgagccccccgcctgtaagtcccccaccgccttgccctgtggcctctggaagtcccagtgcgccaccgacttcaggattccacctgcagatggggagaatggtgccgggccggatctgggctggttgggcggcaggggtggaaggccctcctccgagggtgcggggtgcccagggctgagggtctgctgtggggggcttcctgccgtattgtgctttctcaagccctgggtctggttgggttgatccaggaccatcttgcagcccaggggtggggccggagcaggggaaccctctttggtctcctggccagcatcagctccacacagctggggagaggcggcggtctcggggcggtgggtcggggcggtgggctggggcggcggcgcctccctggttgtctgcctgacggtcctcccaacttctctctgcaggcgaggccttcttgggcagctttgtggccagcgggatggggccctcggcctcgtcccatgggagcccagtgccactgccctctgacctgtctttccgctccccaacccctagcaacctgcccatggtgcagctgtgggccgcccacgcccatgaaggtaaggaacatgccggggtcggggctgagggctgctgggctgacgtcccagccactctggccacttcatgtgcccctctgttgtcatcgctgagctggggctggtgggtcccaggtcacctggcttccctgttgtttctcaaacgctcagggcttcttcttgtcactgtcacagggcatttgtatgagctgtttcctctcctttcagcctgacaccccatgccacagaccaccttccagtcctcctccggctcagctcagagaccccctcttccgcacccacttccatcacttgcttgtgacgacagattatctcatcattcatgaactacccgctttcccaccggagtgagccctgagttcagggcctagtgtgatctactcagcactgtatccctggtacacagtaggctcattaataattacaggagcaggccgggcatggtggctcacagctgtaatcccaacagtttgggaggtggaggtgggaagatcacctgagggcaggagttcgagac

SEQ ID NO: 4968 - DNA, 1189 bp, Homo sapiens
gtaagccaccatgcccagccgaaaattcattttctggaattaatgtcttttttttttttttttttttttcatttggaatttcttagaatatctggcttccagtttctctctctcttttttattaagacgctgggtctcgctctgttacgcaggctggagtgtggtggcattctcgtggctcactacagcctcaacctcctgggctcaaatgagcctcccacttcagtgcctcctaagtagctaggactacaggtgcgttccaccacacctggctaactgttaaattttttttagacatggggtctctcgctatgttgcccaggctggtcttgaactcctgagctcaaataatcctcttgcctggacttccctaagtgctgagattataggtgtgagttaccatgcccagccagccttctggtcccttgatgcatttttttcacttgtcatatctattggatgagctgctttgttttttttggagatttccttcctggaattttccatcttccttctctagtctggttggcccggttcttgggtgtgctggagagccattgttcttcagactccctttgcctctctcctgtgtgtctgattcccttgccttcccgtttcctgttttactcccttctttctgtagagcacatcctgcggtggctttctgtgaaagggtgagaggaaggcaacgtttttgggtcctagtatgcctggaaaatgcttttgttctaccttcacacttgagtgctatttgggaaatactttccctctaggaattttttttttttttttttttttgacagagtcttgctctgtcacccaggctggagtgtgatggtgtcatcttggctcactgcaacctctgcctcccgggttcaggtgattctcctgcctcagcctcctgagtagctgggattacaggtgtgagtcaccacacacggccttccctctaggattttgaaagaattgcaacatcaccttccatattcgactgctacttttcaggaatatgatgccatttttgattgctgatctttgtgtatgaacctttccccacctcccccttccttttcttttttcttttttttttttttttttgagatggagtctcactctgtagcccaagcgggagtgcagtggcacgatctcagctcattgcaacctccacctcctgggttcaagcgattct

SEQ ID NO: 4969 - DNA, 1181 bp, Homo sapiens
gcctcagtactaccagggactgggtgggggagaaagtggaggcagggcttagatgagtgagctggtgtctctgtgagtccttagctggtggggtgggttgcgggtacatgaagtcatgctccagcctaaggggcacgtgggcacgtgtcattgtccccagaatagttagcattcaccttgtgcctttgctgagagccatgcactgagcccatcctccctgccataatctgctgcgattgcagccttgatcattcccatttcccagatgaggctgtgggagctcagggggagctgagtctctcgcaaacaccggtgcttgaccttggccctggagccatgcagagtagagataagggcgccccttgtaaatctcccctctcccgcagaaggcatggcaggaagtggccgggtctgctcgggagcagccgagctggaggctcacaccctggagtcccccggccatgcagccagcttggcgccaccctccctctcgacctcctcccactgcagacctgttagtgttgggttgagaagcgcaggatcaaacccaggactttcaaatggcagagcagattgctagaagcctctgtatttcctgtctggtggagtcaccaggccctggatcggccgctttgattctcagctcgagccactgcgaggctccgtgcgtggggagcggggtggttattcatgctctgacccaggcatcctggagaaccaggacgggcgactgctttgagaaccagacgggcgacttttcagaatctccctgctttagaaatttgacgcaaaatgcatgtaaaatttgggctttcccactttttttttttaaaaatggtctcattctgtctcccagaccggagtgcagtggcatgatcacagctcactgcagcctcgaccttctctggctcaggtgatcctcccacctcagcctcccgagtagctgggactataggcacatgcgaccatgcccggctagtttttttttttttttttttttgagacagagtctcactctgtcacccaggcttgagtacaatggcatgatctcagctcactgcaacctctgcctcctggattcaagcgattctcctgtctcagcctccagagtagctgggattacaggtgcccaccaccatactcggctaattttttttttgtatttttagtagagacggggt

SEQ ID NO: 4970 - DNA, 1197 bp, Homo sapiens
agtagctgggataaaaggcgcacaccaccatgcctgactagtttttgtattttcagttgagatcgggcttcaccatgttggccaggctggtctcgaactcctgacctcaggtgatccatctgccttggcttccccaagtgctgggatgacaggcatgagccaccgtgcccacctgccaaaccgttttctaccgtggctgcacccctctaccagtcccacttagctggggactcttggctccaggtcagagtgcgggcaggtaggcagcgagaggtggggagcttccctcccggtggagcagctgctgcaagggggagtgtgcgcactgagggttggagacccgtaggtgccttcagccctttccttcctctccccaccctgcctctgtcccgcaggcgagcgaggacaaagtgaggcagctggtgaaggagatcggccgggagatccagcagctgagcatggctggctgctactggctgcctggctccaccgtggaacacgtggcccgctgccgcagcctggtgaaggtgaacctctcgggctgccacctcacttccctgcgcctctccaagatgctctcggccctgcagcacctgcgctcgctggccatcgacgtgagccccggcttcgacgccagccagctgagcagcgagtgcaaggccaccctgagccgcgtgcgggagctcaagcagacgctgttcactccctcctacggcgtggtgccctgctgcaccagcctagagaagctgctgctctacttcgagattctggaccgcacgcgcgagggcgccatcctctcgggccagcttatggtgggccagagcaacgtgccgcactaccagaacctgcgggtcttctatgcgcgcctggcccccggctacatcaaccaggaggtggtgcggctctacctggctgtgcttagcgaccgcactcctcagaacctccacgccttcctcatctccgtccctggcagcttcgcggagagcggcgccaccaagaacctcctggactccatggcgcgcaatgtcgtgctggatgccctgcagctgcccaagtcctggctgaacggctcttccctcctgcagcacatgaaattcaacaacccgttctacttcagtttcagccgctgtaccctgtcaggcggccatctgatccagcaggtcatcaacggcgggaaggacctgcggagcctggcca

SEQ ID NO: 4971 - DNA, 1290 bp, Homo sapiens
tgagcggttccgctgccctgaggcactcttccagccttccttcctgggtgagtggagactgtctcccggctctgcctgacatgagggttacccctcggggctgtgctgtggaagctaagtcctgccctcatttccctctcaggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaaggtgggtgtctttcctgcctgagctgacctgggcaggtcggctgtggggtcctgtggtgtgtggggagctgtcacatccagggtcctcactgcctgtccccttccctcctcagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttgttttggttttttttttttttttggcttgactcaggatttaaaaactggaacggtgaaggtgacagcagtcggttggagcgagcatcccccaaagttcacaatgtggccgaggactttgattgcacattgttgtttttttaatagtcattccaaatatgagatgcgttgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacaccttaaaaatgaggccaagtgtgactttgtggtgtggctgggttgggggcagcagagggtgaaccctgcaggagggtgaaccctgcaaaagggtggggcagtgggggccaacttgtccttac

SEQ ID NO: 4972 - DNA, 1171 bp, Homo sapiens
ccatgattgtacaagtgtactccagcctgaacaacagagcaagaccctatctcaaaaaaaaaaaaaaaaaaaaaaagaaagaaagaaaatgaaggtttcagatgtggacatggcaagtcagctgcattgttcaccaaactttagttcttctcaaaaaatacactcaagggagtgacattacaaaaacatgacagtgtagggaattccaaaaactcctatctcccaccagagcaagaattaacctggcaaaaactgccagaggcaactttttccctttttttttttcacctttcacaacttcctcagggctgaaacagcctcccagtggattgtgttgaaagcatttggaggcatgtaccagctgcagctgcctgaggcaatgagtaacacatgggcaagccaagacagatctagaagactacgtacatgtctagggctcaacacatgctcagaaaaacccaagaccctaggctttcacctcacactgagctttaggttctgtattaacaggaactcaaaaactaagaaagttacagatgacctggctgagtcaactcagagtactccaactgcaaagatcaggatgggaggattggttctttcattttttttttttcctggcattgaccactaagctaatacaacagagacttcagtgaccacacataacaaggaatagtctttacaaaaataactttcttttttttttttttaagatggagtctcgctctgtcgccaggctggagtgcagtggtgcaatcttggctcactgcaacctccgcctcccaggttcaagcgattctcctgcctcagcctcctgagtggctgggactacagttgtgtgccaccacacccagctaattttttgtatttttagcatagatggggtttcaccgtgttagccaggatagtctcgatctccggacctcattatctgcccgcctctgcctcccaaggtgctgggattacaggtgtgagccacggcacctggccccctttttttttccttttgttttgttttgttttgttttgggatggagtctcgccttgtcaccccgtctggagtgcagtggcaatgatgcgatctcagctcactgcaacctccacctctgggcccaagcgattctcatgcctcagcctcacgagttgctgggactacaagcatgcacca

SEQ ID NO: 4973 - DNA, 1222 bp, Homo sapiens
agcctcacagcccaaagactccagaaccaagaaggagccctctaggacagaaaaggggtatgctgtcttctagcacttcaggtgccatctctgacaaaggcgtcctgagacctcagaaagaggcagtgagttccagtcacggacccagtgaccctacggacagagcggaggtggagaaggactcggggcacggcagcacttccgtggattctgaggggttcagcatcccagacacgggcagtcactgcagcagcgagtatgcggccagctccccaggggacaggggctcgcaggaacatgtggactctcaggagaaagcgcctaaaactgacgactctttttcagatgtggactgccattcaaaccaggaagataccggatgtaaatttcgagttttgcctcagccaactaatctcgcaaccccaaacacaaagcgttttaaaaaagaagaaattctttccagttctgacatttgtcaaaagttagtaaatactcaggacatgtcagcctctcaggttgatgtagctgtgaaaattaataagaaagttgtgcccctggacttttctatgagttctttagctaaacgaataaagcagttacatcatgaagcacagcaaagtgaaggggaacagaattacaggaagtttagggcaaagatttgtcctggagaaaatcaagcagccgaagatgaactaagaaaagagataaggtaaagttttaattttttactttttctctttttatctaaaatttttatttttattttttatttttttgagacagagtcttgctctgttgcgcaggctggaatgcagtggcatgatcttggctcactgcagcctccacctcccgggttcaagcgtttctcctgcctcagcctcctgagtagctgggattacaggtgcacgccaccatgcctggctaatttttatatttttggtggaaacagggtttcaccatgttggctgggctggtctcgaactcctgacttcaggtgatccagccaccttggcctcccaaagtgctgggattacaggtgtgagccaccacacccggccaggtaaagttttttcttaagagtattttgaggctaggtgtggtggctcacacctgtaatcccagtactttgggaggccaagccaaggagggaggatcacttgagcccaggagttcaagaccagcctggacaacatagggagacctcgtctctacaataaaattg

SEQ ID NO: 4974 - DNA, 1202 bp, Homo sapiens
cggcatctcccgtttttttgtggcataacagttgaccaaaataggttcaggtctccttgagacaggttttgaaaatgctttttaaaatttttttcctggaaaacaaatgaccaaagtcattgctgtacccacaaaaggtaaatatgtttcgattagtctttgcagacacctgattcttacactgacattcgagtctgggcgtgagacgtgagcgctaagacccttctggggtagctgggaactaggccagggttcacctgggcgcccctgaaacccagccgccggtagacgagcccaccagagcgcatgcgccgggggtacgccggggccggacacgcccaactcttcttgtctgataaagggcggagtctgctacagccccgcccccagtgaaggtgcgcgcgtggcggaggctggttttccgtctggtgaggggttacttccgggtcggacggcgctagctgcagcatcggagtgtggcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacggtgagggatcggatcgcggcgtcgccgctctgctctctctgtccacctgcgtttctgggcggcaaaggcagccctgaggtttgcctgaggacctgggcgactttggctgcctccagggttgaaccggcggcccagccgcgcagtgcgagggggggcggcgggcgggccgtcgggtaaggtaaatatttattgaaaagaacgtctgcctctccctcctttgtttacatttctgttccttggtttcctctctggggactgaggccttcggatggctggggacatccccgaggccaccgtcttgcccccatgccctgggttttgtcattggttgagaacgatcttctttcattactgcaaggagactttgcaaactatacgctgaatagtttgggttaagagttgtaatttgtagctcttcttgtcttttgcttcattggagcttttcttgtcttttgcttcattggaaggagaactaaagatttcttatagtgaggcagcgtggaaataaataaacgtctttggtttaataaaaaggcccaagtttttttttgaag

SEQ ID NO: 4975 - DNA, 1208 bp, Homo sapiens
ttcccctgcctcagcctcccgagtagctgggactacaggctcccaccactacacctggctaatttaaaaaaaatttttttttagtagaggcagggtttcaccacgttagccaggatgacagtgctcataataataataataattattattattatttttttgagacagagtcttgctctgtcacccaggctggagtacagtggcgcgatctccgctcactgcaagctccgcctcccggttcacaccattctcctgcctcagcctcccgagtagctgggactacaggcgcccgccaccaggcccagccaattttttgtattttcgtagagatggggtttcaccgtgttagccaggatggtctcaatctcctgacctcctgatctaccctccttggcctcccaaagtgctgggatttcaggggtgagccactgtgcctggccagcactcatttttttttttgggacagagtcttgctgtgtcgcccaggctggagtgcagtggcacgatctcagctcactgcaagctgcacctcctgggttcatgccattcccctgcctcagcctcccgagtagctgggactgtaggttcccaccaccacacctggctaattttttgaattttttttttttttttttttagtagagacagggtttcaccatgttaggcaggatgacagctttcataatttttttttttttttttttgagatggagtctcactctgtcgcccaggctggagtgcagtggcgccatctcggctcactgccagctccgcctcccgggttcacgccattctcctgcctcagcctcccgagtagctgggactataggtgcccaccaccacgcccggctaattttttgtatttttagtagagacagggttttaccgtgttagccaggatggtctcgatctcctgacctcgtgatccgcccgcctcggcctcccaaagtgctgggaataatcccaccatgcccagccagcactcataattttttaagtcattgtcaacctgccctccttcgagtctgttatcctgaattccctccctggcaatgttggggaagctgtgggtggtctgtatttgcccttcagccaactccaggtgcagcacggcctccgtgcttcagccgactccaggtatggcacggcctctgcccttctactgaagtgtacttacccatgttggggctgtgtctgtacacacatgc

SEQ ID NO: 4976 - DNA, 2169 bp, Homo sapiens
gggagccggcagaaggcgcccgggccccaggagctgcctcccgctggtggtgtgatcagaagagagtggggtcgagtgtacattgccgtgtggtcgtgtttcctgtaggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcatacgactggtaatactggtgtttttgagacttgatgaacaagttcctggtgtgtgtttgtttgccttgctttaaagtcctgggttgttggagacagtcattttcaatgcgtgtctccacacaggagggacagggagtgccacctccaggggagaactgggtgagcccaaatacggcaggagtggaggtgacattcatgtttggacctgtcgaacagtggcgaagctctgagggagaagcgcctatcggggtgtgtgtgcacatcctggcccagagctaggggctgaagatggagatgttgggaccctagactggccctggaagagtagaggttggtgaaccacatgcccttaagatcctttccagaggctgagtgcgtggcttacgcctctaagcccgacgctttgggagg

SEQ ID NO: 4977 - DNA, 1243 bp, Homo sapiens
cagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaaggatgtagtattttggctttctgcattacaacgtcttctggaggaagggagcaggatgggtttcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggagagcacaacgcatggaaaggtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcgttggaaaccaaggccttgtatgccacgccttatgaagcactgtttcacagttactttcacttcccgaataaaggttaccaggtaattaatatttttattgaggtgtttgtgtgtttttcaatgtaagcatcatgagaaataaagcaaagttcagatatttgcccagtaatggatataggaaaagctgctttccagccaggcctggtggctcatgcctataatcacagtactttgggaggc

SEQ ID NO: 4978 - DNA, 1197 bp, Homo sapiens
aaaattctttttcaccccattcaataaatatttaagcacctgtgatatgccagccatggtactcagggaggaagacagaatacagttattgttaaaaaggtagacagtgtccatgccctcccagacctctcagtctataggggacaaaggtagttacaaaacccagtagggtctgtcctgtgactgtgaagggggacgctgtgggccaagtggatactcttgccatttcttaaataatatggttctttttgagatggttcatccagtactcttagcccttcaaagagagatttttctggacatacaaatttaagaatctagttagtgagtggattttgcagaaaataagtaaagtctctctgccactttaagaaagaaaagcagaagatgccattttaagttcactgctttttaaagttgagcatttgactgcaaagtttgtgaaaggtcaattgctttagcatgtaggtgtccctatcagggcccatgtttgtctattctgagattcactgcgaagttgaacctctttcttggctgaatcagttgctcattgggtggttctagaactaaaatgattgctaaagactggtagattctcctgtgaagaatagtaaacctgttttaaagtgaaagattgttagaacttagagtactgttcttccgattgcttagagagctttgtgtacctccctgtttatttgaactagtctttgagtggattggcaatgaagaataatattcgtattctaacacgcacataatatatgaaaggagatgaagtatactacctatagttgtcttatttattattacctaacattttattgtgctgtttatttggatagagttcaaacttgttcgtgaatatggacctagtaggctggaaataaacttaagacccagtaaaaaagagttgtaacaaaagagttgctatgttttctgcagtgaggattccttatcactttgtgattcttagataaaatcctttccatccaggaaaaattatacttccagaatttaccaaactgacagaacaactaacatgccccaggccaagtaatgtcagttctgtaatcccctaaagccattccttcccataattgcaaaaactaacagggaacccccacaccctggcccctgcacccttgcctgccatgctatatgtttaaaattgacatttgcttgcaagagtaaact

SEQ ID NO: 4979 - DNA, 1216 bp, Homo sapiens
tgctgaaccaaaaagaaaatgtattgagaggatggtaaatgagttccattttggttaactggttgtgagattgccttcagggcctcccagtgaatagtggtttctgtagttcacaggtcttcacttacatcataagtttcaaacagtgcatgttctttaatatataatagctctttttcctaaatatgtataatcaattttattatgagaaagtataatcatgtcactctcctgccagggtcttttgcaggagacattgtaacatagaagttaagagtagcactggctttgggaccataggaatgcatttgaatcctgggaagttttggacataaaacctgcattaattctcaaagatttaatgaatggtagctgctgctataaaaatagtcacctttattatcacctgttagtttccctaatcctttcaggaaaaaaatatcaattatttaatacacagcttagtcaaaacctccttccctagcctagtttgtgtcaattatctaataagatgaattctgaccatttcttagacagattagaccttttcctaagtttgcctttgttggtatattttcctctgtgcccttttgttcctacataccagatatctgcctgcataacactaatttctttatattcatcctcttgtttttttaatatgtaaaatgagaacattggttcagatcatctctaaagctaaggtttttttcctaatagttaaaaaatatttcttagtaaaatagggtaataataccttcctcatatcattgaggttacatgagatacagcaaaatgcttagcacaacttattggcacatggcaaacaattagtggtgatgaatgttgcttaatagtgatttttttaaaatctctttagaagttatatagaatgggtttcagaattatttaagacatttctctgttttctacaagatcacctcagtttgagaattaaagccccatgacatcagtttcataatatctaccatatttagctgagaggcattactttgtgattaagatcaagttgatgttactactccctggaaaactgtgtagctctctgttatgcaatacaaggtttctagttctcaaatcaaataccatctttataaagagaaaattaaaatagcacctatcccttttatatatgtaactatgcacacatgggtgtgttagaattgggagttgaggtttatgtatttcaactgag

SEQ ID NO: 4980 - DNA, 1196 bp, Homo sapiens
ttgtcttcctcaagcagtttaggtgcatgatcttcatttacatagaatacttgggtctcagaattgatgcaacataagcaggtttttttggtgacttacaagagcaatagtttgaagctatctcatttaagcctctcataatgcataatcatgagtagttttgaaatttgcaacctgtgaggtagagcataaactcaagaaaatagccttgaacttgcagacttttgacacaagttctccacaaagtgtgaagagagccccaggcattcctgattggtcaatgggagagcctaactttcattgttttcttcagtacaaagagtatccaaaagctaagtttttgtattccactactttcagttcaataaaacctagagttgtttcatctgcgcctaaagtgtatggcacaattttcttaagaattaggggaaccaggtgcctacagttaaaggaacgtttcagttcctttcattcattcctgggtttttcttttattttctaagaaggttgaagaaggatgagtgatagagaagaaagcaacaccattgatttttttttttaagaaatgatatatatatgtatatgtttgtgtgtgtgtgtgtgtgtgtgtgtgtgtgtattctgtgcattattttgtcatgatctcaattctcttctttccaccaaagtttgtcgtaatattttctcctgaaggtgcattctggctcctttaaattagtcagtgttatattgtaggagactgtcatggaaaaaaggactcagtttactttcgtcattttcacaggggaaccttttaaaacaatcttttcagcagcagatacctttaaccctaataatctcaggccttgatgaaaatactatattttgtagattatggttaaagggggaaaattactagttccgtaagataaatatgagctccatttgacttctgatgtctggtttagcattacataatatgttgatcttacactctgcttttgtccaaataaaatgcaatagtatcaatatcaatttcagaaaaatggactgaatatgcttttttggtgatgaaatctcatgtacgatatttatagtgatgtgcttttattttctcatgagatactaaatattaattgtgttgtacatttgttcttagcatatattaaagttttgaaccaaatgtgttaaagcttacgctttgccatgtaaatttc

SEQ ID NO: 4981 - DNA, 1216 bp, Homo sapiens
ctccttcatcttttctctagctctgagctgtcaaacagcccatggtgggaaaatgaagactttaacatttaaatttaaaggaaggggtgtgtgtatgtgtgtgtgtagataggagggagtgtatttgaagctatatattacctgatttttctgtaaatctatcatattcctttaaaaaagtcttttttaaaaagttaaaggactgtgagtagaaaaattaatatttttcttttaaaatcttttgttaattataaaaatttatatacaaaaatataaaaagtaattttaaatcacctataatcttacactatctcaatgtatttacttctattcagacattttgatgattctgttcaaaacatttaaaaaactttagccatgtatataatttgaaagctgaaaatatcagaatattttgggaacagttttctattaaaacatttcttgatccattcttttcctttcccattcctatggcttccttgagacctttcgcagtgtctagcctctgttttctgccatgttattctgttcaccttagcttctttgctgttttctcttgccgcctttctctgttcctcacttctgattatctctcccttggatccctctctgtctgccttgcctctcctcatttttattgctagtgtataattgggttctacagctctactatgtctcacttcccccaaccttctggctcgtttcctcacctgataaaatggccagaacttgaactccagttcttgtggaaagtgcaccattgtcctcactaatatccagagcagggcatatgttgtcttccttctttaatccccactgcacccggctgttctttacttctttctctaaataccattattccaaggctgtcttggacatttactgaacaatttagggtaacagaggccttacacacagaacagtgtaagatttaaaattaaatgctttgtattcttgttcataaaagttacttggccatccttgccactaagaatgtttcctttttgccttagaccaggttttataaaaagcagtgatcagtgacttaagataaatgtctttagacttaaaatgatgcttcattgtatgtcacgaagagattagattctaaggaaggaattagaaaattaagtaaattttgtgctataatttttaaaagttcatttcaaaaatgcttttctattagtaaaaatcagggaagagaggtttaatt

SEQ ID NO: 4982 - DNA, 1180 bp, Homo sapiens
tacacattggggaaaaacgatgtgagaacacagcaaatggtggctgtttgcaagtgaggaaggaggcctcaccagagtccgaccatgctggcaccctgatctcgggcttctcagtctccaggctgtgagaaaatagatttctgttgtgtgagccacccagtctatggtaacagactaatacaggaagtaataaacatcttttgaggtaggaaacatgaatctgaggatcactactttggagtcttactgttgtgtcagttgttaacagtacctgataagatccttttcactgaggttcaagtgcaggttttttggtgtcttttccagaagattacattttcagattatagatcatttagaggtgggtgttttagaaatgttcttatctgttgatctagagctagagatatcctgagtccgtgtagtactagtcatatctgtttgtaattgagtggaatttaagactgttaatgaaatttccaaatgcctaaggtagcctgttattaatcaatcaggagagatgatataggtgtcccagatggcttggcccatagaaacattgaagctaacaataatactttaggccatggaagtttgagggttcctgagaactttcataattttagttttataatgccatagttcccttaattcttcttcaggactcttgataaaaaaagatggtgaaatttcttgataaaagacaaaacctgcttttcagcattccttaacaagaatgctggaaaaacaaatgtctctgtcagtagaaaggcagaaattcctcaggttgaaaaacaaaaccaagcatttttggggtcataattaatggccatgcattccactgtatgactataaaacacattgatgatccatctatcagttgatggatatttgagttatttctgctctttggctactgaaataatattgctgtgcacattcatgcacaagttgcttctaataagttagattttcacatatggttatataactagtagttgaatagctgggttatatggtttctacatgtttaatattttggtgaactgccaaatttctaagtgtctgtaccattttagaacctcatcagcaatttatgaggatttcagcttctccacatgctcatcaacacttcttattgtctgccttttgattttagccaccctagtgaatatgaagt

SEQ ID NO: 4983 - DNA, 1236 bp, Homo sapiens
ttcaaatatatattaaagccctttaacagagaaacattgtagaaacaggtgtattttaattatagggactacatttttatttaaggacatggatcttttctgtttttcaatatttatgctttaaggtttactaaaatgtattttaatgccacagtaacgtttatggtattaataacctgaatctcttaaagggaggcaaaaaaacccctcaacataatagacttgaatttagggtaaactctctattagtatgagtagtagctctttgggcagcatggtggagtagagacacccttggaattcaataagtattctgtattctttgtttgagaatcccacctctttgtccaagtaagcagacatggagattgactaacaccacaacaatgaacaatccattgtagtttatgactatacaagcctccagaatacaataagcttaggccccaggtacccaattttacacttaagaagaagtgatttaggatgtgagggcaatctggctgcgacatctgtcgccccactgattaccagggttgattcggctgatctggctggctaggcgggtgtcctcttcctccctcagccctccatgtgtgtacctcctgaagcggactggtcttcagtcaagggtagacgagtagctgtgctcccctgctagaacctccaaacaagctctcaagaaggagtgatttagactcatcaatttataaaatactttgctgtacaagttgggtaagctgagtgagatcatctatgatctatcattaatcattgttaacaccagttttcaagctctctagtcaaattacattttgttttcatgctaggagtaaattatttcagcatttttctaatgttaaacaattatctatttacatgagatttaaaaaataatcatttgcatccttttggtaaattataagctaaattaactatgtcatacatgtagaaagagacagtatggcaagattcatgagcaaacaacataactcctttgagaaaatggagaatggcatatttagaatcagtgtttacccagcaatactgcttgaattgttaaggataatctatcgatattgcgtgacacttacatgttgtaacaattattaaaatgagacaattgtgttagggaaagtaatgaatgtaaagtggaataactgcactctgcaggagttaaatgtattaagattgtgcaaggaacacttaaatgacaaattgacatacagatgaaca

SEQ ID NO: 4984 - DNA, 1122 bp, Homo sapiens
tatgaatctaggtgtatttgtgcttattgctgtccctctccctttctctctctctctctctggcaccacaggtccatattacatctccttcctattcaagtccccagttgagctgactggagttattttctaccaattacaagtgtcagggagagatagtaaaatgctcaattttgtcatctgcgacccaaacatctgtgttttagtcagcctccaggtaattcagatacatgctagagtgtgagaaaccttgggccagagcaattatccaggaaggaggcttctgagagttgttggcagccaacattgactgctacagctcggagatgagtgcaccatgggtgcagtcaatggaagacatcaatggcttccactacaggtgctaagtgccagctcctctctttttatattcacttagaaaattttactctaggacacaaaaaattctaagagcagaggagacaagtgtcctctaatgtgtcctaaaattgataataaccgtaaaaagttataggtcaaataggaaaaggagcactgtagaagcagagcatcttacagtatcttaagcatattacaatttacaatggaaaactgcagagtacattggtctttgaacagagcagtcagagaaattctaccactgaatagcatggcctcatgggctgagtgcttgttagatatgtgaccccgttgaagcacttctattgaatgtgtttgcagaacaagatagatggacactgtcaagacccacatgccctctcaaggggaacttcagagttctgggataggaagctcttcattcatggatgaggaaatccatttacacacaaaacctcagcacaaggttcatcaacaattctctgacacaagagagataacatttcttggaagatttggaaaaacaaatatcctaaaataatttattaaagaaaatagaagattttttgagaaaatttacttagtgttctatcttacaaaagatagaggaaaatattgccttaattctttctaaaaaactgactcgaatatgtcacatgatatgaattataaatgaagactcaaactatgttttattggactctcctatgtaaacaataggatgaaatgtaattcactggagac

SEQ ID NO: 4985 - DNA, 1194 bp, Homo sapiens
atgattccatgttttctctggagaacatgcaatccctgaggaatgattgttccataccaccgttaagagcgttactgtgttaactatgtttaccatcttgtctcttttttgccagatttttactttcaccttattttgtccaccaaacacttgtgcaccaggagacatgtatttgatttgtttctgtaaagatttggatgctctcattccgtgttttatatgcctagagggagacttagtaaacagtgagtgttaaagcactcctttcctaatatgcctaagaattacccagagagcttgttataaaacacagctcccccagagattctgattcagtagggccagggttgggcctgagaattttcattttaacaagtttccaagctgatgctctgactgttgtaccaggaccactggtgtaaagtgtatagcattcaagaagcaacagatgctatgaactccagtgacatgttcaagattatacttacctttgatttcatgtacatacccacattttacacatatggagtagtgtcttctctgcttcttttaccaagtttctgtggattccttttgtttgtcataaggaacgtagtgctctaaaacaagtttttaaaatgtaatggaaaccgttgctccattttaattttcatttttatctctctctgacacacagagcacacacaaacatatacatggacacacacacacctcccctttcccaacatgtccagaacttgatgatagcagaaacttgggcatatgattagccatgtcccccttggcaaatctaattacttaattgaatatcattattgaaagatttataaatcttttacataaataacagtggaataaaagcaaataaactaaataatgctagtcagcaaagaaaaaagtggtgatgggtcattttgcaaagactctctgtattaaaatctagatttgcatatttttaaggtagtaagaaacagtaaatccattgctaactttcaagcatcacattattgacttttaaaaataattttctcttcttttttccctgaagataagtcccatagactcagcatggtctaaaatgtgtaaaactaccttgtcaagtactgttattatctctatcatgggttttcttgtttgcagaaattttttaggttaaattctatcctgcatgcaaatttttctaaaaggagtttt

SEQ ID NO: 4986 - DNA, 1168 bp, Homo sapiens
tggtataattatatgtagcactgtgctgtgtagatagttcctactggaaaaagagtggaaatttattaaaatcagaaagtatgagatcctgttatgttaagggaaatccaaattcccaattttttttggtctttttaggaaagattgttgtggtaaaaagtgttagtataaaaatgataatttacttgtagtcttttatgattacaccaatgtattctagaaatagttatgtcttaggaaattgtggtttaatttttgacttttacaggtaagtgcaaaggagaagtggtttcatgaaatgttctaatgtataataacatttaccttcagcctccatcagaatggaacgagttttgagtaatcaggaagtatatctatatgatcttgatattgttttataataatttgaagtctaaaagactgcatttttaaacaagttagtattaatgcgttggcccacgtagcaaaaagatatttgattatcttaaaaattgttaaataccgttttcatgaaatttctcagtattgtaacagcaacttgtcaaacctaagcatatttgaatatgatctcccataatttgaaattgaaatcgtattgtgtggctctgtatattctgttaaaaaattaaaggacagaaacctttctttgtgtatgcatgtttgaattaaaagaaagtaatggaagaattgatcgatgaattaagtgaggtggaattcttttctttctgctttagcttctctctgttggacttagagctgggtattgctattttagtgtataatcaagctgtggaaataaatttccagcattaatgtctattggtagtcatcctcaaatcctttcttgaaatgtttcagtggctaatattatctccatggtgagaaaaagtttttctaaaaagagaagccattaatatttatttgggaaaaatatatacgttctttcccattacgaaaaattattaatttcttgttttacattctaggtagcatgtggtattttattgtcttactaggtttttagaccgagagagggtaaatggttgatctgtagagttttagagcattttgtaggtttgtcacttccgtgactttgcaacactagctaattttccaaggaaacagaattgtgccattttcacaatgtcctatgagctctggggtagcc

SEQ ID NO: 4987 - DNA, 1199 bp, Homo sapiens
tgttttttaactattcagtttaaactgtgagagacaccatgtcaaggaagcagtgtgagctagcgtctaaggattgtgaaaactgagcaagtgcccagaactagaaacttcccagccccctgaactcagcctcagggtaagcgagtttaatagtgcttcctttgattttcaaatctgtggaaggtttgtttcagtttttcccagacaaatattgttgggatagtgtttcttttcaaaaatggataggattcaatgctcatcagtgggaagatagtgactcctgaccattttcctcctagctggaaactacagaagactcccaagtatcaggaaatttggagaatttgtacaggaattatattcagagatagcaatttatttactcatcaaagagagctattggatagccaccataaagaccactcattaaaaaacaaaattgcatgatattcttaacattgtctttcactttttttaaccaggcttggtggagtttcaagatgctgatgaacttaaggtatgggccgagtggaaagaatttggtttaagttattaatagttgaattgaaattgtggccaaggatgagaactctaatctgattttatgtgcttctgctgtgatggattaaaggatttacctgaggccaaattggtatgcaggaatttattaaatggaatcataccccccccccttttaaaattacgcttttggtaaaagggaaaaagctcttggtaaatggataatactactaagccaagagaaagacaggattttgagtgaaaacataaatttagatgtcacaacattactaaagcaacagtgtgtaagatactggacgattttatttacttacttgcacagtttttgtaaacagtctagacagtactgtattttgctatttagtaatacctactgtgatacttcttttacaggtctggcgcttgaaagaatcagtgaagcttttcaagtagaggaggtatatttgaatatgtaacctttagtatctacagaatagaggttgcttttttttttttttttttgtccctttcacagtggtagcaaggttgaattttgagatggccccaatcatctataggaatattatttgacagttttggagacacaaaactgccttatagctgacttgatcctgtagaacatttctgtggaattcaattctattatttaaggtagtttt

SEQ ID NO: 4988 - DNA, 1225 bp, Homo sapiens
tctttctatattgtctagacatactaagatataatgaagatttttgagattttaaagaacagttgctgggcacagtagctcatgcctataattccagcactttgggaggctgaggcaggtggatctcttgagcccaggagtttgagaccaaccccgggcaatatggcaagaccttatctctacaaaaagtacaaaaattagccagacatggtggtttgcgcctgtggtcccagctactcaggaggctgaggtgggaggatcgattgagcttaggaggttgaggttacagtgagccaagatcatgccactgtactccaccctgggcaaaagagtgagaccctatctcaattaaaaagaaaatagaaagaaaagttgctagtaaaattattttgttttattgtttattttaggtaataatagacgtggatggaatacaactagccagagatattccaatgtcatccagccatccagtttctccaaatccacaccatgggggggcagcagagatcaagaaaagccatatttcagttcttttgattctggagcttcaactaacaggaaggaaggctttggattgtctgagaacccatttgcttcacttagtcctgatgagcagaaagatgaaaagaaacttctgtaagtgaaagttttcaggaaaattactatccatttgcttatgttttttcacctacaatctttgttgtttctctttttttgtaacatcttttcacaatacaatattttctttaaaaaaagaaataatgcattatttttaaatcagagtagcaaaaagaagaaaaatcacccacaattctatcactcatagatagccactcttttgctgtgtattaccctagattttatttcacttaaaaatatatcatctttctataatagtagagtgccttcctaggggtaattacgctttttccactttgtgttgataacactatattgtgaatatctttctaagattagtcctgcttaagttcattctaacttacaagtcctttacaaagtatgatgtaatttagaacaacttgtgaacttggaggtcattttaccatctcatttatttatttatttatttattttgagacggagtcttgctctgttgcccaggctagagtgcagtggtacaatctcggctcgctgcagcctccgccttctgggctcaagccattcttctgcctcagcctcccaagtagctgggattacaggc

SEQ ID NO: 4989 - DNA, 1236 bp, Homo sapiens
accttcgtaaattctacaaccttccatcatagagcctcaaagcatttgactcattagacatttgtgaaagggaggccagattgggcatgttctttgaaagacacttaagctttagaagtacattttaggaatgagttttcaggagtttcgtagaagtacatagctatgatagcagcacctttgagaactttcttgtcactgtgtataacagcatagcattgtcctcaggtagcagctctggtgaggtaagtagaaaccaaagtgaaagtctattccctagtccctgtggtttctccttgggtgaaggtcgatcaaggtgaaaatgggattgttagcagaaaagacaggcagcaggctttagtgggtagttctagcctctcatttttactttcctcatctcgtccgtccagtaagcttctcaacactgaaacatgacataaataagaaaaaaagatagggggaggaaataattgtgacatttttctgaccgtaatagatttttgttgttttttttgttgttgttgttgtttgtaggctttccagtcaataacagcagcagtgataatgctcagaactttagttttaaaacaaactctggatttgctgctgcctcttctggaagccctgctggttttgggagttccccagcatttggagctgcagcctctaccagttcaggtatctctacttctgctccagcttttggatttgggaagcctgaagtcacatcggctgcatcattttcattcaaaagccctgcagcttccagttttggatcacctggattttcaggacttccagcttccttggcaacaggtcctgtcagagctccagtggccccagcctttggaggtggcagttctgtggctggttttggtagtccgggctcacattctcacactgctttttctaagccatccagtgacacttttggaaatagcagcatatccacttctctgtcagcctcaagcagcatcattgcaacagataatgtgttattcacacccagagataaactaacagtagaagaactggaacaatttcaatccaagaaatttactctgggaaaaattccattaaagcctccacctctggaacttctaaatgtttaaaagggcaattttaaatacaaaaaagaatgatgtttaaaattgctttgagtgattcatacagagatgtatatatgcatacatgtatatattcataaggaatataagcttccatcaatagtgattt

SEQ ID NO: 4990 - DNA, 1160 bp, Homo sapiens
ttgggaaaacatgtttaccttttctggaagtgatttgctgaattggtgttatttctttaagtatttgatagaattcacctgtgaaaccacttgaataatttctctcagaagtttttttttttttttttttggagacagagttttgcttttgttgcccaggccggagtgcgatggcccaatcttggctcaccacaacctctgcctcctggttcaagtgattctcctgcctcggcctcccaggtagctgggattacagacatgcgccaccatgcccagctaatttttgcatttttagtagagatggggtttctccatgttagtcaggctggtctcgaactcccaacctgaggtgatccatttgcctcggcctcccaaagtgctgggattacaggcatgaaccaccacacccagccctttttttttttttcttatgctcaaattcaatatcttcagtaattatagtgttcttcaggttatttcatcttgggtcgtttgtagtgttcaaagaattggtcaatttcatccaagttgtttctttttttctttttttttttttttaataactacatcatcatggacaagttgcataaagctttgtagtattcgcttatcctttaatgtctgtggggtctctagtgatatctccactttttaattctgatactagtaatttttgtgttctctctcttaaaatcttcatcagccttgcagagctttatctgttttattgatttctaataacttcatgatgttgaagctgaatgagcttctctgtctccatgattttgagaggtgaaggtggctgggcttctgggtcaggtggggacttgaagaacttttctgtctagctaaaggattgtaaacacaccagtcagcactcagtttctagctaaaggtttgtaaacacaccaatcagcactctataaaaacgcaccaatcagtgctctgtgtctagctaagggtttgtaaatggaccaatcagcactctgtaaaatggaccaatcagcaggatgtgggtggggccaaataagggaataaaagttggccacctgagccagcagtggcaacccgccagggtccccttccacactgtggaagctttgttcttttgctcttcacagtaaatcttgctgctgctcactctttgggtccacactacc

SEQ ID NO: 4991 - DNA, 1183 bp, Homo sapiens
ggttcaaggcgtttgttgccatcagggactacaatggctacgctggtcgggttgaagtgctccaaggaggtggccgccgccatccgcggggccatcatcctgaccaagctctccattgtcaccgtgcgcagaggctactgggggaacaagatcggcaagctccacaccgtcccttgcaaggtgacaggccgctgcggctctgtgctggtgcccttcatccccgcgcccaggggcactggcatcgtctcagctcctgtgcccaagaagctgctcatgatagctggtatctacgactgctacacctcagccaggggctgcactgccaccctgggcaacttcgccaacgccaccttggatgctgtctctaacatctacagctacctgatcccctgaaggacttctggaaggagactgtattcaccaagtctccctatcaggaattcactgaccacctcgccaagacccacaccagagtctccgtgcagaggacccaggctccagctgtgactacaacatagggtttttatgcaagaaaaataaagtgaattaaagcctattactgtcaaaaaaaaaaaaaaaaaagacatgaatgtactgggtatgattcgaactggatttgtttcaagcctacaagtctctctctctgataagtgtcatcaaaaaacactgggtgaaataatgtttacttacttatttattcaacacatatttataccccaaagggagtcttgtggaggatagagatggatgtatactgtgggtccttgcctgccccttgagaggcagcctataaatgccattcatgttattcttaaaagtgtggaaaagtacccaagctgctcttagctttcttcttcctcctcctcctcctcctcctcctccttcccctacttccctccctccccggctccctccctccctccttctctccctgccttccttccttcctggctaatcaagtgaagcagtgggagtggagaaggaacgaagaaatctataactggttgtgatcaattagttgtaaacaccactgcactcagaccggcccttagttttctttaatgtctcattttaaagcttttgtttaggaatgtatcttttttttttttcctttttgagacagagtcttgctcttgtcgcccaggctggagtgcagtggcacgctctcagctcactgctgcct

SEQ ID NO: 4992 - DNA, 1149 bp, Homo sapiens
ctcacaaaatttaagaatacatttgactaataattgagcatcttgtcagtttttatgcaagcatatattgtatacctgaggaagatgacagttctataatttttttaaggtaaggttatttttaaattgcatttttgttctaacgttttgcaatttatattctttttaaaatatttcccataattcatcatgctagcttctgtgttcttggaatagtttttgaaaaatgcagagattcgaacatgagtccttaatatactaaacagtgaaagaatgatgatatctcatttctaaagtaagcatggttcacaccactttggcaatacactgcagtactttttaaaaaatattctctagtgataaaagtaaagacagggtactggccaagatcctaattctgacttctgactgtgtgatcttcgatgaaatttatatttccctttatcattactattctacttgttaagtaaggctaagttaatatttgtcttcgccttaaattctgatttgtaatttgtaactctgatgtggtagctgtgatatggtgaactgaaaaatccttattaggctactttatctgttctcttttagttattttaaagtgtacctgtttctgaagtaatgtagtgaatggtgaatacttttcaggaattcttccagttttaaaatagccccaaagatacagtttcagctggtggaaggtctgttctgctctcttagtcctaatcagaaagtcccttttatcttataatcccatactaaatccaaacccttagcaaatccttgctgccaaccagaccactcacaaatcaaacaaaatgtaagcaagcaatccagtactcggttacaccagaagactctgatctttgcccccgaaaactgtcctactttatccttatacctgaaatcactgcatacctgaaatcactgcagccctactgttttacccataccattaatttaaaaaggcatctatttctttatagaaagaaacattcacagtgaggtcttagtttgtgaacctcaaaatccagatattaatccactttagttattactttgtaattgcttctcagtcattggctgataatgcaatggtgtgataaatttgacttatctccacatacaaaagtcgatcagaagggatag

SEQ ID NO: 4993 - DNA, 1190 bp, Homo sapiens
gtggtcgccgatgccgccagtgctccagacgccaggccgagtggccctggtggccacgtcgctgcgcctttcccttgggggaggggcaaggccagagggggtccaagtgcagcacgaggaacttgaccaattcccttgaagcgggtgggttaaaccctgtaaatgggaacaaaatccccccaaatctcttcatcttaccctggtggactcctgactgtagaattttttggtttaaagaagaaaaaaataaagctttggacttttcaaggttgcttaacaggtactgaaagactggcctcacttaaactgagccaggagagctgcagatttattaatgggtgtgttagtgtgcagtgccttgcaggaatttaaactctctacccttaaagaaggaaatgtatttgtacaaaagccacagataatggtccttttactcaagcgacctgctggataaatgacagcctgcagggattgagtttggagatctagtctcaattctgcttccgatttagatgcagttcacttttgttttttaaagtaagttttattaatggaaaggaagaactttttccaagaaagcattttgaaagccactgggggagggggacatttatgcttttgggctgtggagatcctttaggtggagagactgctctctcatccctagtggaatggaggtttgggttggtgagtttctatcaatagcctgctctctatagtgggtcagtgactggcaccaaattgtagtcctgttccatggacattgccctgttttggttttatgagcttttggccaggcacaggacgcagggtggtagggaaaaaaggaaatggttcctgtgcccgtggtgctgacaggtaagggaagggccttctgatgtattttatgggatgcttcagaaacctgggggttgcttgtgtctctgggaagcccttggtaaagaaagccaccattttttttacttaggtatattccagtggtttatcatcgggagagggatgataatggaggaaggctcaatgagggagaaagtattcagctgcttgatgttagagcttaatggcaggacctaccagttgcttttcacagaaatgctgtgtattgatcctaaggcagcatgtgttctcttttgtgtggccattatccattctcccacttttccatcagtgactgctttgcttttgttcct

SEQ ID NO: 4994 - DNA, 1552 bp, Homo sapiens
atgtacttttaaaaaaatcccttactcagtccaaatgaggatgagagggtgaaaggaccctttatttaaaagaatagggtcagccacgaaataaaaatgtctatgaacccgagtaatttatctcctgagtaattctgctaactggctgcaaaggattaggatctgcttgtttaaaagactggatggatataaaatagaatcaactgtagtgttaggctgatcatgggaaatcaaagtaagtttgttttctcttgctgttccaacaattataggaaactatggtccaggaggcagtggaggaagtgggggttatggtgggaggagccgatactgagcttcttcctatttgccatgggtaagtagcttttgagttttacaattattattatcttgggagacatagctgcaggagtaaaagctttttaggatcatgttatctttccttaaaatctggttagatggataatttcataacctattttttttttactctttacttctgttgaaacaggcttcactgtataaataggagaggatgagagcccagaggtaacagaacagcttcaggttatcgaaataacaatgttaaggaaactcttatctcagtcatgcataaatatgcagtgatatggcagaagacaccagagcagatgcagagagccattttgtgaatggattggattatttaataacattaccttactgtggaggaaggattgtaaaaaaaaatgcctttgagacagtttcttagctttttaattgttgtttctttctagtggtctttgtaagagtgtagaagcattccttctttgataatgttaaatttgtaagtttcaggtgacatgtgaaaccttttttaagatttttctcaaagttttgaaaagctattagccaggatcatggtgtaataagacataacgtttttcctttaaaaaaatttaagtgcgtgtgtagagttaagaagctgttgtacatttatgatttaataaaataattctaaaggaaattgtgtaattatagactttttattttaaataagttaaggagtgggtagtataattaaggtccgttgcaaagctgttgttatatttgtataagataaatgctggtcagatgtaagtgtgttgtctgcaattcatcaggattaaattatgtagataacttaagggatatctctgcaaggagaaacacctttttagatcttttagatgctgcttcttcaatgcaaggaaaggaaataaccccagcgaggtactcttcagggacacaggtctagtacaagagaactcttgacggctactaagttcagccagtcttaaaaaactgtgctgtttctacaaaactttaactacagtagtttataaggatgccaacgaaagctgagggtgtagagcaaaatagttctaagcttcagttaaacttctttaggtaagatcttatttacttttcctttcttaattttcctccctaaaagataaactaatactcttaaatggtctttcagtatagtggttcttacgtagtttaacatagctataaattgagtttaaca

SEQ ID NO: 4995 - DNA, 1338 bp, Homo sapiens
taatgaaccaagagttattttctgatgtttaaaaatagaaatttgcgtttttaggttgtagggttgaaatttttggtaaagattctttaataatcctttgataatcacggtctacatttgtttatttttccttagaaagttttttttttaattaataatttaagataatttaatgttgagtaaatttatatcaagcattaatgactttgaaacttgtgtagatcagctgaggcaattttttggtgtaacacaactaatatgcagtttaacatatggtttaaatttgatgtaagttttttttttccccccagaaaactttagaaactgttcctttggagaggaaaaaggtactctgccagcaggtcacctcatatttaagaatttaatttcctgcatacaaagaggaaaatgtaaataaaaattgaaatggtattttcctttgcagagagaaaaggaacagttccgtaagctctttattggtggcttaagctttgaaaccacagaagaaagtttgaggaactactacgaacaatggggaaagcttacagactgtgtggtatgtaaattactgaattgttactggatattagtcttttagctgtatgttaagtgaatcatggaggaaataactatcagcatagtaaaaaattctattatgacttcacttataagctataatgagattaaatgctaaagtttaccctttggtttgaaaggtaatgagggatcctgcaagcaaaagatcaagaggatttggttttgtaactttttcatccatggctgaggttgatgctgccatggctgcaagacctcattcaattgatgggagagtagttgagccaaaacgtgctgtagcaagagaggtaagcaaacaatgactgtcttgtgcattaacatgaagaacgctgccctgctgaaaatcagaaactatttctgaatttagttttaactcaagattttttctcttattaaaggtgtgttgggtttctggaccattttcttaagctagcttatttttcaaaagctaggtccctaaaagctattttatatctggtagttttaaggtggatacaagcgaagtatggtactacggttgggtgctttgaattatgcttgtgtttttttctgtttggatgacttttaccccaccactattttaggaatctggaaaaccaggggctcatgtaactgtgaagaagctgtttgttggcggaattaaagaagatactgaggaacatcaccttagagattactttgaggaatatggaaaaattgataccattgagataattactgataggcagtctggaaagaaaagaggctttggctttgttactt

SEQ ID NO: 4996 - DNA, 1412 bp, Homo sapiens
ggcagcctcagcggctggcgccaaaaccggactccgcccacttcctcgcccctgcggtgcgagggtgtggaatcctccagacgctgggggagggggagttgggagcttaaaaactagtacccctttgggaccactttcagcagcgaactctcctgtacaccaggggtcagttccacagacgcgggccaggggtgggtcattgcggcgtgaacaataatttgactagaagttgattcgggtgtttccggaaggggccgagtcaatccgccgagttggggcacggaaaacaaaaagggaaggctactaagatttttctggcgggggttatcattggcgtaactgcagggaccacctcccgggttgagggggctggatctccaggctgcggattaagcccctcccgtcggcgttaatttcaaactgcgcgaccgtttctcacctgccttgcgccaaggcagggggcgggaccctattccaagaggtagtaactagcaggactctagccttccgcaattcattgagcgcatttacggaagtaacgtcgggtactgtctctggccgcaagggtgggaggagtacgcatttggcgtaaggtggggcgtagagccttcccgccattggcggcggatagggcgtttacgcgacggcctgacgtagcggaagacgcgttagtgggggggaaggttctagaaaagcggcggcagcggctctagcggcagtagcagcagcgccgggtcccgtgcggaggtgctcctcgcagagttgtttctcgagcagcggcagttctcactacagcgccaggacgagtccggttcgtgttcgtccgcggagatctctctcatctcgctcggctgcgggaaatcgggctgaagcgactgagtccgcgatggaggtaacgggtttgaaatcaatgagttattgaaaagggcatggcgaggccgttggcgcctcagtggaagtcggccagccgcctccgtgggagagaggcaggaaatcggaccaattcagtagcagtggggcttaaggtttatgaacggggtcttgagcggaggcctgagcgtacaaacagcttccccaccctcagcctcccggcgccatttcccttcactgggggtgggggatggggagctttcacatggcggacgctgccccgctggggtgaaagtggggcgcggaggcgggaattcttattccctttctaaagcacgctgcttcgggggccacggcgtctcctcggcgagcgtttcggcgggcagcaggtcctcgtgagcgaggctgcggagcttcccctccccctctctcccgggaaccggatttggcggccgccattttcatggctcgccttcctctcagcgttttccttataactcttttattttcttagtgtgctttctctatcaagaagtagaagt

SEQ ID NO: 4997 - DNA, 1096 bp, Homo sapiens
ggttctccgctcccctcccctccccttctcgccggaccccgcgccgggagctgcgggaaggagtggagggtcgggcggtggcctcgcggctggcctggcgcgcggccagcgccggtagttagtggggggactgctctgccctcgagggggtagggagctgtggcgacggttgccccatttcgagacaaagcgcatttccccctcccctcccccacccgcgttccggcggaggcgccccctcccccagccgccacgcggggctgggtcgagacttgggcctcccggagggcggcgcgtggtcccgcgtccgcgaggcctggcggcgcgcggccggctgtcccgaggctgcggcgaccgcccagttaacgtggccgccgcgggggtaggcgcgtgcggtgtggcgcagtgcccttgagcccccgtgccgcggcctttgtttctccccgcggatgcgctgaccacgaggcccgcgctcccgggtgggggcgggcacccgcgcttaggcctctggacgccgggcttcagcggcgggggtcgggagcgggtgtttgcaagaggtgattcttttttcaaagtgtcacgaaacggggttgaagcatcttaagttttttccttttgttatttaattaccgattggaaagagggagggtttctgagcagaaaccaagttgggattgcagaacagagaagattcacagtgctttaccgttgtgagttgtttgggtaatcgtgcctggttttaaaccgaaaggattgtcctttaaaaatggaacatggactttattataaatgggacttagattggaaaagacattggtcccctattttaagccatgtgaagctgttttaggtaccaggatccccagtaaagtctttctagactcacatggttaggacacgtacttaagtacatcataagcaatgtaggtaggagcgcagatctactctggatttgtattcacgtttgaaatgtgcgctctctacttgggggttggaatccaaacagaatttgtatttagttaccttttttgtgtcatgcaaacttaccttaactgtcatgcatttttctagtaatagctcttcaagtctgcaataa

SEQ ID NO: 4998 - DNA, 1198 bp, Homo sapiens
caatcattctgtctcacgtgatcttcccacctcagcctcccaagtaactgggactacaggtgcacataccacacctggataatttttaaattgtttttgtagagatgaggcctcactatgttgcccaggctggtcttgaactcctggcctcaagtgatcctcctgtctcggcctcccaacatcctgggattacaggtgtgagccactgtgcctggcctcaatcatagcacttccaagcaccgttcaaatgactgagtggggaatgaaggtgctatgaataattatacatactgtgatgacaagagaaaaccaagactgtcctgaacaacccaggccatgtggtcaccctagttatgggcaatattttacttctctgtttttcaaatttcctgaattatattatttaaacattaatttaaatttaaaaatacgtaaaaagaatgatcttgctttagaatatttgctttcagaggtcacagaacatttctttggctctttcaccaagcacttaaatgtctcctgccttttaaagtgatagggataccgtggagacattggtctcagaggatgggtggtctcagaggttggggataatccagctgggaggctttgaagctgtgatcatccccctctgccctctaccattctcatgaaagaacgggctagcatagcacctacagactccaagatgacctttttctgtgactaataagattaggatcctagtacgttcaaaatgtcctaaggatttgcttagatcacttgacaggcctgttctcctttgcctttcccaaagcaatgttacagttaaaggttagtttgtgggatctggatttgaatttttttctactgaagtttgcaaaatatatatatatatatatatatttgagatggagtctcgctgtgttgcccaggccagaagtgcagtggcacgatcttggatcactgcaacctcagcctcccaggttcaagcaattctcctgcctcagcctactgagtagctgggactacaggtgcacaccaccacacccgctaattttttatatttttggttgtgacggggtttcaccatgttggccaggctggtctcgaactcctaactttcctaacttcaagtgatccgcctgcctcggcctcccaaagtgctgggattatatgtgtgagccactgcacccagccatcaaatataaatttgttt

SEQ ID NO: 4999 - DNA, 1271 bp, Homo sapiens
gtagaaaggtagtgttagcctgacatttgagttatactctgtgctgcctgagcaagatttgtagaatcatataattaccttttcatgtatatttgaaatcagaggtgtttaaaatacctatgagataccaatgtagccttaacatatgtcaaaatgcattgctggttagataattatttggactacacataaactcctaatattgaatcattacctatcaggtattatctttatggaacttttcaatatctttgctttataaagattctaaacatgtatctgagctggtaatattttaaaatctccattatttgtgtaaaactgtttataagcagtgtttgagagggtctgctttaccattaccccctcaatatcatgatcatccaatctcaaatgtgaaaaaaaaaaagaaatttgattttagggattgtgagtaaacaagtttatatagagagacattgtgaagttaaagttttcagaagttacatttgtgcagttcttaccttttcctcatatagtgccattgaaatagactgaaattatcttggcaaaagttagacaaccaaagacgactttagtggactggttttcaaaacttgagcagctgaaaagcaaaagccgttgtttcccatgacaatgtagcctttgtggatttgggtttgtgctttgggttgaaaagaagtttttagtcctaggccagtagatggcagcagcttttcattgcagacaaaacctcttgaaacccttcccccatggcacaaactcgcccatgatggaaagcatctagatttctgcctccttttacagttaatccaggagagggagtcctttgccaactgatgaccaacagttccaagccagatagtctcgtgaacagtgacaatacagaaataaggtgttatttctgttcagatctccaccggcctttgttcttttaaaacttgaatataggtgggagacataagaaaggaaagaaaagacttaaaactggagtgacaggacaaataatcattactttcaattcatgactgctttatattcatttgatgaaatcatttgtatacaaaccagggagagttttctttacacccttgacaatatatcacatactcttcaagatcataataatatcattaatataaatttaaacaacatggcttgttagaaaatatgctaattgctatggtctcattatgtttgcttagcttttatttgtttttctgtgaacagttagagagctaatttttttcaaaggtgattgtaagtcatat

SEQ ID NO: 5000 - DNA, 1112 bp, Homo sapiens
ggagacggccgattccttccacttcttgccttcggccagtggcggcgtaaatcctgccaagatgaggctgcgggcgacccgggccacaagggtccccatgacagattattcaaataagccacagacgtgatcagcggccttagggcgccctgacggcttgcccagctccgaaggccttccaggaaggttaaataaggagtggggggcgtagagggacaggttgggaaagaaagacgaagtcagtgaacgggacagaggaatcctaatcttgctacagaacacaaggcagcatgctttccctctgcgtggcaaggagacctgtttccaaatttcattctatacagcgttttgagagtgggaggaaggagaagggggacaagaggacagagtaggagaaaggaaggtctcggaggggagggcgagccaaagttttactgcgtgcaattttaagtgactgtctgtgcgtctgtctgccagggttccattgtgtccgaggcctgactgcctttcctaaccagttcagcagagttctgcacttcggccagagaccccatgcaggaggctcatttgccccagcgggatgtgcgtcttctgctcctaaacccagtgtttctcttccccgcagataacccagcagccaactggcttcatgcgcgctccactcggaaaaagcggtgcccctatacaaaacaccagaccctggaactggagaaagagtttctgttcaacatgtacctcaccagggaccgcaggtacgaggtggctcgactgctcaacctcaccgagaggcaggtcaagatctggttccagaaccgcaggatgaaaatgaagaaaatcaacaaagaccgagcaaaagacgagtgatgccatttgggcttatttagaaaaaagggtaagctagagagaaaaagaaagaactgtccgtcccccttccgccttctcccttctctcacccccaccctagcctccaccatccccgcacaaagcggctctaaacctcaggccacatcttttccaaggcaaaccctgttcaggctggctcgtaggcctgccgctttgatggaggaggtattgtaagctttccattttctataagaaaaaggaaaagttga

SEQ ID NO: 5001 - DNA, 1112 bp, Homo sapiens; identical to SEQ ID NO: 5000

SEQ ID NO: 5002 - DNA, 1116 bp, Homo sapiens
agggctgggtcgccagccgcctgcgcctgggaatcctgattgccagctgatgagaaaggcgggctgggcgcgcgtgtgcgtggggtcgagggccggggaccgagcgcgccgcacaaccaaccaggccctcaaaaccttcgccctggtggcggctggccgctccctcctggccagctcctccgtggggtcctcgtagcaaaggcgaatttaagggttgcccgggcgcccctcgctccaggcgggtagctgtggggacctacacccgcggtactccctgagcggccggtccctgcctggagtgccctggtagggccggcggcggctccgtttgggacggatcctgcgttgaatttgacttttcgagggcggccgcgggtaaactcgcctctcccggggaccgcagggattatttacagggagctcgccaaccaaacacaacagtctaacctttccaagtcctcgtaaatttttacagctgggagccacggcgaggcaaacgaatctgttggtcgtttccgacttcccgccagcctgtgtggcttctgaaacaataactccttatgaaatatcataaatatagatttaaatacagtagagcgacaatgcgatttggctgcttttttatggcttcaattattgtctaattttatgtgaggggctccgctggccgcactcgcacgcgggacccgcgccttcttgatggcgtgattaattgtgatataaaatagtccgcttaagaagtgtgtgtatggggggggagacgggagagtacagagacaaggctagatttgatcttttaatcgtcgttggccacaattaaaacaaaccccatcgtagagcggcacgatccctttacataaaaacatatggcttttgctataaaaattatgactgcaaaacatcggaccattaatagcgtgcggagtgatttacgcgttattgttctgctggacgggcacgtgacgcgcacggccaatgggggcgcgggcgccggcaacttattaggtgactgtacttcccccccggtgccaccaagttgttacatgaaatctgcagtttcataatttccgtgggtcgggccgggcgggccaggcgctgggcacggtgatggccacc

SEQ ID NO: 5003 - DNA, 1184 bp, Homo sapiens
gattataacacaatggtatttgtgtatctaaacatagaaaaggtacagtaaaaatacagcattacaaccttatgggaccaccatcacgtaagtgttccatcattgaccaaaatgttgttctgcagtacatgtctatatgttatagtgcataggagacaaccaagacaacaatgttttaaaaacaatccctcctgccaagcagttggttaaaggacagttgttactttggtttttaacataaattaatttgctttctgctttggctttagtcttcacacctccccagccttaacccatccattcttcagctgctgccatttccagtggtctttctaaaacttgatcatgtcaggaacccaactccccccagctccccctcagactcagaattcttctgtgcttctccatttccttcagggcaattgtcccactctagcaggaactctaaggtctttctgaatggagctggcagtagtctccccttccctccccacaccctgcacggtaatcagatggggctacttgttccacacatcacactccaccttgcctctttctgtcacagttggctccatctctttgaaatattgtcaccatctctcagccctcttaacgaactcctattgatccttcaaaacctatcctgtgtgctttcagcacattcttcctcttggttgtcactgtttacttctgtgcttccccaagagggctgcctcttttaggcacccagggctttattttccttgggtgaccccaccatctgtgactgtacagagaatgtgtttgagggcagcacttcatagggtgatctagatccttggtgcccagttcggcttgatctcctcctacaggagtagaaaggagccattctttgaaagtcaaacagttgtggaaatgactccctgccagtttcttagagaacttagtcatgagtagcatttgtgggtatgagaaatactgtttctgagatactcaagatgagtatctcagacagctgcgtacaggggaattctctgaagatttattaataaaaagtaaggtggccctttcccaaatgtagtcaaggagacttggaatcaagattgttaactctggtatgtattatagtcataacccatcaatgcaaatcatctgaagtatgtaggtcttgcccttaggctgatgaggctcagacacaaacatgt

SEQ ID NO: 5004 - DNA, 1203 bp, Homo sapiens
tgtgaaaatgttgggaagcaccaacagaatccacgggggaccggacagtaaaatctcctgtagaattttttaagggcatacatgttctctccccaccccggatctactgagtcagaatctcggtggggtttggggtgaggggtggcaggtgttatgtttcctagactgcagtaaaaatactgtagtgagtatttctgtctgttagccttcctcatattttgacaccttggtcattttattctctgcctgttttctgggctacttagatttgtgacttttggctgggcatggtggctcatgcctgtaatcccagcactttgggaggccaaggcaggtggatcacctgagattgggacttcgagaccagcctggccaacatggtaaaaccccatctctactaaaaatacaaaaattagctgggtgtggtagtgggcgcctgtaatcccagctactcaggaggctgaggcaggagaattgctggaaccggggagctgaaggttgtagtgatccaagatcacgccactgcactccagcctgggtgacagagtgaaactccgtctcaaaaaaaaaaaaaaaaagatttgtgactttcaacttttataggagctggagaccttgaagaacttactttgtcagagtaagtacttctttctgcaaccttttctagtctccctccccaacctccgtctctttccagaaagaaccatgccttcttccctgttccccaaatacatatactctaaacatacctccacaccactttatcatgtttgtccatagggctgttacctcctaccctgctctaagttctttaagggcaggatatagatgtcttcttcaaccttgtgtccaaggcctagtcgtttagtggatcctcagtaaatgtgattaaatgaacgaattattgagtgtagggaaacaggaaaagcaaatcctaaatatatggtttcctgggactacaataactgtaccataaactgagtggctgatacagtaggaatttattgtctcccacttctggggactagaattgttggcatcaaggtgttggcagggttgtgctccctctaaaggtgctagggaagggtcgataccaggtccttttcccagcttctggtagtttcttgtcagcataactccagtcttcataggaagttctccttgtatgcatgtctgtctgtgtgtccacacgtttccttttta

SEQ ID NO: 5005 - DNA, 1224 bp, Homo sapiens
agcaggactggacacccacagagcacattagacagcctcagatatggataccaagggacaagacaatctaaacttccatacagtcaacttaccctatcattagaaaaaccaggagacttcttactagaaaaagtttgaggccctgttggccagaacaccgaatgtctacgacagaggcccaatggtacacatcttgctatttcccaacaactggagggaagccagatgacagctgtctcgaggggtagacatgtgttgggagaaggttccatctccagtcccctgagggctttttagtcaaacttccagattccaaagtttaagcatcagttattgagatgccctctgggaatggagcaaaggacagtgtccatcaagcgagccgagcacagccgccctcccaagggcttgggggaggatctgctagagagctgggtgatgtggcagcgactggctgtcccgcccaagcagcacactgccaaatcctgcacctcctgcagcacacactgcaaaaggactgttgtcatgatggtcaccaagcacatacccaaggactactgtgcgttgaaaaggtgccatttgtgtagctagagttgctctctgtccagcttgcttgggatttggggatgtgtagcattgaagagaaatcactattcattgcacccctttttgccaaataattaggtcactcactcaggaaaggccctgtgatacatatgtggagtaaagtttgctgtgggaacttgaactctgaatttcctgacttctgtgcaattaaaatcccaaagttaatgctgcattagcatggattttccatggtgggttataaatgcaaagttctatgtttcatatgtatttttctaacatatgttactgcctgtgtttctgattaaaagttcatccaaaataaaataacaagggattacttttttccaatagaactttcttcttcgataaaagctggaaataagcccttacctaaagttacccaggtttgcaggtgctgagactttagaggtgagtagtgtttgttagcaagacaaagggcattattctccctgcaatcaccaacagaaagcgttctttctataaagaaaattataggccactgcttcaaagacattacatagttaggcactactactggagactttcaggcagcaggcaggctggcaatcaacaaatatttattctacttccattgtgcatttagtgactttaaaa

SEQ ID NO: 5006 - DNA, 1219 bp, Homo sapiens
tacgatataatgcatgattggataataggaaataccttttagtagaatgtatgattcttgataggatatcctgcccattggctttgacagttgaattaacctatttggctgacattgaccctcctactgaccacgatatataagaaaatatgaaattaatataaaagctatcttgtactggtagcaagatagctactggtaggaaacattaacaatagcatcgtaaaatatagaattgaaaatgtgagtcattttgcttttaaatctctatcatgtacatgactgacttcagttgttctctctcctcccttttgttctgtttcagaggttgaaggctgcattgactcaccaccctgctgccatgtcaaatgggaacatgaacaccatgggacacatgatggagatgatgggctcccggcaggaccagacgccacaccatcacatgcactcgcacccgcatcagcaccagacactgccaccccatcacccttacccacaccagcaccagcacccagcacaccatcctcaccctcaaccccatcaccagcagaaccatccacatcaccactcccattcccaccttcatgcacacccagcacatcaccagacctcgccacatccgcccctgcacaccggcaaccaagcacaggtagaccttttccgtgatctctttccccttcttattctccttcttaacagtgcaagctctaatgctggggtcatttgcagcaatcttgtttgacaagcccaggtgttctatctcacattctaggggctctgtttatctcctaggaggcaagccttacccataagaccctaccagatcataatttctataaataatacactaaaaaatatcaggtctagtctctaagggcaagcataaactttaagttctccaaaatctatttttgcagtgtgtcagaaagttagcccctctcaaaagtaatatgaatcaatggattaggaagaacttaagcttgtgaagaaagatgtgaattaagaatgagaaaaacgagttaattctaaccctggttctagctgctatgttttaaaacatcatagagactcaattttgtcacctgtaaaatggaagttaaatacaacaggcaatcttctgagtaacagtgaatgttaaaaatctaaagagtaacaattcaaggcagacaaagaagctccatcatggatgctagggcgtaaggtgctgtgtaaatggtga

SEQ ID NO: 5007 - DNA, 1210 bp, Homo sapiens
ggttcgaggatgacgtaggtaactctcccctcccaagtccatgttccaagtggctatgtaaagcaagatgatacagaaagctgctctaaaatctcactgagtgatttcaccttcgcctactatgaaatgtctcatcagacctgacatgtctgagataaccaaggtgattcaggatttgatcaaaagaagtctagtaagaattaattacacagaagcctcctttcatttctatgggccaaacaaaggccatggataaccctacccgctttatgtcattacccattgggaaacacaatggctacttctgttagggtacattgaccttggtcaagcatcttaaagaaggcaaccctaattgagagctgtcttggctaatactctgcaccacaattgtgatgtcctagtcctaccactagagggcatggtacagcctggcaaaagttaaaaggggtgtggcagctcccatcaggtctggaggtggtctataagcacagttgacagttgtgcattgggatgggtggagaaagacgacaagagagcagagaatctgctgatgtggctgcgcttacttttagtgactttatgtacttatattaacagctggaaataggttgttgggttttgagcaggctgttatagtgaggaatgttcatttttaaatgttcctaacagattttgcttttgaaaaatgcttgttacatgaataatttgtggaccagggattgcttttctgaaggcagtatagggaacatgaatattcaagatgaaatacaaaaattatgtttaagggtcatagtgtataagtagcttcctaggaaaccctttgtgtatcttttcagactggggtgggggctgagcatgcttgtgcagaaagaagccatagccagaaaggacagaatctctcccccactcccttgccccataaccaaacataagctagctagtcttgtctaatagatgggatttactataggtgaagatagccctcatattcaaggacagaagctctggcaggagtaaattagcaaagcagaaatagtaccctttcattcttggaggtgctttgaaattttaggtagaatataatcgaaattatggaggttccttagtgctcaataatataagacctggtgttattagaacgagtctttcttataaactaacagagcaggtatatgcctgttagaccttagctgtggggttcctttac

SEQ ID NO: 5008 - DNA, 1313 bp, Homo sapiens
taaactgaaattttatacgttgaagcttaaaatctaaatttatgtatgtttggaaatggaatggacattaacataaaatgtattttatcaaaaaagtgtttagactttgaccaaatacatgttggtattatcatgttaatgttctctgtttataaaaattgagtggagatagatagactcggccattctgtgggctgatgagaattctgggctttgttttgcaccaggggtaggaaacagagaacatgtctgtatgttacttaatctccatagcaaaatcccaaacagcattagcagatcgaattgtttcttctaagacttcctttttctgaatgtgtgcacatcccttctcgtgctcacacacttgcccacacactcacttcttcctgcgctgtggctgctctaagcagggctgtgcatggtgcaaagctgcagtcagtgagcctggcagcctgtggtttctgttatggaaatggttccatggtgaaacacatccctgacccttcacagacttacacatttactcaccaggaggtggcagcggtgtgggaggaggagtgttgaccttggacgcaggagagacacctgggttctagttcaagtcggccaaggactgtgtgaccttgacaagtctaactggtctgtgaacaaggggcatttgcccttccagctgtaaacactgcccttctgtgcctgccttatgtgtgtgtgtgagtaaggagcaacagtcaaggaaacttttagggattcgagaagaaaatacatgtgggatcttgccaaggtgctgcctttaggatgctgacccctgcactaccttagaacatgttgatctgtgagtgcccaagcccctgagggctcgatctcatggggcagatgaaattctcttccttagaggaaagggaaaggtgaggccccagaggacttatctcagctgtacatgctctgcctgtggagacatggcttttctttgtgctgtggcagactggggctttggaagtggtgtatgtttaacttacctgagagtgagagatgtgtaggaagaatagctggaagaaagtgaaagatgagtgccagtacttttggcctgttatccagtagagagaaagtgacagtgaaagtaacgtgagagagaaagagtgtgtgtgtatatgtgagagagagaaagaaagagaaaggaatgcttgattgcttgttgttcactgggccagctctgaaatccaaaatcatgccttgataacattacaaaaccgtgatcctgggtttgagtgaatcctagagacattgttcttatggccgcctggtttccgcagcct

SEQ ID NO: 5009 - DNA, 1183 bp, Homo sapiens
agcactataaggctgaataggcacaagcgattaaaagtagatgccaggccacataaaaataaatgttttaatttacttagagctgtattcaagttgtttgataccagacagaaagctgacagtctgttctttgtaaactgcctttccctgtttttctgttttgttttgtttctcaagtttcattttttactaagccccttctgacacctaggcagataaagataagagtagtgcgcagtacaaatgtcagctctgaagaggaggaagtaaatcttcaatgctagggcagatcttcactatccgtgatccagtcttaatttgagcatgagagcaaaatttagtcatctacacaagaagcaaaagcaaggaatagttgttgggtttttgttttttggttgttgtttttttttttttttaggcaagaagtgttgccggtagggtatgtgtgctttctttgccttcctatttcctttcaaagaaatctcttgtaaattacaaaactgtgaattgggttgccaaaaactgttgcccttcgttagatgcttcaaacagtgtaaatcctatactgcaccctgtccacctctgctccctcctccctcccctgagagtgaggacctcatccgaccatgtaattaccattcgcttgctattaaagagcctttcaaactctggtggtgtttgcctctttttttctgcctccacaatgtttggtcccaaaggacacctaatgtggcttataaatgaagagcaaagagtaaaggaccggcagctcgctgtgtggttgctgtttgtgaggaggctgggggaagagagggaggagctggtaacatgaaacactgccattgttcaaagattaatcatttctgtgtgatgcattcatatgtctattgtgatgctataactggtagttagtaattttctacttctttgaaccaatactttagttttgtgtttgagaaccctattttttctagcctacttaggaattctttttggcattaattagaaatctgtattctgtggtcattctatgacatgacaccatgtctccaccaccttcctcccggttatttattcaccaaacatggcatttaaataactcatctggaagttgatggtaagttctgttatttgattaagagccagtttctttctccaaatgaatgggtctccatagagagac

SEQ ID NO: 5010 - DNA, 1236 bp, Homo sapiens
gacatgaacaggttgataatgtgcataaatgaataactgttttgaaaagaaaaattatgcaaatttgttattcagttttgaatattggtaaagtggtagttcagattatcttttggaagtagttctgtttgaactttaaagtactttatagcataattttgcaaaggtttttttcttaatcgcttagaatcaaaatataataaacattcttatctgttgcttatgtatgccaaatataatttaaaatgctcatttttttctgtaaaaaatatattaaagtcaagtatttttactgtggctctcattatataaataattagtataagtatctcaatttttctggttttgttcctttctagctgcatagatgaatggtttgaagtaaatagatcttgccctgagcacccttcagattaagcgtcagcttcctgttttataggtaattttttttgtaattactttttaaagcgttagcccaaattatacattctaaactataatttttatttattcatttactcattgaggtgcatgagtgtgtatgtgtatgtttcagacacttaggctactgcatagaaaacttacattaaaaatattgtataattctaattgttggctgggtatgctggctcgcgcctgtaatcccagcactttgggaggcctcaggcaggtggatcacttgaggccaaaagttcaagaccagcctggccaacatggtgaaactctgtctctactaaaaatacaaaaattagccaggcttggtggtgcacacctgtaatccgagctactcgggaggctgaggtacaagaatcacttgaggctgggcatggtggctcacacctgtaatcccagcactttgggaagccgaggcgggcgggtcacgaggtcaggagattgagaccatccctggctaacacggtgaaaccccgtctctactgaaaatacaaaaaaaaattagccaggcctggtggcgggtgcctgtagtcccagctgcttgggaggctgaggcaggagaatggtgtgaacccaggaggtggagttggcggtgagctgagatcgtgccactgcactctagcctgggcgacagagcgagtctccttctcaaaaaaaacaaaaaacaaaagagaatcacttgaacccaggaagtggaggttgcagtgagccgagatcatgccactgcactccagcctgggtgacagagcaagactgtctcaaaaacaaccaaaccaaaaaata

SEQ ID NO: 5011 - DNA, 1170 bp, Homo sapiens
tataaaaaccattcagaatgtatttgaaattttttaataacttaaatgcaatatagtaaatcaaattgaatctttaattcacagtcttttcaggatatcatttcttaatgtcagtaatgcattaagatgaagcagtcaacttcactgggtcaaaagttacactggactggacatagcatctcacacctgtaatcccagcactttgggaggccgaggtggggaggattgcttgaaaccaggatctagaaaccagcctgtgcaacaaagcaagacgtcatctctacaaaaaagtaaaaaaattatctggacatggtggcatatgcctgtagtcaccgctacttgggaggctgaggcaagaggatctcttgaacccaggactttcaggctgccatgagccatgactgtgccactgcactccagcctgagctttacagtttagagtaagaccctgtctctatataaaaataaataaagttacactgatgctgagtcacttacatagattggcatagtatttgcatataacgtgtgcacatccttccatatatggtttttgttgtgttttgttttgtttttgatacaaagtcttgttctgtcccccaggctggagtacagtggcgtgatgtctgcttactgcaacctccacgtcccaggttcaagcgattctcctgcctcagcctccctagtagctgggactacaggtgcccatcactctgcctggctgatttttgtatttttagtagagacagggtttcactatgttgaccaggctggtctcaaactcctgatctcaggtgatccacccaccttggcctcccaaagtgctgggattacaggcatgagccactgtgcccagcctctcccgtatactttaaattacctctagattatttataatacctaatgcaatgtaaatgctatgtgagtagttactatgctggggttaatttagtattattatttttctcaatatttttaatccaaggttggttgaatctggtatgtgggaacccatggatgtggagaaccaactgtatttcttgcccttccatgagccagacaccatactagattctgaattcttgccatctgtgatcttgcagtctaccatgaaaggcagtctaccaccttttcagttactagaacaaagtattctgtttttccctgaat

SEQ ID NO: 5012 - DNA, 1210 bp, Homo sapiens
gtgcgggggcctctctgggccggccgcggcgcctcggccctgccctctagctcccgcgttcgctcctaccctcttggctctcggggcacagcgcgcggcccggtccggagcagggcggacaggagcgccaggcagagcggcctggccgccgctaacggcgcacgcgcgcgtactcggctcggatctaccttccagtagcagcggagtggccaatgggaccgggaccagggctgggggccggggggccgccgccgcggggaggttcccggctcaggtgcccagcgctcaccagcccagcgcctcgggcggcgccgcggtggccccggcagccccgcgcagctgtttcctggggggcgtggcgtcgggggcccgcgcggcgcagtcctccttcagcatcccgaacagcagcagcggtccgcaggactcgcaggactcggtgcacagcagccctgaggatggcggcggcggcggccagcaccggccggtgggcgggagccccggcgggccgcgcctggtgatcggctccttaccagctcacctctcaccgcgcatgtttggaggtacggacccctctccacgcgcccgcgctcggttctcccgcggctgcacgtgggccgtggccgccggctatttttaccgttctccttttctccttccgccggggcgccgggggctgcttcccggcccagcccgccaggggctgcttcccggcccagcccgcgccggtctccatcctgggaagaaacccggcacgtaacacctgcggtgtcgctgccgcgtagacacgtggttttgtttttaaacatcgtgagcacccacacctcagcgggtactcagtagagatagtctattttccagtgagttgactggagcaaatgttgttttacagcaaacccacgaaatagcccttgtggttgtggcttttagtaccaggaagtcaggaggagacggttgctaaatgtagttctatctggggactcgagtggggcacaatttttaaaagccaaaagtcagagggtctcaaatgaactctgagttaccatctttggaccgacttttaatataaagctgtaatccttaaatctgtgtcagtagtcccacttactatgtcactttaattggatgaatgcgttaatgaaaagtttgttttcaaacctcactaaactgctacttaagatcacagttaatgtgagtcctgcttaatttggaa

SEQ ID NO: 5013 - DNA, 1204 bp, Homo sapiens
ttttctgtgtgaatggtgctagatacctggtctctcataatcctcacaacaaacctatgtcatggttgtttatttccccattttacaaatgtgaaaactaagaccaagggaagctacctgcccagaaccacattcttgataagtagctgaggcagagtttaactgaggtgtctctttccgcaacacctggatatatgtatctacaggtctgtttctttccttatagtcacctttgctgcattgaccttgtcctaaggtgagtcatggcagcttataaaaacataaatagctatgtaacaggattgtttaaaaactaaagtaatttaaggggaaaaaaggaattgaggtcaggaatgtaagaagtgctctgctttctctgcagttatataatgcatattgatttttaacatgtacattcatttttctaggcctggttgcagtatgcctgaaatttgggatgtagaagatcctgccaatgctgggaaaactcccttatgtaacctcttggtgaaggattccaaacctcacttcaccactgtattccagaacagtgtttacaaagtcctagaagttgtaaaagaatgactgctacatgacctgctgcctacggagaactacatctgtaatggttttaatgttttgctaagtcatgtgttgttcatatcccaaaaacttttataggtaactgttttcaaatagaaaacgttttatttggtcaatttgaatgtcattctaattataaaaatgacttacacctttatcaattggttactatttcaatgcaccctttaaaatttgctatgcaaatgagtatatgcttgtacttgactttaatatttgtgctaaagtgagcaaagctacctgtataaagaaaacacagtgggttgtgacaaggatgacatgaaaatacaggacaattctgacaatgtaggggctgattttatagtgtaagaactattaatgccccttgcttcttttttctgcctcttgctcttgtcttttggacatttcagtgattgtaagttcttcggtcatgtcagcccctgtcatcaacttgagttacagtagatggggcagacatggagtgtttgctatatagaactatctgtttgttttacttccttgtgcgctttttgttctctgttctcttgttaatgaagcttttcctgcccattattaatccaaactcttggaccttgtggtt

SEQ ID NO: 5014 - DNA, 1193 bp, Homo sapiens
tggcctcccaaagtactggggattacaggcgtgagccaccacgcccagccagggtagaagtacttttatccattgcttttgggttaatttttaaaaatcagttaggtaaaggaatcataaaaattatacataaaagccttatatatattattttaaagcaaacaaatgcattgtcactcaacaatgtgctgtcataaagacaaaggtttttctctgagtgttccagacaactgttggtataagttgactttcttatatgtatcataattcctcttccaacatttacaattttggtatcttggaagagaagcaataacttttaagactcttgcaaaataataagagttcacattctttctagaatttcagaatttttgatggaaaatttttccaatactctgacccatatgtcttagaagtaattttaaagtttgtatgaaaatttaatactttcattacatgcatcacatttgtagttcccaaatacttctagttgtttttaaaatatatacttaaccttttttaaggtacattttacaaattctgaggcaatcatagctattcgaagtgtgtatttatattcattcatacttgttatgtagaaactctctcagtgcttgcaaatgacctaggtgacatttgtttagctatttgtcttggcatgcatatatcccaaagcctgggatgccaagaatcatatgccaggatcatactgcggggctgggctgtggatctagttggtcagtcccagaattctcacaactcttatacgtacaatcttatttgtcccttgggtttccttttgctcggtctgatatatctgttgctggtttctggacatggtagttaattgctctctacataatggcctcatgagttaagagagcttcaaaaactgagaagctatgccagacactcagaaatgggatctagtgagcctagtattaaaattactaaaacaaactcacccctggttttttaatatgtttgttgtagtaaacaggatgtaaagtgggcattttgttgattgcaggccacccgtgtgatgtggacaccacctctccatgaaagtttttcctatcctttccttgtacttcagatgtatattttaactttgattctcaggtaactttgatttgtaaaacaaaggcaaataaattataatttaagtttcttaaaatatacttcaattc

SEQ ID NO: 5015 - DNA, 1199 bp, Homo sapiens
tttatcctttagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattatttttttttttgttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgtaatattgtgtgaggtcttaaatatcctacagtcgatgtacaagagtagagtatgtttgggaagaaacttttcagcttaagtttgcctcctctacaatgacatcttttatatgcttgtctcatttagaatgcatat

SEQ ID NO: 5016 - DNA, 1176 bp, Homo sapiens
caaagcataaatcagatcacgtcactcccttgggtaaaactcttcagtcacttccctttgcccttttgataaaagctcagccccatgatcccaatcaggcctcctctccagtctaatccacgctggagtgctccctgcctcaggcactctgctccccagttcctgcaacatccaaggtcagccttttacacagccttcatgtgctagttgtctgtacccagtaaaattctttcaccctcctccctgacctccctgactacattaatctccctgttgtaggcgccctgagcatcagtaactcccccttcaacagcccttagcagagtttaaacatcacacttatttgtgtgatcctttgatcaatgcaaacttcctcctctaatgtataagcagcccagcccatgaaatcaacaggcctatttttctcttggaaggaggctcaccattgtttatggatcacctagtacaccacatggtacacagcaggcgctcaataaatatttgtgaattaacaaatgaatatttccgtttggtccaagtgccgaggtgtttacaactaattgatcttaaccatttacagatttctttgttccttctccactcccactacttcacttgactagccttgaaaaagaaaaagaagaaaaataaagaatatttccaaatcaaatgctggaacaaatccaggcacacagtagcaattaagaatttaaaatactcctatccctttcctgaaagttaaaggcagcagtctcttcccagccaaggactaaagtcctagggtggtttccaccccctgcatacgatccaatactcttcaaagcacttatcacttctaatggatggaccaaactattcctaatacaacttctggatttcgaaagggtgaaactcaacattaaaactactgttatgccatttctctgtgccttgctttgatctagtcataaaaaattgtcttaaagatatatgttgagataaaaacaaatctgagaattttcacaacttcttgtattttcagacaccctcatctgcctgtcttatcattcccaggtccagacgccgagtctcagactgtttcattacacacttgcacatgctagaatggttagcaacacatttgaaaagattcaacatggccctaaaccagttgacaataattatatgacaacgctt

SEQ ID NO: 5017 - DNA, 1349 bp, Homo sapiens
ttacttcctctccaccccctgactaacgctaccttagtgtttctgaatatgagagtagaaaaagaagatcattttttaaatatgtgtttttaaattgcatttttagaactctgctgcacagttctgcaacatctgcagtgctaagaaccgtggaccaggaagtgcaattttggagatgaaaaaatagctcatttctccttgtcagtctccttgtcaccactctttttgagactgtttttgcaacaacaaaagcatttgttgacactcgtgctgttaagagatttgtttatgtttatattatactcaaaaacaatttcttcatctattcctgtactaatggtttctctttgcagttcacagagaatttggggctctcttcatgccttgaaattttggggtccatagtgaatattttgttatttatttgtttggctcattctttatatagtaatggaaacataagtctaggagttagaaatgaattttttagaccttagtaaaaccatttaaccataaaatggacaactgagaattctcccagctgcctgaaagcgtcgccaactgtggttatcctgcaagctgctacctgcaacttggacgttgtttccacgtgctctgctggctacgattcttgcattctgggtttggcttttttctgtgtcatcaactatggttatcctctaaataggcatttaatgaaacattgtacaaattgtcactcatttgatgacacctgggaataacattagcaggctgatgtcctgcaccattatgtttactaatcacatgttctgtgtgctgtgacgactgtcaaagagtatctggccatggcggacactcagcatttgttgattgaataaatgttagctcttctcattgtgaaggactcacttttactgggataaacaaatgcagttaagaattctggcacccttgtaaggaagaaaagagagttcaacaccttcgagtctgagcgcttgtggctagagtttgccaggagggaggaaaccagtgaccctgaaaactgagggtgcctcaggagcagtgggaccacctgatgctgaaggacggactaatgatgtttcctcttgccttctctggtgcctccattgccctcatggaacagagcatatcatagagggagaaaagtcaaacttgtaattgtgtcttacagttactggcttcatcttccttgggatatatggtcatcctctaatgagtgtaaaagtgcgcaaaacacatccttattgttcctgatctcttagtcccataaatgggaacaaatacagctttctgcttctttctttttggggaaaggacagggtgctagtgagtactgacagcatgcc

SEQ ID NO: 5018 - DNA, 1192 bp, Homo sapiens
gggatttaagacagagattgtatctgtttagtttattatctatacccagtaccctatacgtgatagggacccagtacttatttgtgcagtaaatagattaatttatgaaataaattgatgattttggaatagcaggttttcattctgggtaaagatctgaagaatggaatgaacacatgatgtaggagccaaagtctgcccaagaggatctgtataaggaagccctctaaagtagcaatagggttagttaatatagggccttctttgccagactttggaatttatgtttgattatacaaatgctacaggagcccgtgtatggttggaagaaatgatgaaatgacgcacagagtaatgagtggatcctggctggccaggtcagcctggcagtggtttggcaggaagagggtactgagggcaagagaatcagtgagtgccccttttgagtatttcaagcatgccagcttttggaatccccagtacagtgtcccttcacccctcagatttgagtctacttaagatggcttttcttttaaaatgtatgcattagattctgcttcgtgaaggctgcaagaagattctcgtagctgactctttgtccttactgaagaaaatgcaccgaactcaaatgaaaggtgttcttgttgatggtgggtaaaattgaaataatcatatggaaccacgtgccctgctttcagaaatggccaagcaggtataaacagggcataatccaaagtatgtgtgttttcttacagaggagaacatctgtgagtcgtgcctttcccctattcttccatcaggtaagaaggttttccccaaaaaaatcccaaacatgtattttaatgatgagtggaatcaaaattttggaattagccaactaccgtttataaaactatataactttcagaataacccagtggagagaagtgttgtggcttccatcctgctcagtggaatgctggtgctgccattgcttagagctgaggttctcaagctctagggtgagtcatcgtcacctggcaggcttattggaacccagatcgctgacccagtcagactccctagagtctctggttccaaacttccagggcaggaactgagaatgtatatttctaacaagttcccaggtaatgttgatgccactggttcaggggcccttcttttagaactgctagtctagggtaaaaacaaa

SEQ ID NO: 5019 - DNA, 1193 bp, Homo sapiens
cctgtatacttgaattgcatgtcatacgtaattctgtaatagtactttcatataacttgtatttttgctttggtttgtttttgttttgagacggagtctcgctctgtcacccaggctggagtgcagtggtatgatcttggctcactgcgacctctgcctcccgggttcaagtgattctcctgtctcagcccctgaatagctgggattacagatgtccgccaccacacccagctaatttttttctatttttagtagagacggggtttcaccatgttggccagcctggttttgaactcttgacctcaagtgatccacccacctcggcctcccaaagtgcaaggattacaggcatgaaccaccgcgcccagccataacttgtattttcatataacttgtcatgttttcatatcttattcttactgtatttctgagagcagggactcaattttattctttgtgttcattgtgtgcagcacacagttgattatcattaaattttgagtaagtgaatgaatgaaatggagaggtaggaatgttctgtggaataggtggaatgttaaaggtgggtgcagtttggataggtatagtggagggcattctaattattagtgtcatgacttgtttttacaagacaatgaaagatcggcatatctcctaaagaatacctagcttccaaattatttaccttgtgtttttctaggtctgaatttatattcccgcagtttagaactgctgatatctcctgaggtttgagaagaaagcaacattgatttgttcattctttctttccacaaatgtttattgtgctagtttctagatagatctgggctggccagtgcagtagccactagccacatgtagctatttaagttaattagtattacataaaatcaaaagtttagttctttaactgcactattcatgttccaagtgctctgtagctacgtgtagctactggctacattttggacaatgaagttacagaacattttcatcatcttagcattgaataatgtccatctaaatactggggatattaaacaaacaaacatctggtccctgactcaacctagtttctggaaccagaagaatcagcaaacactgccagaactgaatcagactaatacatgaatgacaaacctgtttctgcctagagatttttctttattgttagttaatctgtaattgttgga

SEQ ID NO: 5020 - DNA, 1182 bp, Homo sapiens
agtcacttgagcctgggaggtggagattgcagtgagccaagatcttgccgctgcactccagcctgggtgacagagcaagactctgcctcaaaaaaaaaaaaaaaaaaagttattttaggccgggtgcagtggctcatgcctgtaatcccagcactttgagaggccaaggcaggtggatcccttgagcccatgagtttgagaccaatctgggcaacatggtaaaatcctatctctactaaaaatactaaaaaattagccaggcgtggtggcacacgcctgtaatcccagctactccagagggtgaggcacgagaattgcttgagcttgggaaacggaggctgcagtgagccgagatcgcgccactgcgctccagcttgggcaacagagtgagactctgtctccaaaaaaaaaaaaaaaaaaagattctaatgaccttctaggtgttaagattctttctccttcagttttttggatagtaaagaattggaggctgggcatggtgactcatgcctgtaatcccagcactttgggaaccaacgcaggaggattgcttgaggccaggagtttgagacctacctgggtaacataaggagaccctgtctttacaaaaaaaaaaaaaaaagatgaagaattagagatcacatgatctaaagaaggatttcttgtctagtaattatttgccttttcagttgtcttaccaatgcttatgaaatgacattttctagtacttgttactgtttcttttcacagcacatttaatccagtatacctagaaaagattaggaaatcagcatgtaatatcagtgctactttgccagtccatttttaaaattgtttcttaattatgttttttaagtattttgccaaaacttggaactataggtttatcccactcaatttatgggaaatgcctaccttatattctaatcataaactgtgtccttattgtaaagcaaatcacctaaatcagacttaattttatcagaacacacctgactgcattttttcattaaaaacaaacatgttaaaaacacattcaaggaacattctgtaagctatctgtaacaaattatggaatgtatcttgttagatacattactaaagcaatcaagtaaagagtatcagattgatccaatatttaaataaaaacattttataaacaatataatataatatctctca

SEQ ID NO: 5021 - DNA, 1152 bp, Homo sapiens
gtgtgtgtgtgtgtgtgtgtgtgtgtgtgtgtgtgtgtggtgtataaagggtcatactctaacatgccatgccatgaagtgcccacataagtcattcacctcccatgtgagttttctaaatgttccgaaacgtatgtatggaaaaataagctggcccaatcagtgttttcacatttacctctaactctacagcttttatcattgcacagcctgcatcccaacaggcaacagttataacaaatgtttcaccactgcataataaaggtaatcctgtttccaaacagaaagagttggaacctcacagccagatgtcctatctctttcattcggccaactctacattttaggacgtgttctctaaagcaccccttcttggttcaaaaaatgaggagttctgtcagccgtaagtgatagaacacttagctaacagtggtataaaaacagggtttattttaatcactcaccaaagtggtaggaagttgccaacattaatttacttacccaacagtgtcataagggacctgagctgtttgcttgttttcattccacaatcctctgctgtcagcttttcaccctcatgcatgtcacatccctgctgtaagatagctacctcaaccccagacatcatgttcatagcagaaactgggaggaaggtgctgtgtgatgaactctctttctacctgctccttttataagacagcttcctcagtagactcctgtttatgtctcactggtcagaacgagttccatgcccacttctggctacaagagaggctaataagaacgttcatatcttgcttttaaaagatctctatagcaggagtcagtcaaaagagaatggggttggaaatgacgttgggttagtagctgtatctattgctacataatatacccccaaatgtagtggctttaaacaaaataagtgtttcttatttttcacagtttctgtgggtctgaaattcagaagcaatcttgggtgatcttgactgttacatgttggcctgggctgcactcatctgaaggtttggactggggttgcaggtgctgcttccaaagtggcccagggacatggctggccagcttgacctggctattagtggtcagcttcagtttctccccagtaaacctctccacagggcacagccgctggct

SEQ ID NO: 5022 - DNA, 1211 bp, Homo sapiens
ctcccaggtgctttgacaggttcacacagcaggactgggtgagattactgactttgtatatgtctatgacatttacacacatttgggtatttactgtacatactttaaaatagtggttaggtgctgtcattttcatgattttgacagttgagaaaccatgttagggagagagctttgtgtgacaccctaatcagaccgtgaagggacaggtctgagttgttcatagtgcagagcgaggcatggccacggtacacagcacacaggtgataggcaaatatttaatgcactgagccttttgtgtgtaaggataattagttactttaaggtattcggcatacacttttacatttccatattttaattggactttactggtcactgtggggcatagatacaactgaactgttcaatcctaatcaaataaaactattagtacattcttatacatctttttgggacaaagtacctcctacttacagagtatccaatgtaaattttttatggacaaagtaaatgtttataaatattttggcattttataacttttcctagcatagcttgagggctgataagaaactcagcagaaacaggctgtggttggcatgaagacactctctctctctctctctctctctgctctaggggattttactcactttgggacaaaagcaatatagtagcatcttttcactgaccaaggtaaccagagtgttgatcagatcacactgatacctacaagtggccaaaattaaatgacaagcatggggggaggtgccaggaagtggcaggggtatagagtgtgagagagaacagatgcatgtgagtgtggtgtgatgagggaagcagctcaagagctgacacctaaacccagaataatttcagaggtgaaaaattaccacctctcttactagtgacattgaagagaaaaaaaattagggtttttcactgatatgttactagtatttaggcaaaaacacaacagaaaccaaatcaagtcactataaagcagtaagaaaatatttaaaaaagacattatcaaactttagtgaatgttattctaagtctcgaaaatttagatgtctgtttagactaaaattttgccaaaaacaaatccaaagtgaaaaagtagcaattttagtagacattaacaaacattatgcagatatagatacacatatgaataatgcaagagatttacagaagtgtagttt

SEQ ID NO: 5023 - DNA, 1139 bp, Homo sapiens
aaaaagaaagctaataggttcttatccatctgctttccaaacaacttaaccgcatgttagataattgtatccttaggttttattagtcttataaggaaacatattataaagcaaaagaacttccttctgggcaccagagcctacaaaaacagaaatctggtatctgctttgaaaaggtcagtttaaccctcttagcattagcaggcttaatgccattgtggttgtctacaatgaaggacagccatgagctctcttcctacattcttaatattcattgaagagaagcctctcaggaaaaaaaaaaaaaaaatgagcttaaacatgctagtagagtatgaggtcttcagttgttacaagttatctctattctggagttgtttctttaaaaacatatttatgtgttctttgagtagattatacagtgaaaagtgtctccctgagagcacttttgtcagtgtgttcagataaatattccaatctctacagtcttttaaaataaatggcagagcactgtacagttttgtgcttttgctctttaagttacacactgtcctattgtctatatgttgtgaatttatgtggtgcttcctatctgtctgttctctgacaacttttactttatcttagtgtttgaattttgtttctttgctatggccaaattatagaaaaccagggcttaggttggccatctgttctgaagtaaaagtaagtgtagagtttgaattaatggagaggcttttctaatctacctgataggaaatagtattatgtagtgaagtgctccttgatttctatttgaaagccgctatctcgggtattttttctgttcacatttacttcctgtgcacttaatgcctttatgggtgattctgaacaggctggaacttgatcactgcagtagacactgtctttcctgttctttgaggatagcagtgatgtacacttgcagtccactgtttcctgtatatccattcatcactgtgactcagccatcgactccactaactaccttaatgatgtcttggataatgcatcagaggaaaaggtgactttttgaggaagggcccccagtacatcccataaagagacaggatagcccagagaccagagaaaggggtttcctagaattatacaaactg

SEQ ID NO: 5024 - DNA, 1162 bp, Homo sapiens
gtttaattgtctgtattcccctcaggaccaaggaaaattccttatatcttgatactgtttttatattcttactgtctgaccagatcagaccctcagtaaccgtttgctaaacaaaagaaggaatgaaggtacaaatatgtatccaccttgtctggaaaaatagcaggaaaggcatgcctgccaaggacttttacactgaacagtaagaatatattttagctcagagacactgtttgttttcacatttcaatattgctttaattagatatcttaaagctcgtgtaccacagtggttgaaagagcagatgctggagccagactgcatgaatttgaatcccagttctaccacttattcacttattagtgcacctttgggcatgttacttaacctttctgtgcctcagtttactcatctgcaaaatgagcgtgatgataatagttcctacttcaaagggttgtgagaattaaatgaattatataaagtgcttagaatagtacaagacacataatagtcagagacagaagtattaggtattatcaatattgttaaagtccatgtataagtttactgtactattgtttctttttaactctgaagtgctgttttcactctgtcacgtacagcttttattgctagcatcttgcttctgcaggtccagcctcctgttgattggccctgtgtttgtgctgtggtcaaagcacttgctgtctgcggttctcccttgtgcacaccggttctttggttgctgtaacaaaaactacataggacacagacaggaaacccgcaggctttgttttttcttcctaatttggcagcagaagggggaaaaaccagggcctttcacagacaaggcttgttttagagtttaattttaacttcttgttcgtgttctaaagcttgggttggtaataaatcttggctgtatgagactagagagaactgggctttaaaaatatgattttaatgtaaaatcttttctaattgcaggacaacttgcctttgatgattttcaagagagttgtgctatgatgtggcaaaaggtaatggaatgttccagggccaagttccccactagaacctgccagggtattctcgagttagacaatagaagaaagtcactccctgaatagttatgggcttctcctggtctttagggttcac

SEQ ID NO: 5025 - DNA, 1160 bp, Homo sapiens
ccctagatagaatgggtttacaggtattgggtaaatatagtcattccaaataggagaaattggccaaaacaaaggggtttcagggcccatgcaagtctgaaatccagcggggcagtcaaattttaaagctccaaaatgatctcctttgactccaggtctcacatctgggtcatgctgttggagctgcctatggtcttgggtagctccacccctgtggctttgcagggcatagcctccctccaggctgctttcataggctggcattgagtgtctgtgacttttccaggtggatggtgcaagctgtcagtggatctaccattctggggtctggaggatggtggccctcttctcacagcttcactaggtagtgccccagtagggactctgtgtgggggctccaaccccacattttccttctgcactgccctagcagaggttctccatgagggccccaccccgcagcagacttttgcctgggcttccatacatttccatacatcttctgaaatctaggtggaggttcccaaacctcagttcttagcttctgtgtgcctgtagactcaccaccatgtggaagctgccaaggttgaggcttccactctctgaagccacaacccaagctctgcattggcccctttcagccacagctggagtagctgggacacagggcaccaagttcctaggctgcacacagcatggggaccttgggcctggaccacaaaaccactttttcctcctgggcctctcgtcctgtgatgggaggggctgccgtgaaagtctctgacatggcctggatacattttccccatggtcttggtgattaacattgggctccctgctacttttgcaaatttctgcagccagcttgaatttctcctcataaaatgggcttttctttcctatcacattgtcaggctgtaaattttctgaacttttatgccctgtttcccttttaaaatggaatgcttttaacagcacccaagttaccttttgaatgctttgctgcttagaaatttcttctgctagataccctaaaaatcatctctctcaagttctaagttccacaaatctctagggtggggcaaaatgctgccagtctcttgctaaaacataacaggagtcacctttgctccagttcccaacaagttcctcatctccat

SEQ ID NO: 5026 - DNA, 1211 bp, Homo sapiens
ctgtccaggtctgggcctcccttgggtcactcagttctcccccattcattcattcattcattcactcactcactcactcactcactcactcattcccacactctgcagccactgacttcagctagccatgctggatgctaagacatagagtcccggccatcaaggccagtccatctcagtggcatctagacatgcacagagatgaccagggagcccttgagggacagagaggcacaccctgcctcctgatcccatctgggggctgcatgaaggaggggcacaggtgtggccttgaaggctgggtaaggggctgggagggctttaggggcattccagggggcaggcacagagctggaggctctgccaggcacacccacaggagagcaatggctggagggtgacatggactgcagggtgtggccgcggcagcccagctcttaaggggacagcctgggaaaacagacttagggacaatgatcttgagccatgaaatgatgtccaatgccccttgtgccacctgacatcagcctgattaatgaacaaacagaagaggaagcaggggacctgtgtgtccctctctctgcttttctgtctttctccgtgccccctctcttatgtctctcacgctgtctcttgtccttgtttttaactctgacacgccgtgggaactcggctcacttcctagggggaagctgtctggactggcccagagatgggcaccaccatttcccaataaacacaagataaaatcagagagctggcgtcagttccacggctggactcagtggggaaaagggcaaaaagcagcagaaataagagcagggaaagaacgggctgggtgcgatgggtcccatctgtaatcccagcgctttgggaggcctaggtgggaggatcgcttgagcccagaagttcaagaccagcctgggcaacatacggagacccccatctcttaaaaagttttaaaaattagctgggcatggtagtgtgcatctgtggtcccagctactcaggaggccgaggtgtgaggatcgcttgagcccaggaggtcgaggctgcagtgagctatgattgcatcactgcactccagcccgggcacagagcaagaccctgagaccttgtcagaaagaaataaagagagaaagagagaggagagggagagggagaaagaaagggagagagagagagagagaaagatgaaagaaagaaaaaga

SEQ ID NO: 5027 - DNA, 1178 bp, Homo sapiens
tggtgggctctggccccaagattatacctcctgtctctgcattccagcacaacctgctcccccagcctcctcggagtaaatacatacacccagatgacgagctggtcttggaagatgaactgcagcgtatcaaactaaaaggcaccattgacgtgtcaaagctggttacgggtagggagcccaatgagaggatgtgggtgatgcaggtgaagagcccagcggtggtgtgttagggatggtgtgagtggggagcctggggggagtgggggggtgtggcctgggcacacgtgtgttcttgaggaggtaggtgaggctccaggcggtcggaggccatcagattgggtgagacctggctgggagatgggtctccccacctccatccaagggcagtgactccaggaagcaggcatgcatcctggagtcctaggtgagaattcaccaatgtggttgtggagaactggcttgttttgcccgttggggtgactggaaggagtggtagcacctggggctccctgctcaggcctgatgccactgctccccagggactgtcctggctgtgtttggctccgtgagagacgacgggaagtttctggtggaggactattgctttgctgaccttgctccccagaagcccgcacccccacttgacacagataggtgagcagcagttctcgggagctggaaccagctcatggtcagtggaatctttgagttgcacctaggaggggctgcctcccttctcggcaccctggaggaccccaccttctcccgcaggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggtatggagcccacctggctgcattcagccccagcccaggagcctgcaagcctgtaagaccctccttccccagggcgagtagggtaccctgtgaggtctcgcaggtcggtgggaagcgccctgcagtgactctggggcctcctgcaatggggctcctcatgcccaggccctcgctgaggatggtgggaggcttgaagggagtgagg

SEQ ID NO: 5028 - DNA, 1661 bp, Homo sapiens
ggatcttatttgtacattaatgatattaacactccagtggggggtggggagtccctgatgctagggctggggtgggtggagtttgaagactcttgggaaagcctctcctggggccactgttgggggtgggagtgagcccaccacagaggccacaggcaggcccccacttcaggcccaaggcctggggcggggggaacagtcactgggtctcagattctgagactgttgtttagcttacctttctgctaggattggcttcccgcagagggcagggcccatcctaagcagcttccaagtcccacaaaggtggcttgtgggaggatttggaaggagctgcattgtgggcggggagtgtgtgggttgggttcgtaccagcaagtagactaggaactgagcccaggaaagggggatgttttcctggtgtttggatggtcagctgggagtgtccatcatcaggggaagatcaaacacaggtgcactcagctgcccagggcctctgggacacttgccttgacttgcaacttgccttgaacatcacgatcaaagcagcaggtgctgtggtctctcaaaattgatttttatttgactctgtggctctaagactgccttgaaccgcctgaggcctatgcatctgaacaagtgggtctctcccttgagcaccaggagtgggtgccagccggccccgaggattcccagcaccccacctatggtcttgccagcataggcttgctagttccttcttggtcagaggtagctgcagaggggggaggccaagggtttggtctaagctgtgccctgccacctggcaggaggcccactcactgcccaagtcatggcaacaggctggagcagcccaggagatgggcctaaaatgttctggatcccttgggtcctagtgttatgttccagtctgcccacctgtgctcaggatgcagccctgggatccagcacccatggaagcttctgctgggatggtgtcacctatgggttttgaaccagtgtggtatggtccttgggagctctgctctgagcttgccacactgctgagagcacccactgtcctgaccagagtctcagtggtcctgacccccaatgtgggcaggggctgggcaggagggtggggtctgctgtgggttcagaggactccacctcctggctggtttacctgctgctgcccattttctctgggtactgctggccagaggactttagcctacccctgaagagcctgtccatgtcattttcctactgccatagataccctaagcccagggccccttgaggcccagactcagcctgcccactggtgccggagacggagtggagtgggcctggatccgagggatgctacctctccctttcccacttgaggaccctggggagagatgggggcggggaaaatggaggtatgaatttggggtaagaggaagtgagatctccgcttgcaggtcagcccctgccttgcagggcgggctggcttgactcaggccctgtgagatagagggcccagcccagccccacccacagatcccctgctcctgttgtgttctgttgtaaatcatttggcgagactgtattttagtaactgctgcctaacttccctgtgttctatttgagaggcgcctgtctggataaagttgtcttgaaatttcacagtggtc

SEQ ID NO: 5029 - DNA, 2101 bp, Homo sapiens
acgtggtcttcttgctcatccccttataaatgtgctttgcctgcctcagcctcatggtcagagcagtggagactggagccctgtttgcacgttctagttgttcggagaaagcctaggttctgggctcaggtccagatgcagcggggattctgttctctgactgtggcgaccttgctttggttcttgttgaagtgaaccaagcccggccaccacgcatggcatgctgtgcttggctccccataagacgtcctctttgggtgcacggtgtcaaagtgtgggcaggagtggagagctggtgccctcaggaggagaccacagcatgtccatcagctcagcagagctcgacagccacaagtcctgagaagctttgaccttgaagggcttctgggagaggaggaatttctgcatggggcgtgaaggcacactgtcccaccacaactgaaccagaagagagtgaagactcccctcttcccatcctctgtgccaggtgccagactgtgctccttggaacttatggcccaatcttacctgttctccagggactggtcactgcctcaggacccccaagcctatgccctgagccatggctgctgactgactccagccaaggtgcaaagacgagattatgagacaggtcctcaggcctgtgttccaagtactcacaggggctctgggtgcccatcgccgggagtatggttcagctgccaccggcactgtccatttgcctgtctgtcaagctcagagcatggataagccacacagcagggcagtgcaccctggcaccatgcacggccagcaagaatcaaggcccgcagatgctaagagggcctattgtcaggggaaggtccccgctcctgcacactctctatggatacttgggttgtgggggctctcttggagagtaagtttgtggtttgtttctggtttacagtggtggctgacaccccttgtaagaaagcattcctgggaagtcttctgtgggtccaaacatgttgctccgatcatcacaggagagcaaaaggccctagataccccctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgccctgctttaataaacagcaaaccaatatctaggaagaatgactgagggatagtattgggtattggccccatggcaggaacagccacttgcatctggtcccggtgccacactgcggtgcttggtgtggttgtggagcctgtccctgcgcgccttgctcccgttgagccacgctgtctggtgggtgattctctgccctgagccaccaccctggactggcccagtctccagagctggcacaccctgcctgttttctctttttagacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagcagttctgggtctgcgtgtgacatttgctgctgagacagttctgtctgtgcatggtcattattgttgcattctagccttgaggtcccaggccaacgtacacagcaaacaccagcatggggaattcttaggggttgtttcccatctggtctgaatgcactgggcaagatctcaatacagctttagaaatcctgtaagattttgaccagtggggag

SEQ ID NO: 5030 - DNA, 1297 bp, Homo sapiens
tgggaacggcgaagcgcccactccaagacttctgctagtgggtggccagaaagaagccatcctctctcccttcctgactcaaattgtacaactgctcaaaggaagaaaaagaagccagaggttcctctgcatcagccagaggccaatcaccctgatccaggctgccaagttagaacccaagctcccagatcaagggacaagtcagaggtggagctctttgatcaaggggcaggtcagagatcaaggtccccattgaggcccggcagggacgaggcaaaagactggggcaggctggcaatcttaaaccccatttgccccaagcccctaaaaaaaaaaagtattccataaatacttgctgaatccaagaaccaaacctagtacttagcttatactgaaagctttaattatactatctcatttaatccttacaacagccctttaattgttatcaccctattgtatataagaaaaaaactaagacctcagtaaaaaaaaaaaaaagaaaagaaaaggctctcttcctcggcgctgcctacggaggtggcagccatctcctcctcggcatcatggccgccctcagaccccttgtgaagcccaagatcgtcaaaaagagaaccaagaagttcatccagcaccagtcagaccaatatgtcaaaattaagcgtaactggcggaaacccagaggcactgacaacagggttcgtagaagattcaagggccagatcttgatgcccaacattggttatgggagcaacaaaaaaacaaagcacatgctgcccagtggcttccggaagttcctggtccacaacatcaaggagctggaagtgctgctgatgtgcaacaaatcttactgtgccgagatcgctcacaatgtttcctccaagaaccgcaaagccatcgtggaaacagctgcccaactggccatcagagtcaccaaccccaatgccaggctgcgcagcgaagaaaatgagtagacagctcgtgtgcacgttttctgtttaaataaatgtaaaaactgcaaaaaaaaaaaaaaaaaaaaagaaaagaaaactaaggcccagggagacgaaagaatttgtttgttcaatgccagacagcttatcagtgtcagagctagcaactgaatgcccggtctctagactccaagattcatactcttattccataacataatttttttaaaagggggaaaaagactagaatcaggaagtaaaaagataaatgtaacagtttcagagattaaaggagcaaaccacaaggcaagagacaggtatcctccttgctcatccactgggag

SEQ ID NO: 5031 - DNA, 1160 bp, Homo sapiens
atcccagctattcaggaagctaaggcaggagaatcgcttgaacccgggaggaggttgcagtgagcagaaatcgagccactgcactccagcctggggggcagagggagactctgtctcagaaaaaaaaaaaaaaatgcaatttagttctctaggcttttccatttaatagttttatatcctcctgtttctaaatctggatgacagtgtaacactccagtaaggtgaattgtgaattgctgaaattcttcagatgtttaaaagagttttcagtattcctcatgttagaattaatgcagagaaaaattttatcctttgaactagttacatgttgtggacttctggcctgaggctcttggggattatgtgacatattgggaagggacacatttctgctctgtggctgttactagaaatctagccagcaaatcagactacgtttgtgagaagacaggaaggcacagattagggttgagccagccttcaacaggtttggctggcagtagacacagtggagcacatcttaactattttggtaggtcctgggtttctcttggtagtttttgatagaaaggggaatggtgtgaggaaaaagtgggcatacatttcacctttccactgataaggcaggtggaattgggatagtcagtggatgggccaatagctggtggctgtgagaagaataaggatttccatactggtgtgtcatatttacagataggttgtgacctaaaaagttttttaaaaaacagcagttagggcctgggcgcggtggctcacgcctgtaatcccagcactttgggaggccgaggcgggcggatcacaaggtcaggagatcgagaccatcctggctaacaacggtgaaaccctgtctctactaaaaatacaaaaaattagccgggcgtggtggcaggtgcctgtagtcccagctactcgggaggctgaggcaagagaatggcgtgaactcgggaggtggagcttgcagtgagctgagatcatgccactgcactccagcctgggcgacagagtgagactccttctaaaaaacaaaaacaaaaccaaaacagtagttagggtacacacacacaaattctagtgattttccccccaatactacccttgacttttgaaattcttgctttctcagagtttacaacatcctt

SEQ ID NO: 5032 - DNA, 1666 bp, Homo sapiens
ttaacagttgaagatcatcctattcctatccccagtaaaaataggcctttccacaatcttctaccagttaacttagctttttttttttttttttcctttaatagagtctcattcttgtcacccagactggagtgcgatggcacgatcttggctcactgcaaccctccctcccgggttccagcgattctcctgcctcagcctcccaagtagctgggattacaggcgcacgccaccatgcccagctaatttttgtatttttagtagacgtggggtttcaccatgttggccagactggtctcaaactcctgacctcaggcgatccgcccgtctaagccttccaaagtgctgggattactggcaggaaccaccaggcccagccaaccagcatttcttaaggtgaaaatacatggtgttaatttatattttgagtgagacccagtccagctgctataactgcttggacacttggcagaggacagagtactgcaaaagtgtctaagggagacagcattttgccttgggtgctgtagatgtacaagagaggttccaggagggggtgataggcagaattttggtccccatcaccttccctgcccagtgttatgcctatgaatgtgttacattatgtggtaaaagggactttgcagatgtaactaaaatttctaaaatagagatattatcctggattacctgggggaacccagtgtaattacatgaacccttaaaaatggaagaggatgcaggagtcagattcaaaggaaggcccaaggtgctattgctgacttgaagatagaggggccatgtggaaatcaagagaaggaagtgaatccttccagtgagcttggaagaaagcaccttgaggcacagatgagaagcttggccttacctgatgccttgattttagcctggtgagaccctgagcatataaatttgctgtgctatgccacacttctcacctacagaaacttagtttaaagccactaagtttgtggtaatttgttggctttaggcccctgagggtagagatttatggcttgtgttacaagtagagagcagtggagagttgggctttgtaattctttcaagggtgattgtagttctggagtcctatctacctgggttcagatctttgttggccagtccctggctgtgtgacttcactgctttaagcctctgtcttcatccttaaagtggtgatgatagtacctacctcactctgatctctgaatgagaacacatgtaagacacttagcacagttcctggtgctcaaagagttccaacacctgaaagcaccatggccctgtttgtttttcagtcaagatttctaaaagccgttattaccagaggttcagtgagaacatgggcagggtaaactcaaaatggagaacataaaaactgggactcccagaccagtcacttagaagactgctgcaggaagtaccaaggtcgttaagaatcagtaataataataagtaatgtgtgaatccattagaatgttgagaagtagacctttgacatttcagaaaaatgtatatctcagacacagccatatgtattgttatccctgagttggaagagcatcacagggcatagtttcacaaaagcttcaaaaaatatactaattgctggtaatatgtgaactaacagaaaaaaatagccatgtta

SEQ ID NO: 5033 - DNA, 1162 bp, Homo sapiens
gctggcattacaggtgcctgccaccatgcctggctaatgtttgtttgttcttttgtttttgtttctgagacaggatctcactctgttgcctaggctggagtccaatagcctaatcttggctcactgcaacctcagcctcccaggcaactgggactacaggcatgcgccaccatgcccagctaatctgtgtgtgttttttgtttgtttgtttatttgtgtagtagagatggggtttcaccatgttggccaggctggtctcaaactcctgacctcaagtgatccacccgcctcagcctcccaaagtgctgggattacaggcatgagccactgtgcctggcgtagaaagtatttcttataattaaaaacaacacccagtctaactagtataacacctaaaaaattgtcagatctgtattttagatagtacgacacagtgaaatgcaatggcacttaagcagagagaagaaggatttttctttttctttttttaaatagaaggtgttagaacctgaactgggcctggtttgcatttgggaagagtccagtggggaaacaacacaaataaggtcttgagaatgaagaattgcatttatatagggagttgtaacaaatggcctggagagtatctgactctttatgaaacatttaatgagaaatgtgacttgctttggtgcctatggttgaatttgttgcgatgcttctgacattatgaaaattttcaaacatgcaaaaaagttccagtagttatccagtgaattcttatactcaccacctatatctatagttaacattttacttgtattttatccagttatcagctcatctatgagatggcccttatttatttgcctgctgtttttattctctatttgtcctgttatttcttgttagagaagagaaggtgttcttagatcagaagatgccattgtattaggtgacggcaaggttttgctgatttagtggaacaagattctactgggatgtgtgctgagctgaaccaaggaactgcccgaatgtgctgaacaaggacatttgcttctcagatacgtgaattcaattttaagcaagattcttgatctgcttcagagcagctttgatttaaagtaatttcagagcgcttttccttgcatgagtaattttctgaatgtataaaatattctat

SEQ ID NO: 5034 - DNA, 1092 bp, Homo sapiens
ctcaggcccaagcaatcctcttacctcagccctgcaaatagctgggaccacaggcacatgccaccatacctggctaattttttttatttatgtaagagacagaggtctccctatgttgcccaggttggtattgaactcctggctcaagccatcctcccaccttggcctcccaaagtactgggattataggcataagccaccatgccctgcgctaagtaactgttacttgagttaatgtactagttaattgacccttagaaaattatatttttctgcttgcaagtcttcattaaagaaggaaattttaaaatattttatagtataatgctatccaaactcatttttaaaaacattttattatggaaattttcacaaatgcacaaaaagaatagcagaatgaagctctgtgtacccatcctccaacagctgtcctgtggtcagtcttgtttacctgcatccccacctatcccctgccccaacccacagggatcagtttgagtcccattaacaggcatagtattttcatgtctgtgtgatcagagacattcaaatataactccaaagatagggtacttttttgaacataaccacaataccattgtgtaagactgctaaaacattttttgatgccaagtaccagtcaatattcaaacttcctgattgtctcgtaagttttttttaacagttggtttattcgagtcaagatccaggcaagatctagatcttgcattttgttaatataatctatagatttaactttcctgtttttaatttttgaagaaactaagttgtttgtcctatagaattgtccttcagtggattttactgaatgtatcctaatgggatcatgtacaccttttctgtcccctatatgttctataaactgacagatctagagggcttctgttgttctgttttgctttttcacaaaaataattcataggtgatatatgctccatgttgtatcacatcatggcacataatggctctcatcttgtaacattaagattgatagtgggtttggatgctgccagcccactccattcattacaaaagttctctatcagcttttcccctgatggatttagccat

SEQ ID NO: 5035 - DNA, 1224 bp, Homo sapiens
cttactgtcacagcaactcctttgcaagatgccccggtaaatcacgttgcagagaccccaactctgccttcctggaactaggcctgcgttttctctgaaccattatttcatggggaaaatgaaatctacttcatgtgcctggtctacttactccttcagaagtgatttctgagccgtaagatacatgagaaaaaaatgaaggggaaaaggcagtatttatattaactacatgatgataaggatgtttctggtcacagtgaaaagccatgctagaattgtagtgtcatagaataatgtggaagtttagttcgtgttgtctgatctatttaataatttaataaggttatctcttccaagacaccttcccttcttcctcagccagaaaggatctttccctgagagtcattagtagctctgggctcctggaaccaagctcaggtgcctaattgaactctggtctcttcccacagcccccagcagggactggtgcttagtgagagtggactgccagattccttgagtgtgggggatttgggtgaatgagggtagcaagcctccagcgtgcttgggtctgcggtgaccctatgcattccttcagtgcttgctagaacagttttgaaacggtttgaggccttgccctgctccatccagagcaaggttatagaaatttcagacaatgacttcctccctcctggatctagtgtcctgggccttgtatagatccgtgccatctaatgtggtagccacttggcacacatgattaaattaaatttggagttttatttcattttcacactagccacatttcagatgatcagtagccacaggtggccagtggctaccatattggaccgcacagattagagggcatttctgtcgctgtggaagttgttttggacaatgctggtgtgaaaggtgaagggaatcctgagtgtttgctgtgctccaggctcagtacaaattttattttattatacacttaaagcaaaagtcttataaaagttgaggatgaagccaagagtggtggtaagggtaggagttgaaacagtgaagaggaataacagggaagagtcctgccctgagagactcatggaataggatatttacaaggcaaagcaaagagaaccaaagtctcagttctgcagaggagctgagtgccccaggagctagtggagggtgaggtcaatgtgtgctcatcttaaaggaaaaactcatggaagagga

SEQ ID NO: 5036 - DNA, 1224 bp, Homo sapiens; identical to SEQ ID NO: 5035

SEQ ID NO: 5037 - DNA, 1123 bp, Homo sapiens
gtaggctggccatcccacaggctgggaagcgtagcctttggcagagcctgaaaggtaggcacttcagaggaggaggggttggaacaggaatttgtgctgaatgggtttgtgctgaccaagtatatacatattcaacaggttataggaggagttatgaatattcatggagggggtcctgatgcatgtgtactgaacagacatgcaatttattttattttatttattttttttgagacagtttcactcttgttgcccaggctggagtgcaatggcgcgatcttggctcactgcaacctctgcctcccgggttcaagcgattctcctgtctcagcctcctgagtagctgggattactggcgcatgccaccaggcctggctaatttttgtatttttagtagagacggggtttcattatattggtcaggctggtcttgaactcctgacctcaggtgatccacccgcctcagcctcccaaagtgctggattacaggcatgagccactgtgcctggcccaaacatgcatcttttttttttgagatggagtcttgctctgttgcccaggctggagtgcagtggcgcgatcctggctcactgcaacctccgcctcccaggttcaagcgattctcctgcctcagcctcccaagtagctgggattacaggcgcctaccaccacgcctggctaatttttgtatttttggtagagacagggtttcaccatgttgaccaggctgatctctaactcctggcctcaagtgatctgactgtctcggccttccaaagtgctaggattacaggcgtgagccacctcgcttggctaattttttttgtatttttaggagcgacagggtttcaccatgttagccaggatggtctcgatctcctgacctcgtgatccacctgcctcggcctcccaaagtgctgagattacaggcgtgagccactgcatctggcccaaacattcatttttaaaagaacttttaggttcaggggtacatgtgcaggtttgttatataggtaaacatctgtcatggggatttggtgtatagattatttcatcacccaggtactaagcgtagtatctgacagttattttttccagacaggcatgttctttgcattccatg

SEQ ID NO: 5038 - DNA, 1694 bp, Homo sapiens
gaaattgaagattcccacacattagtgaccgtcatgatgaaggtgggacacctctcggagccactaatgaaccgcctggaagacaaggtactgggcctgaaagcaggtggcacccagcctgcctcccctgggctttgggcttgttctttgggtgacagttgtctgcagaggggtgcgttgtgtgcactgggatcagagccctgggagcttctgtctggagcctcaggcatcacatggggcaggaccagagggctcggagctgcaacaggtggttgccctgtggctgcattcatcaagcaccacttgctcctcccaacacaggcgcttccctgattgcacctttatctttcccccaaaccccatcacagcacgatcttgagaggggggcatggcaggcagctcctgaagtaacacagctactgcccaggcctggcttctggctagaactctcctggagatgtgctaacccctatcggctgtagccctgcagtcaagtcaaattcagtgcccgtttctgtcatagcgggggctggcccagatggctgccacagcaagctccacagctcatgggccctgggtcacctaccctgggacctggggataagtttggctgtggacagtgctccaggtccaggggttccctggggtggatgaggaggcaggccctgcacagtggtcctgtgtttagtcagctcaggcccagtctgacaggggctgtcacaggggctgcactggatgggaccatgggacccctgcccccagctcatctctgccaccccaggccattgagctgacctctgcgcggctgtggttgacagtgcctggagttggtggagcactttggccccaatgagctgcggaaggtgctggtgatgctggcagctcagagccggcggtccgtgcccttgctgcgggccatctcctaccacctggtgcagaagcccttctctctgacgaaagatgtgctcttggacgtggcctatgcctatggtgagccctttggacagaacggtggagagaggggagcgctggccctgcagatgcctgcagccgtgtcaaattcagtacctgtcctatgcatggtaggcactggcccagaaggctgccacagaaacactgtgactcatgggccctgttcctgtgtcccaggctcagggataaatttggttacagacatcaaatatctagacctcgaggctgaggtggggtggagctgctgggtgattgctgactctctccagctaaaccctgtgatctgctctgtcctgaaggcaaactcagctttcaccagacccaggtgtcccagcgcctggccaccgacctgctatccctcatgcccagcctgacttctggtgaggtggcccactgtgccaagtccttcgccttactcaagtggctcagcctgcccctgtttgaggcctttgcccaggtgagccagggcctggccccaactcagagaagctggcttcctggccatctgctgggaaccattgccttagtcgggaaagtaaagccagtctgaaaatgctcacttgtgggggcaaatacatatttcttgcattttggcttattttgaaagggctgctattcagttctcaaaaaagtgtttgagaactgtttcctctgttctttcactgaccattataagtgcttccatccattttggggtagctgtagcaggtagcagcatggct

SEQ ID NO: 5039 - DNA, 1694 bp, Homo sapiens; identical to SEQ ID NO: 5038

SEQ ID NO: 5040 - DNA, 1694 bp, Homo sapiens; identical to SEQ ID NO: 5038

SEQ ID NO: 5041 - DNA, 1196 bp, Homo sapiens
atcaagctgtgggcagggctgggctctcctgagacctcgttcctgggctacagacagccgccttccctctgtgccctcacagagtcttcccgctggctgtgtctgtgtcctcatctcccttcttataaggacaccaggcagattggattagtgcccaccccgatggcctcattttaacttaattgcctctgtaaagaccctgttttcaattagtcacatcccgaggtcctgggggttagggctttatgcattttgggggacacagtttggccttgacactaggcctggttactcctcatcccctgacatgctgtctcacagccgcccggacagggtgaggacgagctcctgcccggctgactccctgtgtccctggccctgcgctgtgggtttggcccgggcggcgtggcttttggagagctcttgctatgctctccgggcggcctaggccctctttgtgtgtgtgggatgtcaggctccacatgttgcctccttctctccctgcagctcggtgccaatgccttgctcttcgtcggtgtgaacatgtatggggtctttgtgcggattctgactgagcgttcacagaggaaggcgttcctgcaggcccggagctgcattgaggaccgactgaggctggaggatgagaacgagaagcaggtcagtggcttgggccagtcagcctagaggggttggctgtggggctggggaggtggaagaagctggcttcctgagcctcagtttaccccgtggtgacatgggccacaattcccattggtacatgttggtatttgaggctgtggaggagatgccctgaggttttatagttagcaaatggacaggcaggctgagtttgctgcccatgggatagtgttgggatggggctgctttggggacagcatttgggcgcacggacttccggttgcagctggaataggtcagctgcccagggaggacgaggcaggtcctggctgggcctcggatgaatgtgaccgtgcaggtggccctgatccactggcctgaggcttccaccagctctgcccttggctcagtgtggccgaccccagagcacgctggcacttctggaaggcagagatgcccttttgctgggagttgtagaggggtcacagtggtcatgatacagcacccacagcccttggggttcctccagtggccggcatcaccccattttcaggatg

SEQ ID NO: 5042 - DNA, 1210 bp, Homo sapiens
gggagtgtgccctgtgggtggggaggtcagaagccccagggacacccagatgggtgagaggtccacccttcctggggagaagcagctgctggggggaatctagcacattccagagggctgtccgtgatggtctgcatggcggttaagggaggtgccgtgggaataaagggagttggggaagatgccccatggagatggcattccagccggaccttgaatgatcatcctgtagggttggctcagtgaagcagacaggagggatggacccccgaaggggaaagaggccatgagcgaggtatggggaaagggagaaggagatcaatgtgagcctggtcccagccctcaagactgtgctgaccacgcaagggtgtggcctgggcgggaaggtggtggcccaggtgcagcatgtcttgccagcgctctgtggccaccagtgtctagaggtggtggagccagcagtggcgctcacagcctctgtagcgctgtctcttaccatgtgccttgcccttccctgaaggagaaccactgtcgccgcatcaagattctcggggactgctactactgcgtgtcgggcctcacccagcccaagactgaccatgcccactgctgtgtggagatgggactcgacatgattgataccatcacgtaagtaccccgtggggctgagaggagtggcctggggcatctacacattgaaatcctagaagctgagccaccttctgccccatgtgggctcccctctcagggtctcgctttgtcctgatgggtctgtctgaggctgcagagaatgatgccagcattaggaggatgctgggttcaggaaagcatgaaaggatgcttccgtgattccctgcctttacatttcgtgtgtggctgtatttctttgtccacaggaatcctgcatattgtcaggtatgcatgagtcatacaaaaataaattagtctttagcttagccagataagacatacagaaaggtttggccccaatctagctgaattctctattaaaaggaagtaaatatgtgtgtttctcttcactcagcaaggtaactgggtctcagatgctctctgtgtggggagacaggcttgggatcggggcaggtgagtcttcatggaatgaatattacacctgtgaggccaggcctgcccatttcttggtcagtcttatgttgtcattgtccttatcagagactgggatgaagacacagat

SEQ ID NO: 5043 - DNA, 1199 bp, Homo sapiens
tattaatagctccctctttctctctctggagtatcccattttagataatagatttaaaatgtacactatttttatagccacttttatatgaaatggttatatttagactctgagatatgagtaaagtgaatgtaagctgatatggacaggaaccttccctgtcttattcatcagtgtcaccctacatttaatacaatgcttagagtaaatatttgctgaatgaatatctagggcagagtctgcattttctggggtgttgagtgttaaatttttttctccttatattcatatagtaagaaactctaccttactttattatttcatcaatcgtattactttatagactagttggtggaccagataattagtaaataagatatgaattgctaatgcaacagatgttgggtgcagaacaggtcactggccattcagtgatcagggctcagaagacagcagcctcaaccatggtgtctgcggcattgataccactggggctggggcaaaccatgggggaagcagccctggaagatgtccagagagaggcaacacctgaagttctacaggggctatctggccagaatccgaaaggtttcagagtattgtccaggtggaaggatgtgagcaccctgcagagctcgtggggcagagctctgaacaggctctatcttggtgggaaaaaagagggcaggtgagaaaccaagagcagagcccaatcctcagattaaatcaaagagcagaatgctaggggatggggcgggcaacatccccgtgtgacatagaccctggtgcccaccctctgagatcccatcacaaatctgtaagactccagttaggttagagtccctgcacagcagcttgatatgaatgtcattctacggaactgtgggcattcagtgatctcaccccagccagtgttggtgcctgggaacaggtaggtagaggctacaggtagggaacaagcagcaccatccacaggggcggtgggaggcacaggcagggtctccaaaacattgccaatgcctcctagccttgttctgctagcaggagagggagagagggaggaacataatggcacctgcatgtttcaagaattttgtatatttgtattgcttaatctttacaatagcagcgagactggcattcttagccatagttcacaatgaaagttcctcagacccagcatggcacagccacctagc

SEQ ID NO: 5044 - DNA, 1099 bp, Homo sapiens
cttcaggttgggtgggggcttcctactgcctctctagatctagacctttgggtccacctgtatacacttatccagcatttcttgattctaggcctgatgtagccggagaaggagagtctgataggtgctgccttttccacgtggtggttttacctgatcccaaaagtatagcctgatgaatttcaatctcaactttggcctagatgcctctgcttacctggagcctggtacacctgtgctgaagaaacttggaatttttcttccggtagtccttgctactggggtagaatgtgcacttttctactttataatcccctctatgtcaaaattattattttattaaatttaagaataacatccatagcaggaatattataaatgcattgaatgaaaattaatttgcatgcagttacaaattacaaactagaggttctttgctataagggaatactccatggcagagccctcatgcagtaggtttaattcaatctatgttctcaggagtgagttggcccctaaggggatactcacctgtatctattgttctgacctagttgtatttctgcattgatatgctacaaaaagggatctctttggagcaaggagaataccgagcctgaaatgcctgggtgagagaattggagaaggtttagagagcttcacactcagggaaaaaaaaaaaaaaaaaaaaaaaaaaaagagaaaagaagaaaaaagcagagtgtgaaagtccaagggcttctgtgcatgttattagaaatgtgcatgtagcttggagtcttgaggctggacctagacatctctctgccttgcagatgctcttcctgagtttgctaccatcctttttctttctgctttgctgtggtgacattcagacatcagacaataaatggggtctgtgcacattaggggcagtgggtgggtgaaggctggaggaggctgtgtctcttctggtagagcagtcagcggaaacctaagtgaagaaaggaaagaagtctgtacccttgagccctgtcacacgttagaaaatggagacgggcttgagctgagcactccttgtcagaccccttcaggtgttactcacacaatgcaggggttc

SEQ ID NO: 5045 - DNA, 1201 bp, Homo sapiens
ccagtctttctaaagatcatgaccactaatgaatgattatacagtaagtcctcacttaccatcatcaataggttaggtttttggaaaccgcagctttatgcagaacaatagataatgaaagcagttttaccataggccaactgataaaaatgagttaagttcctagcatatatttctggtcaccaaaacatcgaaataaagaccaaaacacttctaaataaagaccaaacactactaatattaaacattgaaataaatacgagctatacatacatttaagaaagattaataaaagcaagtaatgtgatgatttacccagtttttccagttcagggtcacaggtggccgcagcctaccgtggcagcacagggggcaaggtagaagccagccctggactggcccccatcccattgcaggtgcacttatactcacccacatggggacaattcggacaccccagtgaccctaacatgtgcagtctggggacatgggaggacatgagcgcagccagagaaaacccatgcagacctgccgagaaggtgtaatctgcacagacagtagccccggcctgggataataagatgacgctgaacgaaagtcgttggaggacctgccattatcagcctgtaggctgaaaacagatgggaatctcagcaatcagactcgctctaacagcccacgctcagaggctccggctgtccatgctctgtcaggctttccctgcctcatcacgcctctccatgaagctcctgagtgaatgaatactgttattcttatccccgttttacagatgagaagccatagcctgtaagcactgatttgctggaggccacagttgaatccgcacagtgtcatgtaattgttttggggggttgtgttgttgttgttgttgttgttgttgttgttgttttgagacatggtcttgctctgtcacccaggttggagtgcattagtgcaatcatagttcactgcagcctcgatttcccaggctcaagcagtcctcctgcctcagcctcccaagtagctaggactacaagaacgctctaccatgcctggataatttttaaaactttttgtagagacagacagggtctcgctttgttgctgaggctggtctcacattcctgggctcaagtgatcctcccacctcggcctcccaaagtgctgggattacagatgcgagtcacggtacccataattg

SEQ ID NO: 5046 - DNA, 1152 bp, Homo sapiens
atatgtggggcctgcccagtgtcaccattatcaagatgggatacactgaaattgagggcatcacaaagccatatggtctgttttcctctggagttctacaagtaacttagactgtttttcaagaggtaagaaataaatgacttgcctaccagctgcttcgtgtctcggcttgtaaggaccttaggtttcataccaaatccaaataattttatgtggcaacctgaaagaccaaccatgagggaagtgatgcttatgatatggttcttacaggaggcagaatcatatctgttggatcaataggccctttccacagctggcatacaaaaagactaaatggaaaggaagaaaacaataacaatatgctttggctgatagaacgcttgctatgcagtgttaaatctccaggggctggaaaatgaatgataatggcagatatttatttcaccgcaagtgtgcgttcacattttgccatttattttccccccgcagtttattgctgtgcgtcattccctactcaggccaagcgcttctgatggacgggcctcttcctgacctcggacctttcccagtgtctcttctgccctggctctgattttcctgttgttcttcctcctttcaggataaaagggctcattgtatacccagaatttacttcctttggggtttacatataaatgcattaataacagagatttgtttgattgaggtttatatttttttgaaggaggtaaattatatgcaaattttaggttgataatattcacctgtctgaaattcactgatacttggaaatgttcctgtgaagaactctgctttattttaattcattattaattcatgtttttcttattggatattcagttccagaatttattgccaatttttcttaaaactagattgtatccataaattgaccagtatagtcaatttggatagaactgaaactttctgtctacctggtaaaactaagtgcctaaaaacatgaactataaatgtagttactaggaactcacaacttatatatactatccattcaatgatacataggacccaatgtctttgtgtttttgaggttttcctgttactgtgtactttgccattttacatagttcactaaaaagaaagaagtgggagaagaagggtgttctattc

SEQ ID NO: 5047 - DNA, 1256 bp, Homo sapiens
tttttctgtaaacagaaagtaaatattttggaatttgcataccgtaaagtcttaatgtctctgtcacatattctatttttatttatttttaactttaaaatgtttccaaaaattctcaagtcatgaagagtacaaaaaaagataataggattctgttcaggatttggcctgtttggaagcaaaactttatgtccttccttcccatgggcatccagtgttgagaaccactactgcagaagggtggccccaagaccaaagaacaaaatttagtagttgaaaagtggtgtgtctacaacagaagtaaaatgttgctttgtacctggtgtcttttattaagaatttactccccccatttctcacagagaataacagtcaggagtcattgtcacaatataatagaaatgttagcaaccagattcatgtaaggactaagtggtcctcatgaattgcattaagactgtattgctcatattacactccatcctctctgtagtttgctgggtagcggagggggtaagctaaatcatagtttctgacaataactgggaaggctttttcttaagtaacaatggaattggtttaattgggattgaaaactaaaacttggaactaagatagagaagatgtagtgtgtgtagaagggctgttaaaaatgtaaaacttggttgcattatttgtggaggctcaaacttgtgaaggctaaataccataatttttccatttgttctgcattttgattctgaaaagaaagctggctttgcccatttcttactaaaaaaacttgtaaatccaaaaaaaaaaaagttgtgtgtctatagaactgttctttacattcttatagttctttcaagtattctaatatagaccgctagggtataaacctgcctgtcttcctttacgataccatacacaaaaatatttctaacacatagtgtttgacatacatacacacacttatttataaacctatgaagtggacttgcaccttttaaggactattttctttctgggcatttccactgagagtgtaagtaataaatatttatactgccttttggaaatagagcaagatttgattgtgaaaagtgtacttctatggatacttggttcatgctaaggggaatagtgttcctcaaataccacggtagaatgatctctacgtaaaggcaacacatttgcccctacaatgtaaagtttagtctttataatttatagccacaaccctttgatttgctgactgtttttatgaaaaggat

SEQ ID NO: 5048 - DNA, 1218 bp, Homo sapiens
gataaacacaaataagccttttctgaaaagaaagaattggcattccagcctgaattttaggtatgcaaacctttggagcaaaatatgctgtatgttaacatagagaatttccaaaaagcaaaggggaataagtccaacaatgggcatagattagagcaaattcatattaaatttcttttgaaatactgaagttcatttttgttccagttcattgtctcgaattcttaccaaatgattttggagagaattgaattgatagaattgattattagaaaaatgagttgaaaacaaactatttagaacctacctctgttttttatgcataaaaaacagtatcagaatataatgaatataaggctaatgaagaatgcatgtgtaagacttgcttcagcaaagctaaggaatgttaagacaaaatttctcctaccaagtctgaggagcaagagattaaaggatctgaggagcaagagattaaaggatctgaggtgcaagagattaaaggagagaatcccttctaggtcttttggctaagatcaagtgtagaatctgcttttatcagtttaatatctggtacttcctctatcccaggacaatatattaagtggatttttggagcagggagatggttgaaaataatatacatatgcttaatgttgaccgtttgatcctgctaatcagatgttctgcataaaactggtaattgggtaacaattttccataaattgaaatgagaaatgttagaaacacacaaccagttaacagtaagtggcacaacaaaaacagcaaaagcccacatctaagcagcaagctgccatgctggggtgtaacaagctttgcctatgagctccttttcacttaccaactaacacagctgttgccaggtgcttgtttgcaataacgtctctccacttactgctgtccttccttctggacagtttgctttagcatttgctctgcctttatgtaactcagtttataatactgggcaaaaacaaggactctgtcagaaagtcaaagtggaagcagttttaggactagtgcagtaaacagtagagaatggctcctaataagtgggcacagcaaagcctctcctagtgaaagtcactgtccaaaaacattttctatttgcctgcacttggtgcacacatgtttttcagtatctaggtgagatcgtgatgttccgtgaatcatattcagaatatcaatgtaagttttctg

SEQ ID NO: 5049 - DNA, 1099 bp, Homo sapiens
gtctaagcgggaagatgcggctatacactggactttacgtgtctgggccatctcttcccttggcatttgggaaaagttcacttctcctataggagggagcagagaaacttggctgactgtttcagggcaaatgaaggaaccaaatgtctacggaacctggtaatattaggcagtcttccattcaagtcctatttggacactgtctctctgaaattttaagaacagaaaagctctcagaaccttcctgccaccatgttcgcacctcactgctccagcctctggggcacattctatcctttcagcctgcgactagcagcaaaaaaaattacatattttcttgctccatacataccttgaggtgagcaaaaaaattaaattttaaccatgaaggaaattgtgcacatccaagccagtcactgtggcaaccagatcagtgccaagttctgggaggtgatcagtgatgaacatggcatcaacccaccggcacctaccacagggacagcgccctgcagctggaccgcatctccgtgtactactatgaagccacaggtggcaaatatgttcctcatgcgatcctggtggatctagaacctgggaccatggactctgttcactcaggtccttttggccagatctttagaccagacaactttgcttctgatcagtctggggcaggcaacaactgggccaaatgccactacacagagggggctgagctggtttattcggtcctggatttggtatggaaggaggcggagagctgtgactgccttcagggcttccagctgacccactcacttgactgggacacaggctctggaatcggcactctccttatgagcaagatccaagaagagtaccctgattgcttcatgaataccttcagtgtggtaccttcacacaaggtatctgacaccgtggttgagccctacaatgccaccctctccgtccatcagttggtagagaacactgatgagacctattgtattgacaatgaggccctctaggatatctgcttccgcaatctgaagctgaccacaccaacctactgggatctgaactacctcgtcttagccaccatgagtggtgtcaccacctg

SEQ ID NO: 5050 - DNA, 1211 bp, Homo sapiens
actggctgttccactctgcagtaaagtgcttttaagtagtccttctgtatcattttcccatttctccatttctagtcccagtatttcacccacattctcctgtcagaattgagattatggctggtcatggtggctcacgcctgtaatcctagcactttaggaggccgaggcagatggatcacctgaggtcaggagtacgagaccagcctggccaacatggtgaaacccagtctctactaaaaatacaaaaaattagccaggcatgctggcactcgcctgtaggcccagctacttgggaggctgaggcaagagaattgcttaaacctgggagcggaggttgcagtgagccaagatcgcgccactgcactccagcctgggtaacagagcgaaactccatctcaaaaataaaaaaacaatttagattatatttttgtttattagtgtcatgctgtcattttacttaaatatttcaaaacctggatctgttggctttatactctcttctttaaagcattcccttaaatatgggatttcttgaccaaaaaaaaaaaaaatcccaaccaccttagtttcctatttctggcataccacctacgatgttctgcctggctgttttaacaaggagtggactgctgactgtacaccagatgctgagttaggtagtttctactctggtccatgacaccaggtgaacctaccccatctctgtgagttcccactctggctctttgctctggtacctggcttcatcgtttggacttggttttctgtcattcaaactcttcggctttttcaagttgactttgacttggctatccttcttgcttttaatgctctaagtgatcttaggtagaaaaccttgttcctggccgggcacagtggcttacgcctgtaatctcaacactttgggaggccgaggcgggcagatcacgaggtcaagagatcgagaccatcctggccaacatggtgaaaccctgtctctactaaaaatacaaaaattagccaggcgtggtgacgtgcgcctgtagtcctagctacctgggaggctgaagcaagataatcgcttgaacctgggaggcagaggttgcagtgagccgagattgcaccactgcacttcagcctggcaacagagcaagactccatctcaaaaaagaaaagggaagaaaagaaaaccttgttcctgttttagcctcactgagatctcttagcct

SEQ ID NO: 5051 - DNA, 1166 bp, Homo sapiens
aatccctctttccctgtcctcgattttcattgatcccatgttatttctgaacattcatgagtcacgcatcagatacatttaatatcagatcctaatttaaaaagtaaatgctactcttccaaaagtacacatgatgtggtcactatactgggtcataaagatgtatgggttttcagttagttagacttagaccgttttggaacttttctctgttaaccatttatgtatccctggtcgtatggagctccagtggtgcagtcggttagcacatggtacttacatacccttggtcctgtagccccagcatctggtggtgatcactagctaaatatcagagtcagcaaatagtgtgaacaggttccatttcttgcccttgatccccttttgcatccattgttgaatctgtatgatactttttcatcataatttttctattcaaaaagtgtgcaggttttagcttttctcttggtgtaaaacagttacactcttccctttgcctttccctgtacattagaatctataccataggaaagcttccatggaaccaagctccactctgacacccctgttaaattcatacactgccgtgacctgtcatggctttgtccctgtccctgcacaatgcgcgggaatgaattggttggtgtgttcggtgcgagactacgtgacacccctcccatccccttggcccattgaattgagtagaacataatttatgcttcgcattgtatctttaatttttattcttctgccatgttgatgcccttggggagtattggaggttggagtcgcttccagactatgttgtgttccagctgtcttcttgctccttcctgaaggccagcttgttctctgctcctgttacctctgcctgctggtactgcttgtgttgtctgcctctgtcttgaacattactttcctccctttccatcttccttatttcttctgtgttcttttctactattccccgtctctcattcttctgtctttggaaccaacagaatgttttttggtgatgtcgttttttttcccctcaaatggaaaatagtagacccatagctcccaaaatcctgggacctttggtttttctttatcatcattatactgattgaacaactcttctagatagttggggtatcagaaacctaagcttctgatcagcaggg

SEQ ID NO: 5052 - DNA, 1179 bp, Homo sapiens
ctttgctttccaccctcccttcactagcaggtgtttgtcaatagggagaaatttaaaagccacacatcattaagaaagaaattcttttgtatagattcccagacaaatataaataggttttgaattatctgctcttttgtagtctgcatgctacttctattgatgtgccatcaaacactgttagaagaatctaaaaatatagcaaattaaatttgtttgcattgccacctaaataattaggatgaccaagtaatttgtcatctaaacctggacacttttgagaatgaaaaggaatgctgttaatgattatgcaagctcaacagatgtaaactgggactgtctcaggccaactgggacctgttgattaccctattatagtattctgtaggaacatcaatgttactgaaatgggcttatatgtaagtatcagaagatttcatgagcacatttttttcactcaaaggaatttttggaatttcgtaaggcaagaagtgacatgcttctctccaggaagaatcagctcctgttggagttcagtttctggaatgagcctgtgccaagatccggacctaatatatatgaactcaggtcttaccaactccgagtaagtacagaaatataagttattccttttactcctctgtgaaaaagcacaagcattttgtaaggctgacaacagaacttgtgtgtacattctgtgatgtatgtctagcattatatgtatatatatgtatttttttaagactgggtctcacactgtcaccaaggctaagctcttttgctttttatggccttacacataatgcttattatttgatatttttctaaataacatatttgtttttaagaagaaagacctaaagtgcaggataaggtacaatatgtaacatctgttgtggttaaaggagagcagctaataaacactgtgactgttgaacaaattatataacatgataagagtaaaaggcaataatataacactttctagaaattttcctactgaggactagaaagaaagccccacatagcagcattattaaagtggctaatgcctgtaatcccagcactttgggaggccaaggttggaggattgcttgagccaggaagcttgagaccagcctgaacaacatagtgagaccctgtctctattaaattaaaaagtaaagttttggctgggtg

SEQ ID NO: 5053 - DNA, 1154 bp, Homo sapiens
cctgacctcgtgatccacctgcctcagcctcccaaagtgctgggattacaggtgatctgcgcccagctgatctgttgtaattttaatagcatcttgtaggatggcagctgatacagggtccgcttgtatatttctgcccttgaggttagtcctgtatattatgatattctcttgttttcaagcagcacatctgtgaacattctcggcaatctgtctgttagtgtcatttaccataatgtgtttagaaagtaacaagtgcagtaaccctgatcttgttttcagttccacttattcaggaaatggaatccagaatcatgatcccactgaagacctcgcccctccagtaaagctgtagagtttctatgtgcctacatacatttctgtgacaagtatttgtcgtaaattaattttaattgtgtatcaagtgaaaaagaaacactgaggttttaagctgctgtatatagcttgtgagaaacctcttttctttaaaatttacataatcacaagaaaggaaagaattacagttggactgattgtgacagtgccttgtcgtcctctttgaaacaccccgtgttgtccagtataccttataacactgagccacttctccccaccctccagaaggggtccacgttgaattctgaatcatcttgaaaataagattccaaccacaaaaaaaatttagccatttctttactaaaaaaaaccaaaaaacaaatctgttttataatcacagatttttagacaaatttcttgtatcaggaagaaatacaaattttgtcatgtttctcaagcagtttttctgagtagtttctgaggaggaacaaattacaagtgtacccaataactgaaaatgttttaactcactctcatttgtaagcagtccacatagtagacaatgggttttccaagctgggcaaggtacatttaatcagtaaatcagtttcacatcatgtattgtgatgtttcaatgtgagacacaaaaacaatggcttgaaacttgtgtatcatatgtgattttgaaatgaacaccttgaatagcactaatttttatttgtggtatttttctataacaaaacaagtagctctaggaaaagaggttttattttgtaaacgatcatttgtgacctcagacactctctggctaatatttt

SEQ ID NO: 5054 - DNA, 1188 bp, Homo sapiens
tatctgatttcagccagcaatattgtttttcttaatattattcttacactgttaattaaatgtgatttaaataatcttttaactctcggttattatagatgaaacagcctgcaaaaactcaccctacttcatttattccataatctttgtcctcctaatttttctattgcatcatttctgtattgtcagagtaggtaacgtttacattctgttttttctcccccaaacctgggtttatttagtcttagttttgcaatgatgtacactcaatgctcttgcttgtccctttgctgaagttccctttgctatccattggtgagtaatgtttattcattagcagtgtcctcaagaaaaatattcccatgcaagaccaggcacagtggctcatgcctgtaatcccagcactttgtgaggccaaggtggacagaccacctgaggtcaggagttcaagaccagccttaccaacatggagaaaccccgtctctactaaaaatacaaaattagccaggcgtgtattcccagctacacgggaggctgaggcaggagaatcacttgaacctacgaggcgacagttgcggtgcaccaagatcgcgccattgcacttcagcctgggcaacaagacgaaactccatctcaaaaaaaaaatattctcatgggaaaaatatccccagaattcctgtatgttcaaaactatcgtttgtagcctttgtgtgtgaatgatggcttggcttgttttaaaacaaaaaaatcgctggctcataactttattcatttgtttttttgagacagggtcttgctctgttgctcaggctggagtgcagtggcatgatcacagctcactgcagcttccaccctggggctcaagctatcctcccaccttagcctcccaacaggtgtgcgccaccacgcccagtgaattttttttgttttattgtagagacaggggttggggtgggtggggggaggggtggtctcatgttgcccaggctggtctcgaactcctgacctccagtgatcctcctaccttggcctcccaaagtgctaggattacaggcatgagccaccacgcccagcctctatatctttaaatatttatttatttatttatttatttatttttagagatatggggtcttactctgttgctgaggctagccttgaactcctggcctcatgtgatcctcctac

SEQ ID NO: 5055 - DNA, 1173 bp, Homo sapiens
ggtggtgcatgcctgtaatcccagctacttgggaagctgaggcaggagaattgcttgaacccaggaggtggaggttgtggtgagtcgagattgtgccattgtactccagcctgggtaacaagtgcgaaactccatctcaaaaaaaatgaaagaaaataaagataggataatgctaccatctgtgagttgttgggacacagtgttggttttgaaatgattcagagtggtttgcacagtgaacacccaagtgtgctttatagttcccttggctttgaccctgtgctagagcattcattacctgttcatctgctctgcattgaaaggaatatttgtccttttaaatgtattcagaaagccagcacattatattacctcgtgttcaaaggtatgatgatccagaacactccttcaataattacctgaactttatcatgaactatggttgcacctaattgaagatgcaagtgttaatgtgtgtttattttagggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggtatgtattaaattttgtctatgtctggtatagtatacctatatagaaaatctctgatagtagaaacatgaatatgattaccaatttcaattacaaggtgctgtgtaggttcatttttgtggcaatgatacctaatctgtgtctctaaaaatgaggaaattaaaataatagtatacctaaccaggttataaaagtaaaattgaagctttcattaaaaggtttataaagtggagatttttttattagaaagcttccagttaccagtatttttaataaaacgaggaatgttaatgttaattaatgttaatgtttgggaattatagatggagatttcagaaatgtaaatgacttcagctgttgccttttacatataatgtattctatttgctgatagaaaaagacttaaatcagtgtagaattgtaaaatgaaactgcctactttagccttctgaaaagcaacatgtttctgctgcaaattgaatttacttaacggttatgctcctccaattgca

SEQ ID NO: 5056 - DNA, 1099 bp, Homo sapiens
tcatctcaaaaaagaaaaatgtgactgcgtgaaatatcaataccttctcatttcagtgtttaatatattaaatacccatctgaaaatcaataaccataattttgtgtgtgtttaaacagcttaatcagagggcttgttttggaccacggagcacggcatcctgatatgaagaaaagggtggaggatgcatacatcctcacttgtaacgtgtcattagagtatgagaaaacgtaagtttatagccccttaacagtgaaatggagaagcttcgtattttaggcgagttacttttttgtgaaactttgtttcccactgtaaggacaataatgctcaaattggtttgggggagctataggaaacagtctctgaagatgcataaggggcaggattggagctcagtgaactgttaaatcttaggactaatccagtttcagaagctgctttcttaatgtttccctgctttctgtaacttttttttttcttaatagagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaaggtgagaatgaaaactcaatgtataaactaaatagtacgtatcatcctttttacttttaaggtgaaagatgttgaaattaatttttatttttgttacagggaattgaccccttttccttagatgctctttcaaaagaaggcatagttgctctgcgcagagctaaaaggagaaatatggagaggtatccgagtaatttgacttttactcattttgcaagtgaattgggattatttctttttccttatactttatttttgggtttttcaactgtatagttaattggcattaactatattcacattgtgcaccccgtcagcactgtccatctctaggacttttttcatcatcacaaactgaaactgtatacccattaaatagttactccccatttctccctcccccttgccccttgtaaacattattttactttttgtttctgaattcaatatac

SEQ ID NO: 5057 - DNA, 1205 bp, Homo sapiens
acagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctcctttctgttcttgcaatggtatgacgcacaaaagcaatcttaaggggaatgaaaactgtccaaaggttcagaaaagtagtgaaggggcctctggaacggccgggaccctcaacgtggttttccttaattccctgggcggtcctgaaggtggtgtggccagtcctccgcctcgctccgtcagtttccccctgctgaactattgggtgcggggcgggtggtggcgcagcctgcgcatgtgcataggggtcgactgccgctgcggtgcatgagggcgcatgcgcagcggggccgtgggtgtacgcggcgcagcgcggcagtcctgatggcccggcatgggttaccgctgctgcccctgc

SEQ ID NO: 5058 - DNA, 1205 bp, Homo sapiens; identical to SEQ ID NO: 5057

SEQ ID NO: 5059 - DNA, 1176 bp, Homo sapiens
tgttttcaccaaaatccaggaatagacaaaaagactgatacctggtatctgtacctcattgagtgaaaggagttaattaagttcctcaggggaactccggagattcagggtgtcttgttagttgtaggatgccttcagtagcttacaaacaaaaccataaccttcctggaacccagcactctggaaggccaaggtgggaggattgcttgagtccaggagttcgagaccagcctgggcaacatagcaagacctcatctctattttttatcaaaaaaaaacaaaaaacaaaaaacccatagccttggccttttgtcgctgctttcataatttggaaggcttctgttttattgagtatacgaagctagcattcttctaacttaatcttttctgtttgcaggattggcctaatgaagaagttcaacctggagagatggaaaatcagctctcataactaagttaatttagtataaaaatagaattgatagtgagggtataaagtgtaaccatcagttaaacctctcctgtcattcctggcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttccaaggtatggttcatttagtctatagtctctggttatgaaattagcatcctcccagatctgacagctccctgaggggttatataaggagtagctcacttgcaaacataacatgctgctcaattcaaaggttctagctgctgtgggtctggagttatgtaagctgagcagtagcaggaaactctgcttaaaatattgtttaaagctgtgcgtgctggcatgtgcctgtaatcccagctacttgggagactgaggcgggagaatcacttgaacccaggaggtggaggttgcagtgaactgagaccatgccactgcactcactgacagagcaagactctgtctcaaaaaaaaaaaaaaaatacattgttttaatcaggtgaatgataaaggaaacaggaataggtctatttggggtgggttccctgtggctaggtcagcactgcgtatcactattcctctactgtttccaagcaagcttgtgcaacccaccttttg

SEQ ID NO: 5060 - DNA, 1136 bp, Homo sapiens
ctcattgatattctgtcttgctttatgtattagtgaaagtgggatgttgatgtttccttccattattatattgctgtctatttttgcttcagttccgtcaatgtttgctttatgtgtttgggaaaactgtcttgtatttataggttctcagtgaatgaaccctcttattataattgaatgtcctactttgtctcttgtgaattttgacttaaagtaaattatatgaaatatgaccattttcaacttaataaattgttgcctcttctctcatttggttaacacttgcataaaatgtatttttcatcctgccattttgtcttttttttttattagatctaaagtgaatctcttgaagacatgatatagttagatcttgatgtagatcttgatatatgtcatgatatagttagattttttttttcattttggaagatacttttgctggatatagtattcttgcttagactttttttttttccagtgctttaactatgtcatcctgttcccttcttgcctgaaagatttatgttcttaaatttactcgtaatcttgcagaagcatgcatataaataacacgtctctttcttcttcctgaattccagattctcttcttgtctgcgacttttaaaacattgcttgtgttatgtcttgttagaaatctctttgtgttatcttagttgaagtttgctgagcttcttgattttcttatattttttactaatgttgaagtgcatattagtctttttttgtagttctactacacaatttttatttctttctgtgctttttatctttttgttggtttcatttttgttatttcattttgtttttttaatttccattttactcattgagcatcattgagatgtaattttgattttctagggtaatttatttttttcttttaaaaaatagatcaagactttaattcaaattgtctcacataatttttacatctcctttttttaataattgatttctggatattcttttttttctttgagccatattatcttgatgttttgtttatgttgtaatgttgcaatttgtataataaaaagccacatgtcaaaatctgtattaagtgacttttgtctgagggaatatgataccaattttttaggctagggagtctt

SEQ ID NO: 5061 - DNA, 1202 bp, Homo sapiens
ggagcatattgtatctgtttattctggaattgcctctctgataacggttttaacttagatgctcattgtggcattgttttgttctaaacacatgtattacaaagatagtgttagagtaaattagttgagggaaaagccttatatcatctatccctgttttcatttctcttttcacctttacttttggtctaaagagtctttatcatgatatatggtatatgtatactcaggttcttgtaataatcggcagtatattatgatctctttttcttatagtcattaatttaatgattaaggaccatttaatcaagttgatacctgtacttaactcttattgttagatatgaaggatgtttccagtttctgaaggtacacattgagatagtgcctttacttttgttttatttgaaaaatgtttcaggaggggttgttttattttttcaaaaaacctctttgaggtaatacgcaattgttgtgaaaatgtcatacaatattgcagcatataaagaagaaggtgccttttgagaaggtgagagctttttgtttttttatttttttatttttttgagatggagtctcactctgtcgcccaggctggagtgcagtggtgcgatctcggctcactgccacctccgcctcccgggttcacgccgttctcctgcctcagcatcccgagtagctgggactacaggcgtccgccaccacgcctggctaattttttatatttttagtagagacagggtttcaccatgttagccaggatggtctcaatctcctgaccttgtgatccacccaccttggcctcccagagtgctgggattacaggcgtgagccactgtttttgtttttttttttctgagacagagtcttactctgtcacccaagctgaagtgcagtggcgcaatcttggctcactgaaacctctgcctcccgggttcaagctattctcctgcctcagcctcccaagtagctgggattacaggtgcatgccaccacccctggctaattttacatatttttagtagagacgggggtttcaccgtgttagccaggatggtctcgatctcctgaccccatgatctgcccgccttagcctcccaaagtgctgggattacacgcatgagccaccatgcctggccgggaaggtaagagttttgttctctaaactttcagtcattggagtacctccttgttacttttgc

SEQ ID NO: 5062 - DNA, 1151 bp, Homo sapiens
ttgatgtgttaatactagcggaggccatacagtaggattagggggcttaaatctgggtctttgtcttggtctaaaacaaatttgttgtgagcttggacaggttatggaaccttttttggcctgaaaataattttgtaatcaagttgaattgcctatgtgatttgtatctgtctttagattaataattgagattttaaaatgggatgtttaggactaggcatatttatttgttaggaaagagacaaccaaaagcttacatttagataaattccacttttttagccctgactagttccaaggtttaaaacaaacctcagtgactacgaatctattgtcagaattttcgggtaaaagagagcagatagtctttatttatttttattagtaaatgatggaattagtttgagattacctatagaaaagatagaataatgctaccatctgtgagttgttgggacacagtgtcggttttgacatgattcggagtggtttgcacagtgaacacccaagtgtgctttatagttcccttggctttgaccctgtgctagagcattgcctgctcttctcctctgcattaaaaggaatatttatccttttaaatgtattcagaaagccagcacattatattacctcgtgttcaaagataggatgatcagagtatccctccaagaattgtctgaactttatcatgaactatagttgcacctaattgaagatgcaagtgttattgtgtgtttattgtagggccttcatcccagaataatcactgaaggatttgaagctgtgaaggaaaagcccttcattttttggaagaagtcaaagtaagcagagagatggacaaggaaacacttaaagatgtggccagggcatctctttgtactaaagttcatgctgaacttgcagatgtcttaacagaggtatgtattaaattttgtctgtgtctggtatggtacacctatgtagaaaatctctgatagtagaaacatgaatataattaccaatttcaatcacaaggtgctatgtaggttcatttttgtggcagtgatacctaatctgtgtctctaaaaagtaaaatgaggaaattcaaataatagtatacctaaccgggttttaaaagtaaaattggagctttcattaaaaggtttataaag

SEQ ID NO: 5063 - DNA, 1151 bp, Homo sapiens; identical to SEQ ID NO: 5062

SEQ ID NO: 5064 - DNA, 1197 bp, Homo sapiens
agtgcagtggtgcgatctcggctcactgcaacctgtgcctcctgggttcatgtgattctcctgcctcagtctccctagtagttgggattacaggtacctaccaccactcccagctaattttttgtatttttagtagagaagggatttcaccattttggccaggctggcctcgaactcctgaccttgggtgatccgcctgcctcagccttccaaaatgctgggattataggcatgagccaacgcgcctggccagcctctctttattgggagctttccatccactctccatctcttctgccttttctttttaaatctcctcatcacttccttgcaaactctccatgcctcctagtgcctgaggtaggtataagacagcttgaaaccagtaatctacaattctttcctgggctttccgttctcacaacagagtctgtgtcacctgctaaggtactgaaactgactcagttctttcatagagcagatgtttatggtttcttttgaataaacatagaaattgacacttctagcctggtgtggtggagtgtgctggtattcccagctacttgggaggctgaggcgggaggatcctttgagcccaggagttctgggctgtagtgcgctatgccaatcaggtgtctgcactaagtttagcatcaacttcctgggagtgggggaccaccaggttgcttaaggaggggttaaccagttcaggtcggagactgagcaggtcaaaactcctgtgctgatgagtagtggcatcacgcctgtgaatagccactgcacttcagcctgggcaacatagtgagaccctgtctcaaaacaaaacaaaagcaaaagcaaaaagagaaacaaattgacctttccagtcttgaaatttgagaaagtgacatttgccttatctgagttcctttctcaggaaatcaaccatcaagcctcccagatggtatcaaggaactgaaacttaccagatcactgcatttggacaatgagatgcagaacccctcatctgtcataatggcctaacagaccacctgctgcctgttgatcaactcctcttccttacccctccctaattcctgttttactgcatgtagttacatttcttccttcctatataaacctctaattttagttggtcagggagacaaatttgaaactgatctcccatctccttggctggagcacccaattaaagcc

SEQ ID NO: 5065 - DNA, 1179 bp, Homo sapiens
cactctatctcaaaaaaaaataaattaacatacacatggtgtctacataagtcttcacattgctttttctccttcatacgtggaggtgactttactgagctataaaatgtaatgctaaattttagtatgagaagaatcagagttttctagtttgtcccttccatttacagctgaagaatcagaataagtgtttaaacatagggattaatgccttgtcacagggggctacatggacacttgagggcagaggctaaactggaacccagtgtgccgccctacccattgtcttatctattgcaccatagaactgtggtattattagagatctggacagcattgtgcttgcctcaaaggaagttaaagctgagtttattctgtgtcttgctcatcctcatgtggtaatctgctacgttaaatgtttcaggtatgtctgattgacccgggctgcttccgagaaattgatgagctaataaaaaaggaaactaaaggcaaaggttctttggaagtactcaatctgaaagatgtagaagaaggagatgagaaatttgaatgacacccatcaatctcttcacctctaaaacactaaagtgtttccgtttccgacggcactgtttcatgtctgtggtctgccaaatacttgcttaaactatttgacattttctatctttgtgttaacagtggacacagcaaggctttcctacataagtataataatgtgggaatgatttggttttaattataaactggggtctaaatcctaaagcaaaattgaaactccaagatgcaaagtccagagtggcattttgctactctgtctcatgccttgatagctttccaaaatgaaagttacttgaggcagctcttgtgggtgaaaagttatttgtacagtagagtaagattattaggggtatgtctatacaacaaaagggggggtctttcctaaaaaagaaaacatatgatgcttcatttctacttaatggaacttgtgttctgagggtcattatggtatcgtaatgtaaagcttggatgatgttcctgattatctgagaaacagatatagaaaaattgtgccggacttacctttcattgaacatgctgccataacttagattattcttggttaaaaaataaaagtcacttatttctaattcttaaagtttataatatatattaatatag

SEQ ID NO: 5066 - DNA, 1222 bp, Homo sapiens
tttcagttaagatccaaacaggcccacatagcatttcccccgctccccgctcctttcctcttttaattttcccatgccaatcatttctctctgggcccgccttttcccagtctgagccaatccaaatggaggcggaagcgctccgccttcatcgcctggaactctgggaggtgcttatttctgggcacgccccctttcccctctgagccaatcggagcagggccgagagcgcaccgggcactggcttcctttcccggagctctgggctttcctctgggcccacctcttcgtcctctgaaccaatcaggaccggcctggcagtgtcatggctgcccacaggtctgcaggcactcggtacgccgctaacgcggcgaggtagctcggtgcgtctcgcggtaccagtgcgaatcatcgggctatccaggtccgagatcctagtctcctgtcggctctgaggaggatgggtaagggcactcggcgggcaaggaccctggggcggcaggggaggtaaacgttttactgagaccctctccgggcggagtggcgtcctcggtccctttccttcggagactgttgcacttgacagcaccggctagtcgccgctgagagcaaggaggactgatccctacttttgacctggcttttgccttttgaggctagggggttagacagaaaactacccctcccactttacctacgtgtattaggacttttgcacctgtaaagcctaaatttcaggcctcgacttttgaaattgctcccaggttgaacgtttgaagccaggtccctgcatatctctcttaaaaaaaaaaaaatgaggtgtaaggtcagttacttgagaatcttttacaagtttaaccgtgagcctttgaaagtacagttagtaaaaagagtgcttttactacttaagctttttttatggagcaagcacaacaaaacaaaattaatttcacatgaagtatttttactttgtgttccttctcttgcttctaaatgctcatttcgaagtgaagatacaattttatattctgttttttctttgagttagtgttaacagtgtgataattttattacgttactacatagtgtgttatttttattacagttgttccccacccccccgcccccgagatggagccttgctctgtcgcccaggctggagtgcggtggcgcaatcttggctcactgcaacttctccctcccaggttcaaacagttctcct

SEQ ID NO: 5067 - DNA, 1185 bp, Homo sapiens
gcccaggctggagtgcagtggcgcaatctcggcttcattgcaacctccacctctcgggttcaagtgattctcctgcctcagcctcccgagtagctgggattacaggtgtgcaccaccatacccagctaatttttgtattttttgaagagatggggttgcaccatgttggccaggctggtctttagtctcccattctcaaatacaagcatataaccaatgaccatcagccacctcagaaaaacttctaacatgatagagggataaaaataaaaagaggctgggggcagtggctgggcgcagacactctgtcacccaggctggagtgcaatggcatgatctcagctcactgcaacctctacatcccaggtacaagagattctcctgcctcagcctccagggtagctgggactacaggcacacgccaccacgcccggctaattttttgtatttttagtagagatggggtttcaccatgttagccaggctggtcttgaactcctgacctcaggtgattcacctgcctaggcctcccaaagtgctgggataacaggcgtgagctactgcacctgacaaaaaagattttttttttaatattaaagaactagtccataagacccaatttaaaacttttctttttagtagttctagacagaaaggagaaaaaaaaaatagaagagaggatatattcattgaaataattctggaaatgttaagaagtgaaggacatgagtttccacattaaaggtgtctacaatggataaaaccagacacaccgtctgaggcacattatagcgaaatttcaaaacaatggagacaaagagaaaatcgaatgagaaaaacatggtcatacacagaggattaggaatctgaatgccttttgagttctcaattactgcaaggaaagctgaaagacagcaggtccaacctcaaagggggaatagtttccagccaagaattctatatccaaatcaaatgcgtagggagaatgaaaacacgtttggacattaaaggtctcaaaaagttgtactttttacatgccagtttcttaggaatctcctagaagttgtgtttcctgtgaatgaaggagtaactttaggaaacacaggatcccagagacatttcactcaagacagagctggtgatcccaggataacagctgtgaactaggtggtagagagtgaactg

SEQ ID NO: 5068 - DNA, 1165 bp, Homo sapiens
ctgcctggggaaggaaactcatcaatcccacagaagtgggagaggcgctgattttgcccggcctcggtgctctggctctgagtcagctacttaatgagctccctggagctgaccctgagcacagcaggaaggtgtgaacactccctcccaaaagagtgaaaaggtggagagagttttgtcacctgctgcaggctcccgctgctcccaggggtaatggcctgggcggcattcacacccccatgtagctgtgggcaggaaactcacagccaggctgctgggacgagaagagccatgtgacggcttgaagtgaaagggagtcagagggatgtctttggagagatgagaagagactcactaaagcagaattcgcaaggaattattttcttcctccttccagactcagcaggatggagggaaagtctcactgcagacagggacacagtcagatgacgtggcagccaggcagcagacagcttttgctgatgatgagctattacattggtcaagactttattgcaggtgataaaacccacttccaatacacccaagtgaaaaagaaggtgatttgtgtttcccatgactggggtgtataggggcaaagctgtgctctggaatgattgagacctgacgggatatgggctccatctccagatcagcctctgcacacagtcagtgtggacagaaagagtcacactgtaaaatacttgaggagatttattatgagccaaatatgagtgaccatggcccatgatacagcctcaggagattctgagacaagtgctcaaggtgttaggcaacagcttggttttatacacgttagggagacacgagacatcagtcaatacatgcaaggtgtacattggttcaacctggaaacgtgggacagcctgaagcaggcgaagccggggaggggggttggggtgatctgaggtcataggtggattcagagattttctgatgggcaattggttgaaagagttaagttattatcaggccgggcacggtggctcacgcctgtaatcccagcactttgggaggccgaggcgggcggatcatgaggtcaggagatcgagaccatcctggctaacacggtgaaaccccgtctctactaaaaatacaaaaaattagccgggcgtagtggcaggcgcctgtagtcccagctact

SEQ ID NO: 5069 - DNA, 1452 bp, Homo sapiens
cgtgaatcaatgaccttgagacccaggagagatgaagataaagcccagttcaagtttgaaggcccgagaaccagaactgatcatgaagttcttgtccaaaggcctgcatgctcaagactcaggaaaagcctaggtttcagtttgagttcaaaggcaggaaaagataatgtctccagttcaagcagtaaggcaggaggaagcctctcatactcagaggaggttcagcattttgttctattcaggtcttcagctgattggatgaggcccactcacattagggaggatgatcttctttactcagtctaccaatttaaatgttaatttcatcaatgtcaacactcagaataatgttccaccaaatatctgggcagcctgtggcccaggcaagttgacacataaaattagccatcacaagcatataaatgggatcatagaatatgtaaactttaagagtgactcctttcacttcataaatgcatttgtgatacattcaagttattgtgtgtatcaatagttttgctctatgaaaacaccattaagaaaataaaaagacatcgcgaaggcccacggcgggtgttgacgtgatgtgatttctgcccagtgctctgaatgtcaaactgaagaaattcagtgaaatgcgggtaaacggcgggagtaactatgactctcttaaggtagctaaatgccttgtcatctaattagtgacgcgcatgaatggatgaacgggattcccactgtcactacctactatccagcaaaaccacagccaagggaacgggcttggtggaatcagcggggaaagaagaccctgttgagtttgactctagtctggcatggtgaagagacacgagaggtgtagaataagtgggaggcccccagcgcccccccatccccgcgagggggcagggcggggtccgtcggccttgcgggccgccggtgaactaccactactctgatcaccaaaatagcatggtactggtaccaaaacagagatatagatcaatggaacagaacagagccctcagaaataacaccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacattagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaaggaactaccatcagagtgaacaggcaaccgacaaaatgggagaaaattttcgcaacctactcatctgacaaagg

SEQ ID NO: 5070 - DNA, 2272 bp, Homo sapiens
gtctaccacaaatactctttatctcagctgggagctgacatctctccctgaaaggtttccagtgatattgtggcacaatttgttggccagaatcctagagacccagggatggagatgccagtgctgtcttgagagttcagtgtcttccctgttggcatcttctctttcttggttctggcatatctggttcaaggattagacacatgaattgatttagttctttgctggagagggcagcaaaatgccagttgtgatttttgggcttggctatgttgggaaccactgggaatttgtggactgccaataactcattttgtactagcttttgggtgaccattcagtggctgttatttcaattcatagttcagagtgactgtatttagacccatcatgtttctagagttttttcctagattcaaatcatggtaaatgctttcattagataatttagcttatgccctttttcctacttttatgtttccctgttgttactagccctagatacttaaaaaaattttttttggaaaggactgtgtgtttttagatatggggattgtattctgtgctttagtggggcacagaaggagactgtctggttaaggcaagagattgtggtgctaaaaaaggaaatttggcaggcctgttcctggtacttttagtaagtaaagaaagagaatgacaggctggctggggattgtattaaagggagccctgatcctcatatgaccttattccctgaacctagaaagatggtctgcctatgtggcagttattctatggcgctaaagacagttttgttctgctttctgccatgtatatttaggggcctaacggagagatagaaacctgttaaggaataatcatggatgttcaggcctattgcttccttcacttatccagaagccagcctcaccaatgtccatgggcaagtttgtgttcacacaagttgcttgtaacaagagggaagattctcattaagaagttggccctaaaatcaggatagaatcaggctatatttgtgtttctgtcaatagtctgaattccttattggtagaaaggtcttataattatggggtaactttgccaactaatagtactggggtttgatgtgggttacttacatcagaagtcacatcaactttttgacattagtttctattccaccatgtgctccagggaaaaggagattgatgtggactattaagccaaaaatgagaatctgttattgaaacccagaagtctgaaataagggtttagtgattgttttgtttagacacaaacttttcttcatagatgctttaacttcctaagtgagtttatatatttttctaaatatgtaatcttttaaaaatattgcaaatatttaatttatgtatttgccatttaacaggtaaaacagcaccaggaagtcttgctcctgttttgcaaaggcacatttagagagtgacagaggtttcccactgtgtctgggacaagcctcccagtgtgtctgggacaagcctgaaaagagtgccattttgtctccctgaccatttcactgattctgtacttgttgtttatgaaacttcattatgtaacagacaaaaaagcaatttcatgagcaattcctggaataggcaagtggacaaaaatttctcaggtaccttctctggaggctgtttgtcttccattctggctgcctctcttgagaactggagtggcatagtggttaagaccaggggctctggagactgcctggatctgggtgctggtctgactcttgagctgtgggaccttaacttctctgtgcttactgtccttacctgtgagatggagatgattggagtctccaccatgtcaatgtatcaacacttctaaattatttagagcagtgcctgagacattgtaaacacttaatatatgttggttgttattgtaattttaataataatagctattaaattattattctatggctgtcatgcctgagagttcatcacaggggcatgggtgggtgggtagggaataagggctgagaatctaatcagttatttttaatttattgggcaaaaatgaatcaaataaccgtggcaggcataatgaaattgaggtattcagtgtgtggtgaggatgaactgttttatcacagttcctctggtgtggcctgtgtgctttgattgcaggtcagatggctagggaaaagagtagtcaagctgaatgctctgtggtgaggctgtgagagggacaagaaacgtgggtcaggacagaaggcgtactgcaggaacagattccg

SEQ ID NO: 5071 - DNA, 1197 bp, Homo sapiens
agagactgtcttggagtgttgagttcagacccagataaaacaataatctttagaggaaatgaccaagatgaccagaggtaggtctgaaaacatgaaggccgtgtgggtaagagagaacaagggagtccatgccttctgttttcaaatatttaggaggctactgtcaggaaggagggatattagacttcatgtatggaaccatggagtgagaacaaagattgctgggtgtaggttataccaaagataaattttatgccaatataagaaataattttctcatagtgctgtgataaaatgaatttccccaggagatagtttcccaagtaggaagggatatgaacaacaggagctgatatttgaatcgtgaatatacgtggccttatagtaaaaggaccacagatactcgaatgtcagacctttaggaacaagtcattttctactgtaggattttggagggttcataatagaaagtaacacatctccttgtgtctaaaaataggaataaatcctaatatgaaccaaaaaatatattaggtacagttttctgagttgatattgaaatgatgaaaaagaaagagatctgggactgggggttcttaacacactgggtttagggacctcaagaatattgtttaagaatgacgagagatttgcaatttccaaggagtcataagcagtttcaaaaagttgaatgtttttgaggaacttaaaattctgttgttttcaaaatactatagaaaagtaatattacaaaattgtcttgacataagtaatttgggtatgctgtataaaggcttctaagaattaagaaacatggcccgggttgcaaattttaatgcatgactacctttttttctatagaatatagcttttgtcagattctcagcagtggctctgatccagaaaacattaagaaccactggtcatgagtggtgattttcagcttttttggtcttaacccacttaggtgggacagaagctccttatctcacctataccatccagcatcaagataagcacacgttaatatgaaccatatacatattttgttttataaaagtatcccataagctttaaaaatgtaattttgtcatacttaccttggtatagtagattgtaagttatttagagactataaagtcacagatgaatgtttacaagtactctttttggagttgggcttattctatctatgtc

SEQ ID NO: 5072 - DNA, 1204 bp, Homo sapiens
tgtatatgttaaattagcaaagaatttatgcaagacgtatgtgaaatcagtgaagaattctattctatctagactagagccagggagatttccaacacctggctcatgtatgctttttaaaaaaagatattcagtcttactgaagatgaatagatggatggatggatggtttctaacatctattgattgcttcctatgtatcaggcagtgttctagacatttttatgtttattacatatgtacttatacaaattatatgtttattaactcaattaacgttcttagcaacactatgaggtacatactgtcaatagccccatttaatagatgaggaaactgaagcacagagaggttaagttccttgctagaggtttcacagatggtgtacagtacaggcaggctttgcacccaggcagtctggctccatagttatatatgaaggataacgatgtggtcttttcaagagctgttggcatcttggttcacactgaaagctaccaggctttgttatctgttcctctggctttggcttcctgagtcttaagcacccttctcttttctagaacatagaccagcttgaaccaaccctctgtgattccaccccgcctctcccctggctgcaccaggcctctcatttgtagtttctcttactgagcacatttctaaacgaggacggttgctccactttaaggacatacaaatggcttgccctcacctgtcaagcatgatccttgtattttaccaggcccattatgaacgcaatctttctgttgaaaatttgcatacctcctttcttgaaaagtaatgacagcaatttctttccctccgctcactttctgagtgtctcatttaacggcacctgtgaaaccgacaggcacagagatgagaagtgaaagagagcagttgattaaatcatcatcaagtcgggcctcagaaagtcaattctgcttgccgtctgcaatgatatccttttatcttaaagtaatgagctatggcacttttgcatcgggtaatgcgataagttctattagcatgttccatttgcctcacaagcaagggcaagtcattttagctagctcatatcactgcaatcaaagcaattggcttcccaggcagagaagaaagggaaaaggctcagggtgatttctatggatcacaacacagcggaaaaaatagactcttgtattattttaacccataacat

SEQ ID NO: 5073 - DNA, 1238 bp, Homo sapiens
tagacgataacgagggtgatataaataataatagcttacatttttttaggtcttcttgtgttccaagcactgtgctaaacacagactgtccccccaaaatatggcaaattgtgatgcctgaggcagagtatggtatggctgtctgggaactcttgaaaaggatattggattgcttgcaggcaagaaacaggccagattatcttggcagatctcgctctcactgtggttcttagcctttattacactgttggaatgggtttctcacaagtgatatcaagggaaaaaactagacggatatgtccagtgtatgtgtacgtgtgtgtgcacatgcacttaggacaactttgagccaggagtgtgagccggattagcacactgagttgtactttattctaacacatgcagctcagtagaagtctcatcttaagggacatatagaatgttgaggtagaaatagctcagaagaaagttgataaagtaataggatacgtgcttttgccaatctacatggccatatccttgcatgcttattttgacagaagagtcacagaacagagcaagttcttaaggctcattcattcccatttccctcttgacattttgagcaaaggactggagggaccaatccataaggggaatgcacctggtcatcttttcctgagcatcttgggatcaggtgctcttgggaataagatgatacgtatacccaagagcacttgatcagtcaggcagtgagtccatcaatccacagccctgttctgtgctggatcccatacctttgtacctgtgtggcaggagacaggaaggatgtgtggtggaaactccaggaacttagtccagctgaggagatgatacagacattggaaaacataatggaccaccaggaaatgataagcttaggaactcagagaacatcatttctaggatgaccagagaaggcttcaaggaagaagagaaatttaagcagtgcctcaaaggttgggtgggatgtgagttactcagctggggcagggagtagtctttgcagggagggaaactgctgaggaaagatacggaggtgagccgtgcacattgttcctgttggaaccacacatgtgtaaaggctctgagatgagtttagtgagagttgaaggctcatgttgaaaaacactgtgagaggcacacccagtacagactgtggcaagtgttgaatgcctggcggagaaacctagagccttttaaatagttctgagcaggga

SEQ ID NO: 5074 - DNA, 1225 bp, Homo sapiens
ttcatctttccattcctgcccccatccaggcatgtctgagcagcttggatcgcaaaagggcaagatttacacatggggtttgcagaggaaaggggtagggggctcggaaaggcggcctcctctgcgtgtgccaggagagctctatattgcagtgtgctttctgggttcacctaggcagcgttacacagctgtcctcagaggagcggaaagctgggctctggctggagggcccggtcatcaatatgctgacaggccttcatcatcattttcatctcggttgtaaagcacagcctattttccctctttgccaaatctctgctccaaatgtacataactatagatttctgactgagccctgctgccaggaatcaaccagaaagcttcaccagacctctaagacagaggacaagtaaattgtgttctcggctcccgtgaacggggcctgtcactttaactggtttcttctcaggcagtgggtacagcccaggacacccttagtgaacttgccactgcccctggttttctttctctctctttcctgctcttcctctcctgcctgctgtttgctgaccagaaaaatctggctggagaggcccatgcagtgagtgaacatcacatacataattctatcagaatatatccaagggtggggaatcattgttctcggaactagctgagctgaagcccgagcagaaatactaaagtcagtcgtgcctttgagctgcctctaacagcgccctttagagacccatttcatacaaaatttgaagcctgtgtttattgcccattaaagcaacctttattttatggcaaatgttgcagtaattgccttttacgaagagcactttgtaacacacatgcacagttgaaagaaaaccactctggtattgtctatcgggacttaatggcgcaattaattttactccatctgttcctgagactttaaaggaaaatggattttttttttgagcgtactttaatgaagaagataaagcggcccggctggtgtcccacaggctcggcgcagtaagttcagattattgctcagtctgtcagaatgggctgcttccctcagcagcagccacagccagcaacccgctctggcccctcgccgcgccattcctgatgacaaactgccagccagctcccacaaaagcacgattaaaatgtcagcacaggatgacgaaggggccaagagggtcctcagagacaaactgtgttcagt

SEQ ID NO: 5075 - DNA, 1099 bp, Homo sapiens
ggccttttacatacatgactttaccactgagccctcacaaccgcccagagagcctgctctttgcagatgtgactggcttggtggcaattcaaccccaggctgcgggcctagtggcctttccctgccatggcgcaatcttggaagcggcaactgcggggagggcgaggagcggtgcagtttccgccgcgcccgcccgcaaggaaggcagccggggggagccgagggctcgagccgcggggggagcaacagctgtcgatgtcgcgcctggggaccgcgcctccgctgggccgacccggcgccggggacgagaggaggggcggcgaggggcggggcgcgcggggcgggacggaggaggggcggtggcaccggcggctcgggctcggcgcgccgaggaagtcccgctccgagagctgcgagcgtctggaggaggcgcgctcggcgcagtcggggagcgaagtccggagcaaggggcccccgcgtagccgccgccccctcctgctaccgtccagccagggagcccgcggcggccgccgatggagttcacttgagctgtgaaccggcgggagaggcaggcgcccgcaagccgagcgcgggccggagcccagccagccccgggcgctcacccgccagcccgcaagctccggccagaggcgccgccgccccgcgccccgccgttgcagcgcctcctgggccgcgcgccggcgagatccgcacaaaatccagactcccggagcggctccctccagcaccgcggcgggcccaggaccaggcagcccgcggcgcggctggagaggcgggaccggctgtcggggagccccgggcggccgccggggagaagccgccgcgcgccctcctcctcctcctccctctccctcctccctccctccgcacatggtctcctttgtcctgtcgccgccgccgccgcctcgctcttagctccgcgcgccgcggcggcggctcaggccgctcttctccgcctcgccctcccgccggccggcccgggacgcgccttgttagcccccgccgcgccagcgcggccccgcgcgccgcaggagcggcggggagacagtggcgagcgcgggccgggcgatctcggcgg

SEQ ID NO: 5076 - DNA, 1100 bp, Homo sapiens
cattgagaactagaacatgtcccccagatgtacacaggaatatttcatctttgtcagtattacatggaaagactaaattgaatatcctctttgtccctaaaagctagccccagagtcaaaatatgctgcacttcagaattccccccccccatttcctatatttcctttttccatatttattcaacattctaggcttttgctttctcagaatatgcatctctgtgtatcaagtgtgaaagatgagtgatttctcatgagggttatgtagtgaaaacagcacaaatatagcttggccattataactttaaatgcagatatatcctcacgttatgtagtggagatgcttaatttttattttttcaagttctagaaatattcagtgctgaaacattacagcattttccttcaaaccgacttccatgtttattttccagaacattagtgtataatttaaattggctttagttttactgtttaaacaggcttatttcaccttcctcaagccactgtaataattagcagacatgttctctagaaaatggaaaggaaataatgctggtggcatgcatagtggtcggattttggggcaggccggcttgcatctttttgaacaccaaggtcgtttggttactgcaagggacagggatcttggagtcatcagatgaatcttaaaaaaaaattaatttctggcagtgttggcttacactttttagtgaggaaaagcttagcattaaataataggcatttctgatttgtgaaagaaaattgaaaaattggcatgtctgcaaataccacgaaaaacataacatttccaaaataatgatctgtcaacgaaattgcaaaatcattatgtgaatgagctgaattgctttgtgtatcatctcatagaaatatgttttgcacagataatgtgtctaataaggacacatttttaaaatcagatttttttccccccagcaaatagctgcactgcaggtctctctcaagcagtcaactagcaccaccttatggatgatttggggacattgctgcttccctgctaggctttcgtaaaatgtagtcaactgatttaaaataatgggaatgttgatggtgatgac

SEQ ID NO: 5077 - DNA, 1185 bp, Homo sapiens
gtgagcagatcctttcaagagaggctctctgcctctgatggaagaagtgttaaagaaaactcgtctccctgcagctccaaaggcaggaagattgggacctgatgagtattccagcttaaggattttttttttcattctgatttacttcctcctatgtgggtcagagaagtagggaagaaacaaaacaagctgcatttagagaaagtgagaaatttctttatggaaatccaggctctctcctctgtcttgtttttgccaagttacaaagaagcgtctaaaaagcagcacagaggaacacagcaaagaaaagagaggcagaaacccagtgtgcagcgccaagtagagccgagccctggtgccccgggggctataattctaacccggcacagctcctgaggctgtgtgtctttgttactgtttttcttttgaaaacctggtggctttggtggttccgggccttgctttttcctaagaggggaaagcacagtctttggggggcaggtttcctccttccccaaggagccgggcccggcttctgccccctcggccgtttctgtggcctccagaccataaagtgatgtgagaacccaggcacctgggtttcacctcttctttgtgtgtcttcatttaagaggtaacaagacagatggggggaactcagatcatcgctttttttattcctttttgttaaccgttgctttataggagatgtagctagtggaggatggaaggctggggattttctaggggcattgatgagaatctggccacaggagcgagagaggccctgaggtttaggcagaatgagctgtctcgacaccaagatgccccacagccctgaagcagcagtttcggtttgctctgtctgcagtagcgatgggaaagtttgcaggagttgtgatttcagaaagtgtgctcgtacagggaggatctgtaaagaggaaggggcaagagagactgtggtgagggtttaggggaaggaggtaggattcttttaaagagaatacattgcttacctttttttatttttttcttttcttttttttcttgttccgatagcagcagcagaagcagcactccagcgaagactcagcccgccccacctcacatctcccaccacccctctgcctccccgttccccctctccctgcccaaccacagccccctgcacagcttcacacccac

SEQ ID NO: 5078 - DNA, 1136 bp, Homo sapiens
gttttcagtgctatttacaagatttgaatgttttgtttgctgccttgtacattttattaggaacttggaagaggtttgtaggcacaggttttcccttcactcctttttttcaaatgcagtactaagatggacagggaaacttttttttttaaattagaacaaaaaatagttaaaaggcatcatggtcaactgacagtaaataagctagtagacttttatgtaatgttctttcactgtggataggcttatattaataacagtaccttgggaggtcgaggcgggcagatcacttgaggtcaggagttcaagaccagcctgaccaatatggcaaaaccctgtatctacaaaaaatacaaatactagccggacgtggtgccatatgcctataatcccagctacttggtagactgaggcaggagaatcacttgaactgtgaggcagagggtgcagtgagtcaagatcacactactgcactccagcctaggtgacagagtgagactacacacacacacacacacacacacacacacacacacctatacacgtgtaaaggctactcattcgtgtctctgctttccttctgcttgttcgttgttggtattgttaattccatattatttcagtcacttggcctcaaaatcagttattttggatgacttcctctgttttgcccctcagtggggaatgacattgatttcacttctttagtaacctacccattccactgaccttaggagaaagtcatcattacctgtctgacataacctcctcccaggcttcactgctttcacttgtactgaaatcaagctcatcttacccagagctctggacagatctgattttaccttttaaagcttgatattatcttgattccatccctagttgatctagatatttctttagattacctacttactacatgtaccaacttatatgactcgtgatatttgtttttatcccttgcatcatcaaatagtgatctttttggaaatgggaataatgtatttcttgtatacctgctgcttgcttccacagtgtctcaaatatgtatgctccagggctgggcacagtggtttgctcacaactgtaatcttagcatttggagaggctgaggtgggaggatcgcttgagaccag

SEQ ID NO: 5079 - DNA, 1098 bp, Homo sapiens
cgtgtcacttcttccatcgcgtggtcggggttatgtctcttttctttgagcctatgcacatctttgtgattgccctgaccaataaataaagtaggacagaagcgacgctatgagattgccaaacttcactgtaaaaatgccatgcccttctgctgtgttgtcgtggaatgcttgcccttagaagtaagctgccggactgtgatgaagcccaaaccagcccaaatggggagactgcaaggaggggccacatggacaggttctacataggtcagttgaagtcctggctgacagccagtatcagctcctggttttgtgaatgaagatgcctctaaatgattccagccccctcccactgatcacacttaagactccatgtcttcccagctgaggccccacatgtcgtggaccagagacaagccaggcctgttggaatcacagaatcccggatgataatgattgttttttgccactatgttttggattggtttctggtgcaattagtaactgaaacagacttcacttctttatactcattaaggaatgagactgtgtctttttttttttttttttaactttttgtagagatagggtctcgctgtagagatagggtctcgctgtagagatagggtctcgccgtattgctgaggatggtcttgaacttctggcctcaagcgatcctcctacctcagcctcccaaagtgctgggagcacaggcgtgagccaccatgcctggcctgacactgtctccagtgtttattggtgtttcctgtgttgcacaaagcaggtggtggtaggtgcactgtcaatagtgagtttgtgagtagaaggtgtgtgtttctccttttcgtgtgggtgtcacacagttggtgtctgtgtgcctggaagcacacacctgtttctgcttccagagttgtctctggcctgcagttctgtgcttcccagcttgatccgttcctctccaggaatctcctctccctccccaccctgacccacctgttggtgagatgcaactgactttctgccacattttttacttacaggtggtacctgtattattccctccacctctgcagggaagagggtgaagaaatgagaggc

SEQ ID NO: 5080 - DNA, 1099 bp, Homo sapiens
agcgcaagaagtttcctgataggcttgctgaagatgaaggggacagtgagccagaggccgttggacagtccaggggacgaagacagaagaagtagagaggcagggccgtggtaagggagctgaggtggggggacagctagggagggtgggagggaggcgagcgaggaagaccaagaacctggaagagatcacagggagtccagaaacgcctgtcatcccaagcttatgctgtttttctaaaagctctttatggggcttgatattgggttggtggtctttgtccagaaatatgaagggacaaagagggccataaccctcccttctgagagtttccaggaggagtccgagggtctagcttttctggtgaagccagttcctgttcctgccttctttcctaagggcctgctcgctctggcttccaccacagtgccaagcccctctggtctccaggggagggattgctgtgttacatagcaggatcggggtaatcaggccaacaggggagatggtggcgatttttcttttttaatctgtatttattatacagtcttgtttctttaagcccatactctgtctcttcccccgtcttcctctcaggtgacagtatcagtgagtgccatacagaattgtgtattcaccagcatcatgaaacagttgtggtcttttgagttgatcttggcagagtaaagggacgtgtcctggagccattcctgaatctccccttctttgtgacagctcctcccacccccccaaaaaataaaaaaaccacaaaaaacaaaaaaacaaaactaaggcacttcacttagagactggagtcctgcttataatcatgcatataacctttactttgatggatctggccagaggggtgttggagcccagcccacccacataccagtcaagctcttaggggagcagaagaaaagcaggaagaatttaaatgtttaattttttttttaaattgacttttctagttattaaaagttgcttgtttcagcagtgatattgtataaagaacatcttgtaagatactcctgacatcttgctttagcacatgtacagtacagtttctatgataatgtgtttgctctaacttccc

SEQ ID NO: 5081 - DNA, 1219 bp, Homo sapiens
tataagaaaatgtacctcagagttaagacaaaagtactttaaacagtatcatttctacttaaaagcataaaatgccctgaataggaaccaacagtgaaaggatgaaaattcagtcttgtttcaagaacagtgctttttaaacttttcagatattgccattttgtagatcagatatccttaatctggggtccatggatggattctctgaaattgtatgcatagtttttgtctactatttctgctggaggggttcacagattttgtttaaatatttaagaatcattaatatacataaacagaactagttacatagcaaaaatgtctagtattaagtctggatgtcaagggaattttgtgttgacatgacaaaaacattagctaacattcatgtctttgttttttcagggacaaagtatctatgaagagatatgaatatgtagctttacctgaatagctggggaagagggcctttaagatgcttaaatgttgcttaagttagttttagattttaaaattaattttgctcctattcttaaattctagtatatgactctcaacccttctactaagaggaagaatactggatccccagacaggaagccctcaaagaaatccaagacagacaactcttctcttagttcaccactaaatcctaagttatggtgtcacgtacacttgaagaagtcattgagtggctcgccactcaaagtgaagaactcaaagaattccaaatctcctgaagaacatctagaagaaatgatgaagatgatgtcgcccaataagctgcacactaactttcacattcctaaaaaaggcccacctgccaagaaaccagggaagcacagtgacaagcctttgaaggcaaagggcagaagcaaaggcatcctgaatggacagaaatccacagggaattccaaatctcccaaaaaaggactgaagactcctaaaaccaaaatgaagcagatgactttgttggatatggccaaaggcacgcagaagatgacacgagccccacggaattctgggggtacacctaggacctctagtaaacctcataaacatctgcctcctgcagccctacacctcattgcatactacaaagaaaacaaagacagggaggacaagaggagcgccctgtcctgtgttatctccaaaacagctcgtcttctctctagtgaagatagagctcgtctcccagaagaattgcgaagtcttgttc

SEQ ID NO: 5082 - DNA, 1169 bp, Homo sapiens
accatgttggccaggctggtcttgaactcctgacctcaagtgatctgcccaccttggcctcccaaagtgctgggattacaggcgtgagccaccacgcctgaccctgacagccttttagggggagaccaggcccccagcaccaggactcctgaatagctcctgacctccagcgggtctcggggaataggtcccaaagggtgtttccactgtgaagctgggcacagcagaggtcacccctcagtagcactagggtaggctgagatttgaggtacagttcaaagcccattttgcatcccattagcatagttgggtgccttgaatgcgagggtaaaaagggccattagacactagcggggccaactgcatcactttgtaaatggagaaactgaggatcccgcatgggtctccaccagcctttcattgaagtccttcctgaatatccagtaggtgcccaccatggccaattgggcagaggggatccagagaggccatgccatctcgtggaaggaactctggacttagagttgcccagagctagttcctccaccccgtctctgccccttgctggctgtgtgacttcaggctagttgcctagcctctctgaacttgtttccttatctataaaaacgaggccacggtggctcacacctgtaatcccagcactttggaaggccaaggcgggcagatcacaaggtcaggagatcgagaccatcctgcctaacgcagtgaaacccggtgtctactaaaaatacaaaaaattagctgggcgtggtggcgggtgcctgtagtcccagctactcggcaggctgaggcaggagaatggcgtgaacctgggaggcggagcttgcagtgagctgagatcgcgccgctgcactccagcctgggcgacagggcgagactccgtctcaaaaaaaaaaaaaaaaaaagggcaaaacaaaaaacgaggccaatagtcctaactttcatggttggtgtggagataacaggtattccagggtgttgccactaagttggtatccaatacatgatgtatccttaaggaggtcacattctcattcatttgggaacaccccactccccatggcagggcagcagaggcagagaggacttggatccgccagccctgtgttgggacctcattcaggtcaggttctgctgcaggatcaaag

SEQ ID NO: 5083 - DNA, 1677 bp, Homo sapiens
tgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaa

SEQ ID NO: 5084 - DNA, 1197 bp, Homo sapiens
tggtggctcacgcctctaatcccagcaatttgggaggcctaagtgggaggactgcttgagtccaggagtttgaaaccaacctgggcaacgtagtgagatcttgtctctacaaaaagttttttctcccatccaagtactaaccaggcccgaccctgcttcagttctgagatcaggcaagatcgggtgcattcagggtggtatggctgtggaccaaaaaggtttttctaaaaattagccaggcatggtagtaggcacttgtagtcccaggaggctgaggctggaggatcacttgagcccaagagtttaaggctgcagtgagctatgattatgccatcctgcctggatgacagaatgagaccccatctcttttttttttttccgagacagcgtctcactctgtcgcccaggctggagtgcagtggtgtgatctcggctcactgcaacctccgactcccgggttcaagtgattctcctgcctcagtttcccaagtagctgggattacaggcgcctgccaccacgcccagctatttttttgtatttttagtagagacggggtttctccatattggccaggctggtctcgaactcctgacctcatgatctacctgcctcggccccccaaagtgctgggattacaggcgtaagccactgctaccggccttttttttttttttttttctttcaagacagagtctcactctgtcactcaggctggagtcaatcttgcgatcttggctcactgcaacctccgcctcctgagttcaagcaattctcatgccttagcctcccgagtagctgggacttcaggcatgcaccaccacacccagctaattttttgtatttttagtagaagtgaggtttcaccatgttggccgggctggtctcaaacacctgacctcaagtgatcttcccaccccagcatcccaaagtgctgggattacaggcgtgagctactgtgcctggccgagaccccgtctcctaagaaataaaaaagaagaagaaagaaaaaatactgatctaatcttaccccacctcattgtacagctgggaagctgaggcacagagatgcccagggacttgcccaggccacatagtgagtcagatgctgtgtagaccctgctctcaggaccacccatctgaaccatagaccaccgtgggccacacggcccagtatggctgctcaacagggacagtga

SEQ ID NO: 5085 - DNA, 1200 bp, Homo sapiens
agcccagccttccttccggggcagagcagtggtggggacctgtttccagctgcttgtgccccccacttcatggaggagggaccagggatcctcagaggagagggtgatgtttgacagtggctgcctgccctgaaaatcgcccttgtctgtccagcctggcctgaatttcacccacatcaacccacatgggatactttatttatttatttatctatttatttatttatttatttattttagagccagggtctcaccctgtggcccaggctggagtgccgtggtgctatcatagctcactgcagcctcaaactcctgggctcaagtgatcctcccgcctcagcctccagagtagctgggactacaggaacacaccactgtgcctggcttatttttctttttttttttggtagagatgggggtctctctatgttgcccaggctggtctcaaactcctggcctcaagtgatcctcctgcctcggcctcccaaagtactgggattacaggtataccattatgtccagctaaacctgttccttgaagaaagtgtgaacctcaaattcaaagcccctctctttctcttccctcatcagaatcggctcccagacacctgccactcgtgaatgcatctgataaactcactcacactgaggccttggggactgaggtgagcagggcccagcagtggggagatatatgggggaagtgttagtggtggtgaatccatatggattcacctcagtccttgcctcctcagaagaaagaattccaccaaggggcatgaggcagagtgagggaccgaggcaagttttagagcaggagtgaaagtttattaaaatgttttggggcaggtgctgggcacggtagctcacgcctgtaatcccagcactttgggaggccgaggtggttggatcagttgaggtcaggagtttgagaccagcctggccaacatggccaaaccctgtctctactaaaaatacaaaaattagccagacatagtggcacatgcctataatcccagctactggggaggctgaggtgggagaattgcttgaacccgggaggtggaggttgcagtcagccgagatcacaacactgcactccaacctgggcaacagagcaagactccatctcaaaacaaaaacaaaaccaaccaaacaaagaaaaagttttagggcagtaaggaaaggaggtaaagtaca

SEQ ID NO: 5086 - DNA, 1200 bp, Homo sapiens; identical to SEQ ID NO: 5085

SEQ ID NO: 5087 - DNA, 1142 bp, Homo sapiens
cctgtcgggagtcatgctgacgtggtgagtggctgggccccggcaggggcaggagctgggacaaggaggggatacacggcatccccaagggtccccacactgccctccactttttaccttaggcccgacggtctcatgtaccagaaattccggaaccaattcctctccttttccatgtaccagagtgagtgtcccagatgtctgtgctgagccctggaggcacccgtggtggggggcaggggcagggaacccctcccggggctcagccctgctcctctgtcctccgcccggcccaggcttcgtgcagtttctccagtactactaccagagcggctgcctctaccgcctgcgggcgctgggcgagcggcacaccatggacctcactgtgggtgagtcgggagtggccctggcatctggacattcccctttcctcccatcccgggtctgagtggtagcgtcccctctgtccctggccgtcctgtgccctgaccttcctccccgcagagggcttccagtcctggatgtggcggggcctcaccttcctgctgccttttcttttctttggacacgtaagtcgtgcctctgtgtccctgcctgtctgtctgtccgtcctctgcgccggtttcgggctccagcagggactgggtcttctgagtaaaatgcctcctccctgcttagttctggcagctttttaacgcgctgacgttgttcaacctggcccaggaccctcagtgcaaggagtggcaggtgagccggggtccctggacaggatggatggggggccaggcccatgtccagccctcaccctattcctccggcaggtgcttatgtgcggctttcccttcctcctccttttcctcggcaatttcttcaccaccctgagggttgtgcaccacaagtttcacagtcagcggcacgggagcaagaaggattgaggctgggccttcccctgccggcccagaggggcttctgtcctgtgtgttgtgggaggggatgggaggcgcccctcgagtgtgcgtgtatcagggggtctcttctattctcccttgggttttatgggcgctgtgggccctgaaggaagacctgggcccagtgccctcaataaagagaggcccagaggtggcctgagcgtgtgtgttctc

SEQ ID NO: 5088 - DNA, 1199 bp, Homo sapiens
actatggccaggctccctgtcggagcctctgcctggggccccacctggaaaaatggctcctctaaggcgcttccagcctaaagcccgtcctcttccacctcttgggtgcagactggccctcccactccgaccgcaggtcccccaccggccacacagacggctacgctagaacccagccaaacaccggggttgccaggatggtcccacagctttcctttccgactcccggaagtggccgtgatctcacgagatcccggaggcgagcgcgaccggaagtccggtcactctcgcgaggccccagagagcaggcgctgggcagtgtggaggtcgttggagtcacttccccgtcaccagctcctgtgcctgccagtcggtgcccctcccgctccagccatgctctccgccctcgcccggcctgccagcgctgctctccgccgcagcttcagcacctcggcccaggtaggccagacgaggggcggcctgcaggcggaggccccccggcccgggccacgtgcgtccccggttcgcgggcagctctgaccctctccaggccagcctggaccgcagggatgcccggcactggctggagactgtggcgcccggggcaggccctgacactggcctggaggtgcgggggagaaagccggggaaaagggggcgaggtagtcccgctccagggccggtccatttgtcagggttcccccaggtctcccagatttcccagaggacctgctcttggcttgcacgccttcaaggttgggaaaccagggctctgcatctgaaagtaaacttacgtttttttctgcagcgttccattgctttgacgtagctaatctccttgcagcatccgtgtgagttgtgcgtgaataaaagaaatcgtatacttcctaattccatagtatggacaaaccgaggctagagaactgggccagggttacagtcatttggccagaggattagaattcagcgcttctgacctgaagacggcttcctcttaacctttttggaggatctctcctgctgtgggcggactgagcctgccgccaggtgtcttaacagtgcttgacttggcccgcgaccacttaagcctaggagcctaggctatttttagccatcttctagaatggtggttcttaaactctgcagtgtgtcagaatcaccagaaagctaataaaaaacagacgtctgggttcattgaa

SEQ ID NO: 5089 - DNA, 1376 bp, Homo sapiens
agacggtggcagagatgcctgtttttgccaatgtcagacatttacctacttagtgacacctgattcaggtgactgtgacaatgttttcagtcctttaccaacctgcggggagagacaagaacccagaaacaggctctgttggggagaatacggtgaagtgttcctgatgattgagttcctggcgtccaggtgcttgtcgcattgtcctcgtgttcacgaaggtggatggtgcttgttttatagctaaggaaacacatttggaaggtcagtcattgtccagggtacctgcctagacaatcacagtgctgggacccctgcctggcaccctctggctctgagcctcgcactcctgaccgcagctcagtcccacccacctgctcagcaaggcgtccccagcaaggcacccagaacccgcatgtgtagagagactcctcggcagggctgatggagcgacaggtcggggtttctctaacaagcactttcctggaaacttcattttaacatgttcccatctccctcagaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttgattttatttttcaaggtcccttctgtaaatgctgtgctttcttccctgtgagagccaactttagagtgtctgctacctcttcattaccaatcagaattagatgatgtttaactgttagactgaagcgtgacgctttcatcagtagcttcaagaaagtctaaattgttaatttatggaattggacacagtattcagtttacccgtacatgctcctcccgcccctcctgttggcacccttgcatcgcccaggcctgattcctcctgggggtagttcacccccacgggttcatagttcagcggcgaatgccaggcagctgttttctggctgagcaaacagcacctttctcattgagcttcctctactgacctctgtcccccttgggatttcatcttctgaccgaaccctgatgttcagtggcagagacagcccatagccagaactgtgggtagaccagggttggggtgtgcggtttgggacagcccaaaccccagccgctgtgtcaaggcctaggacgccatgctgccatcaaaagggggttccaggtttcc

SEQ ID NO: 5090 - DNA, 1172 bp, Homo sapiens
actttgatgtttctaaaaataaagtgagcacttttgttctttttaatattttatttatttatgtatttatttatttatttttgagacgcagtcttgctctgtcaaccaggctggaatgcagtggtgcgatctcggctcactgcaaactctgccttcctggttcaagcgattctcctgcctcagcctcctgagtagctgggattacaggctactaccaccacgcctggttaattttattttgtgtgtgtatttttagtagagacagggtttcaccatgttgcccagtctggtctcgaactcctgacctcaggtgatctgcccaccttggcctcccaaagtgctgggattacaggcatgagccactatgcccagcccactttgtccttcaatttcttccttcttcttcattttgacccccagtttacatcattaagtacatagtctcgaaacctcaaagtatcagtgttatccttatttttttttctccttctctgaatttgcctgatagtcaaaacctgtgcctactaccacttaaaggttttttttttcatctgtctgactagattgtccactgtctcaccaaatcttgctttgactagtaataatggcagttgagagtactgcctatcacttgaccagactagctaaatgctgaacattcattataatatttaaatctttaaaccaaccttgatttttattttgatttatgagatgactctaccaaaggttagattctgattttggagagctagatcataatagagtcagaattctgttcttaacttctacactgtactccaacaacagtcaaactgttactttctcattcagggtaaaatcctgaccaaacccattactgaaaaccttccttttttatctcagctcccagtctccaccccatgtatctgatacacctgtgacaatgatcttttctccatatctagaaaatatcaccaacttacagtgccgtgttatggtataggctcttatttccacttcctttcatcacagttctatttatttctcaatacacagttgaagatcagttgaaatatcaatttcagcataacttcccatacttgggcataatttaatagcttaccagacagtagcatataatgtagtgacttgggagccagacttcctgggtttgaatacgggatgaaaat

SEQ ID NO: 5091 - DNA, 1215 bp, Homo sapiens
aagaccagtttgggcaacccagggagaccctgtctctacgaaaaataaaaattgaaaaattagccaggcttagtggtgcatgcctgtggtctcagctacttggaaggctgaggtgacaggatcacctgagccagggaggtcaaggctacaagtgaatgatgataatgccactgcactccagcctgagtaacagagcaagactttgtctcaaaaaaaccccataaaatatggatatagattgattattgtagatctggagctgcaactacagaaatgaccattttttgctatgtgcagcagaagagtcagcttaagccttcccagcttccggggctcagctggcgctgctggggcaggtgctgcagagacttgtgttgctgggtggaagtcgcgctgccttctggagagggccacagagaaactttccagaatgggcttcccagaagcaaatgtgaagttttgaaatggggctgaacttctgtgaatccatgggaacaagagccagtggaatttgaatcgttcatgttactctccttttgtacccacagactggtgatacctgaggaaattcaagtacattgcaattttttaattaactttttttttttttttttgagacggactcttgctctgtcgcctgggctagatggcgcgatctcagctcactgcaacctccgcctcctgggttcaagcgattctcctgcctcagcctccagagtagctgggattacaggcgccccccaccacgcccgtctaattttttgtatttttagtagagacggggtttctccatgttggtcaggctggtctcgagctcctgaccgcaggtgatccgcccacctcagcctcccaaagtgctgatattacaggtgtgagacacagcaccgggcctttttttttttttttttttgacagcgtctagctctgtcactcagactggagtgcagtgggacatcatgactcattgcagcctctaactcctggcctcaagtgatcctcccacctcaggttcccaagtagctgggactataggtgcacaccactgtgcccagctaatatttttttatttatttttttaagaaatggggtcttgctttgttgcccaggctgttctcaaactcctaggctcatgcaatcctcccaccacagcctcccaaatactgggattacaggcatgagccactgcatgcagcctttaaattagctttttttttt

SEQ ID NO: 5092 - DNA, 3678 bp, Homo sapiens
gggtccctgtggcgatcccgccccttcgtctgatgtttgtgcctttgattggctcttaggtggatccctcagcgtggcttgcccaatggagcaatgccggctggtggcctggccgctccgccccttccctacccctcgcggagggcccgccccctgccccgcgccggctagcggaggagagtaaatacaacaggagcgcaaaatggcggaaccgccgagccccgtgcactgtgtcgctgccgcggcccccaccgccaccgtctcggagaaagaaccgtttggcaagctgcaactctcctcccgggaccctccgggttctctgtccgccaagaaggtccggactgaggagaagaaggcaccgcggagagtgaacggagaagggggcagcggcgggaacagcaggcagctgcagccgccggcagcaccttcgcctcagagctatggcagccccgcgtcttggagctttgcccctctgtctgctgctccctccccgtcctcttctcggagcagtttctctttctccgctggcacggccgttccctcctcagcctccgcttccttgtctcagccggtgccgcgcaaactgctggtccctcctacgctgctgcacgctcagcctcaccatctcctcctgcccgccgccgccgccgctgcctcggctaacgccaagtcgcgcagacctaaggagaagcgggagaaggagaggaggaggcacggtctcggtggggcccgagaggccggcggggcctcccgggaggagaacggggaggtgaagccgctgccccgaggtgggtgccgtgcggggagggggaggggagggcgccgtgggtccccgccgccccctggcgcccacggggcccgggaagggggagcgcggcggccgcgtgcgccggcctggaggggctgggaggcgtccggttttcagcagaggattttgcagttcccaaggggacaggaaatggagcctgtaatttcggttgcagagagggggatggccgacactcttattttctgtatcgtttcttcctcccagttagtgcgctgcaggatttgtgaaaatccatcttgaggactctcctaggtttgtttggctagggagagagatggagggaacgggatgggggaagggtttggttttgtaaaagatgcttgattgattgttagaccacttagacgtggtcgcgggaattcgtatttgtgacacagcgttcaaccccggataatcctgtcaaaaaaggggtgtggagagagcactggcgtcagctggaagctaccagaggcctgagcttttcatccctattagggaaatgaggtagcgtgcagggcccgaagtgcgctgtttcgtaaggtaccctccctgcaccctactctccgctgcgtattcttaagtgttttgggtggtcctgtttgaaataccacccttctgaaagaattttcagccatattctttttttccctgcagcaaatgataaaaccaggagctttgacgatttttcgccagatcaagcggctgcagaatgtttgagcattagaaaaaggcgaattcttaagggttcttgtcagacagggtcagttttgtttttaaatgtaggctagtcgtataatttttcaggtgtttccaccacttcagctacggatacacaatgatctgacaatagtgcaacatacggactagttgaaaatcaaatctttatgtgatcgcaagcttaaagcgcataatctttattataaatgtgcactgctacacagtgttgtcaaataactctttttgttttttagaaaaagaaatgtcaagcagtttcagcattgctgatctaacagtagctcagatcatgaaaaattctgtttggattataatggtttgttttcacaacttaaaacatgctgcatgtgcatgtagcaatagtgtcacttcttccttgatattttttgcctgtagcaaagctttaacatctaagcatagccatcagggactctggtgcaatgtaaatatctttcagcttctgggagtgttgtttctaggaaagtggttttgaggatgggattttggtacttttagtcaggaattccaggtgattagtattttaaagctattttgttttaacaatttatatgtaaaatttaggagataagtgcctggaagtttgtccatatgcagcttggtatcatcactagtgtttgtggtgtgtaaactgcacatttgctgtaagttctctgaaagaggaagtgaatatgagtattacatagttggagtaatggaatatttgagaagaaataagtaagcattctttaacaattctaacttaaaatgtggagtacacaaatggtccttaaagtgaaatggctgttaaagaggaatttttatagtcttttcaattacatttagaatccttcttcttttgagggttaacactaatattattaatcctgaatataaacagtgataggttttacattaagatgtgggaatgatcttttcccatgacctatgtgggttttttggagtagtgacaagatattaacactactgtaagattttcattttttcagacacaaatgctatcttgttgaggaaaaactatcagagaaaaagattcctttccagtgtcttggtggtaaatttaatggtgaaaatttttccctcgtaacttggggaatacttatatctttctaaagtttggatttaactgaattgatgttctgttttaacgaattaagaagattcttaaatagcggtattaacaagtggtatagcaagaatacatatatgcctttattatagatataattgcaaatatgaaagtcctgatttgcaatacaatgatcatttctctgtgctttttgtaaaaatcttagtgaatgggtgaccaagtgtttgtttaggtatatacctctttttagtgttgccctaagttggctgtgcatggttcagtaacccctcaattatccacagctggctgattgaacagtctgagtcagaaccagacattagctataaagacacctaaacaaggaagagattctccctcaacaaaacaaaactgaaccacacacactcgaaagacctagcctgcaccccaatttgattaaacaattaagctcctgtatttattaatagtagggcttttaaaaagtcctaagtcagaactgctttatttttacattggtgaccattctaacagaacgtatttgggttaaatgaaagcatgtataagaaagggcctagcagggtatttagtaaatgttatttgagtctgaagcatagttattaattttttaaccctataactaattgaaagatgggtgaatgctgatagaggaaggatcattgacagatatgaaagttaagaatgctgaacaagagaattatgaaagtatactaatatggccccatttagtaccagggcctgatgcctcacaatctctaaggccatctaatcatagtactgtagctgacttgcgtgatagcttgactcaccaagtaaaagttaaatttcttataagaaggaaaagtgcaaaacagtttagattttttttttttttttggaaacagagtctcgctcttgttggccaggttggagtgcagtggcgcgatctcggctcgctgcaacctccgcctcccgggttcaagcaattctcctgcctcagcctcccgagtggctggaattataggcactc

SEQ ID NO: 5093 - DNA, 1348 bp, Homo sapiens
gattttttttattgtgtatgggatgataagaagtttagagaattttcttactagtaagtacctttactaagtaatagctaagtataaaatctttagttacagaaagcttgtgagcaattaaaatccttttacatttttcttgcagaatgggagaaaaatatggcaaatacaaaactgtaaaataagggcaatgacaatgactcaactgccatatagagatataattaacaaaatactttgtggtacctcttatctctcaggatctcctccctaccctagcaaggcaaacaacttggagtacttccttttcgaaagaagttctagaaattaaattgaggtaggagacggattgacagtgcctaactaaagatgagtaaaacagacctctttaatgatagactcactatttgacactgcttctactattgtaattaaaaatcagaagtctttgatgtatgcgttgctgtaagaaactctgctcattgcaaatctattttgtttgtttttggtattattctgggcacatactttggttgatgactttcaattggggttctttgtgctgccttttgggttactgttggtatttccatttctggcttaatttatggtaaccatcaaaactgcttatatttctggttagggcgaagccatttaggaagaagcatttcaccagaacaagtaaaagttaattgcagcaatgatgtcagttttggcccctagtttaataaaaggataggcaaatatcataggaaatcttcatggtttgtaggaaatcagtgtttgcaacgtaggaagtttcatgggatagggaaggtataaatcaagatagtaagggttttgttttatatgtcattgtcttaccatgctccccacctatttaatcttctgttttaagctaaatttatggatttgcacctacctttttgagtggcagaagttcttaacaaaccagtattgagaaataagaagggatgtagttaaaatggttttctgtttctctttaaagttgaagaatgatatatttaacaagagttgtgttttatttccagttttccagtagcatatatgtagatgcattgaggtcatactgtgagaaaatgtctttagggtatccctccaaaataggagccttaaactttttaacttaaaggaaggcatatctaaaaaccatagtggttgcttttaggtatagtttcctatataacctatagtcagacttatctataatatgaaaatttaattgttttaaaaatgcatacatcggccgggtgcagtggctcacgcctgtaatcccagcacttagggaggccgaggcgggcggatcacgaggtcagaagtttgagac

SEQ ID NO: 5094 - DNA, 1155 bp, Homo sapiens
tggctgtccaatatgttaaatggaaatgttggaatatattgcataattccatcatatttatgatggtaagaattccagtttactgaagctataactatttggaaattgaaatttaaaactggtttcaatttgtagtttttatcaaagttctgcagatagatgttttcagagatagttatacaaaatttaggaaaatagcggccatagagccccttttccacagtttctgtttcccagggacaaacaggttcagctctttcaattgatattttatttaccattcataatgatacatgtttgacttccagtcatctgcagggtcatagagaaatagtcactcattggcatggtgtgagagaaaatggatcttttattttaacagctttcaactagtctgcctaaagatgggactaactttattcccgtttccaggggatgcttaaaccatgaatccctgaaactttgttttattgcataaattgggttaatattctcctttctctactattgctgtctgctgtctcggatctgctaggtcagttacaagtcacatatcttctttcaagcttcatttttgttgtttttttccgttctctctgttctcatgtatgtatgcgtttgctgtcatttcagttagatattgtaaggtagtaaagttagatgcttgtgtttagtctggctttttgtattctcttggaaatttggttattctttttatatattggaataactttttttttttctttgagacaagagtcatgatctgtcgcccaggctgaaatgcaatggtgcaatcttggctggctgcaatctctgcctcctaggttcaagtgattctcgtgcctcagtctctcaagtagctgggattacaggtgcgtaccacaatgcctggctaatttttgtatttttagtagagatggggtttcaccatgttggccaggctggtctcaaactcctgacctcaagtgatctgcctgcctcggcctcccaaagtgctgggatttcaagagtgagccaccatgcctgacatgaaataacttttaatagtttgcctgtttatagtacatgggtccaggacagatacatgtttcattttgctcaattcaattacattattttaaaaaactacttttattaattgacacataatgtaca

SEQ ID NO: 5095 - DNA, 1224 bp, Homo sapiens
aattttataatttatcattcaaatgatgagagtctagggtggtgaaaagtgaactattgataatcacgccaggacagcacagacaaggattgtccaggaaacttccatgtgtagtcaccctagatagtcttataagtaactagaccagtaatagaagatttcctatcaaatcagaaataagtggtggacgcaaggatgcagtcacacatagagaaagaagggcaggaggagatgagggggagaaaacactaagggcccttagaactacttttctccaaggttagaaatggcatatgtagtccagcattaggaatattagcatacaaacaagaacattcaagccattcctgttgtgactgtaaaacaaattcaagtccttcctttatgagattctcgggaaaaagacagagaaaagagaagtaaaacatagcacggcttgtcccactatggaaaggtattttcttttgttttcaattttcaaaattgcaagtagtggggacatcaagaagtctgttatcaacagagactattatcacatacagaatagtcacgtttgtctaaaaatctttggtagagatggaagttggggagatttttgttcttttctgggaattggtagtaatgacttagggtcaatgtttaaataattaatatgaagatccagaaggcccattgattaaaacttttttagggattttttgggcagagttatacttttatatatgtaagtttaagcttatatggaattaagttagtggggaaataattctttttttttttgcacagagttctccagcaaggattaatgaaattttgataatgtaaaggtacttaacacataatattgtcttgattgaatatgaattttcacatggaagttgagaaactctcagtatttagttatttttactgcacaatttcacacattaaaatattgatattatttgctgtgttgtgtaatggagccttgttcagaaatcgtttttctatgtgttgtgtgtttgtttgtgtcctcaacttcattgtaagcttctaatgagcagaggttatttttcataacttctcttgtggagtgccttgcagagttctagacacatagcgagtgtttcatatattcttgttgattgatgtggagcctggagttgccacctctgggcactgagcctaatgctctgaaatcagaggcgctgccagcctgctgggtgggagaatcttcctgtctct

SEQ ID NO: 5096 - DNA, 1194 bp, Homo sapiens
ttctaatcctggagagtgggcattccagatgcctggagatctccctgggcgtggagcagagagggacctactgcaccaagatgtctacacaggactggtggggcaactcaggctgttgaaccaggccaggaggttttctgaatgcctggagatctgcctgggtgtggagcagatagggccttgctgtaccacaatcaatgttcaggaggagtggagtggcttagactgctgaaccagatgagtgggtgctctgaatgtctggaaatctgccggggtattaagtagagaatgcctttctgcatcaggatttctgcatgagaaagttgggacaggtcagcttgctgaaccaggtgagtgggtactctaaatgcttgaagacctgcctgggtgtggagtgaagagggttcccctgcagcaagatctctgcacaggagtggaggtgacttaggttggtgaaccaggcagacaggtgttctgaatgcatggagatctgcctgggcatgtagcagagagcccgctcccccaccatgccacaccacgccctgcaccaggatctcttcacaggaagggtaggacagcttaggctgctgatccaggtgagcttatgctctgaatacctggagatctgcctgggtgtggagtgtagagggtctcactgcatcacgatttatgtccaggaagcgtggggttcagttttgcctattcttaaacctagaaaaaatgaatagtacattgcaatgtcttactgcaatcttaatgctcaggtcccatccattaaggcccccctagccaaaattcagtattactgaaattaataactttgtcaaattagcagctggtaaatatttttctattgtacatttgatgaatatgttctgtttggtccttatttcaacagtctctcagctgtagtctgccttcacctttgaaggtattacaatatcccctagcctatgcatgggatatctcaacagatttgtctttgcatgccatctttgcaagtaagatcttagttgcatccaactttctccaggaacacaggtatgacactttctcttgagtagatttgtttgacacacacttattggaaatatgagtacatctttttgtctaaattaaaatcaacagacattcctgttagtatcctcaaaggcttcctcactgtggaagctttaatagtgttctctcatgcct

SEQ ID NO: 5097 - DNA, 1219 bp, Homo sapiens
gtagttctgtaatctgaaaatggaagagatcaaattgcaaaagacttttaagagaatcataagaaaatgaatcaattgtacattaagaaaattgttacttagatgttatgtgttttaggaaagaaataaaattaataaatatagaaaatgataataactgcagaaagaactgaagaccaacagacttgcagaatgtttagaattatatgttaaacacatttaacatctaatatataatatcacccatagtaattgtttaatatgtgttaatgaatactatgaatactggacataattagaaagcccttgtacatatatttctattattgtgtgggtatttgttttgagcaggaaggaagatgagaatccttcaacaaatagcaatgtcaagattgtattattatagacacttttttcaggaaaatttaaatttaagagagaacattgggcaaatttgctaatattttgcaaatagagcttcacgtattcttataagctttcattagtaagactcaactggtcttttttcatagtccaatttctatttccttatttgtagtcaattctatacataggatcatattactgaagctttgataaactgcctttgaaactactagtcatgaaagaattgtaagactcagtaacattcaagcaaagaaaatttctaaggtggcactgggtcaaagttaaagacttttcaatctgttgagtgttgacaattaacatataaataacccctccatttcaaaagctactgtgtgtgtgtgtgtgcgtatgtgtgtgtgtgtgtgttcattcctcagtttgccctcaagcatatattcaagtcagtatggaaatttttaagagtgttctttgtcatttcttaactgacacagctcatgctagcctggtttatattctcaactatgcattgacaccaaagacactaaagtggagtgatgctaattcctgttttaaacagttaaattccaactcagtagtgcacaatggctaacaaagaaggtctttgagtattgacattctagatggacaaacagatgcaaattaagtgatttaccaagtatctcacagaatattaacaaagcaatagttattatcatcttctattctttaaatcccattgacttccacatgtctttattagtgttcttaaaacccacaaaggtatttttatatagaacttaaaaatacataaaagcataaataagaacat

SEQ ID NO: 5098 - DNA, 1171 bp, Homo sapiens
ggtgtaatcccgcgcccggcctacatgctaatctttaatgctaatcatgttctgcatttttctttaacaattggggttttaaaaatcaaagtacatatttttcttggttttaaaaataacattttgttgtaaaaaattgttaatatgaagtgtacaaattgatagtgaaagcctctctgaaattccaaccctacctccaaggcattatgggtttgatttgtgtactgtgtacttccaacccaacgctggctcactggaaatcatcttgagttaaaataatttttagtttgcctattatctagccagtttttaaatatatgtacagatggttcttgatttatgtgattcaacttataattttttgactttatgatggatttatcaggatgtaaacctatcataagtcaaggagcatctgagtatcccatgtatattcatgctttattacacaatgatctgattatttgtcagcacatttttaaattctctaatgaaatgtgtggcttttgtttatagactgtggcagggtataccattcctccaggacatcaggtgtgtgtttctcccactgtcaatcaaagacttaaagactcatgggtagaacgcctggactttaatcctgatcgctacttacaggataacccagcatcaggggaaaagtttgcctatgtgccatttggagctggtaagatgattatattttagattggaaatgtttgttctgataacatatttgtctctgtcaaaatattccgaattgtgtttacaaattatctctccctttcctcatagggacatttttgcaaacttttttaggagaagaatctttataagttggagaaaaatatttcctttgtaccaaatggaattgttccataaatccttatataatgcttcactacttcctaacctgtctggttttattaggtctaatttttatagaacatccttgttttcccttacaatggtatttaaagctctttgtggattctcttttaaagaaccattggagtcagcacaccattcagggaataacagattactagcatttcacaaaaaagcaaaggcagtcttttaaaattaaagctcttctcgatcgttagtcaacatttttgctctctgaatatccgtatgagaaaatggtctttaaatttgggcaggttgtgtgtag

SEQ ID NO: 5099 - DNA, 1178 bp, Homo sapiens
aagcaatctccccacctcagcctcccgagtagctgggaccacaggcacacgctaccatgcccagataattttattattaatttttgtatagagatggggtctccctgtgttgcccaggctttcttgaactccagggctcaagtgatcctcccacctcaacctcccaaagtgttgggattacaggcgtgagccaccatgcccagccttaagagtgtttgattttcattcattttcctatatatattatttctgttggggaaaaaattccaaggaagataaatagtaggctgttggtacatttctcaacttacttataaagctttttagatatataaggttaatttatgaagaaaatcataagatacacaatttaagataatatttttaattttattttttatttgttaaataaatttttctcctttcaggtgtcacgtcttgaaattttaaatgtcctcagtgactctctacctctggcagatgatgttgaccttcagcatgtagcatcagtaactgactcctttactggagctgatctgaaagctttactttacaatgcccaattggaggccttacatggaatgctgctctcgagtggactccaggcaagttatatgaggaagttgttatgacattttatgagtgataaaagaagtacaatgtcaaaatttccaccttaaaaaatgctattttttaaacaactttggtaaaactgtatagaaacataaatttacctttagttgaatgttccatagttggaatatgggttttgcagagaatttataattatgaagtttgatgtctgtttctttaacattaccttaatattggcaaaaacatgttggtgtttgcaaggatattatttaaattgggataccatgaattaaatactacaaacaaaaataattagagttttttgtttgtttgtactttaacttttaaaaaataatcagttaaagttgttgttttgaagctcacattgttccaatctggccaataggagccccttttgtatggctcctgtatctttatgacatgtcctcatcattcttgaatcacttcctcacttccagatacagtaagttattcttggccaggtgcagtggttcacgcctgtaatcccagcactttggcaggccaaggcaggaggatcatttgggcctagtttgagaccaaat

SEQ ID NO: 5100 - DNA, 1138 bp, Homo sapiens
ttgcacatatgttcactgtgaaatgctgaaattccacatctctgagtttcagaatcctactactgtagtattttaagagccatattgaattccacttcttccataaatcttttctgaatctgtccaaccttaattgctcctcccatatttccaggtgttgccaaagcagttttacctctgggataatacctagttaggtggatgttggtctcccataccagatggtgaactcctggaaagcagtggcagggtctctttcatcttcatattccccatagcacctcacattcagggtacattgtggtatcaaactggtaaaaaaaaaaaagtataaaattctcatctttactatttttctgtgattcattcattcttgtttcgcggaatgggattattcctgctggtaagtacattgttcttgagtagaagttgggtactgtaaatgccacaggggaagatcacttatgaatactagtacaaaacaaatcaggaaagaatagatctctctgcatacctagtttaaacataacttgtagcttccttccctctgttacacagcctttgaagttatgtttttagtagtaaatctgtagatacgtgaagctacaagtcaaatattttagctcagttcccccttttctggcagccatccaccgaactgcagggacaagttttcacagataaagaaacattttgtgggagtttttatttttgtgctgaaaaatgtagttcagtgatcttgctatccaaggcttttagtaagttgtgagcttggagtgagcagccttgtggttcataaggttaattaccatatttacaaatccattaatgacttaaaagaaagaactggcctgatagggtttatctctctaaaaattgcagccactagccaatcaggaatatagaaacccaaaagagatcgtagaagtgacaagagtaacggcaataatgtgttagtggagaagatgctatcagagcaaaaacaataagtggaaactaatcaaaacaattggtcattttaatgtactcatatcatatgtcttaagtaactggtaaatcatgaaatttgcttatttcacttaaattattttgcctgaattttattatgtaattgttattgcttatttaggatgcagca

SEQ ID NO: 5101 - DNA, 1201 bp, Homo sapiens
tgagagaggtgaagaaatgatagaaaaattcttctgtcatattttctaacttttccctgcagctttcacttctgcctcacacttagaactttctcctccactccagttgttaggtcagaaatgcagtcactttcactctgactgtatgaagtatatttctaatgttgaacaactttctcttttccttattctctctttcatagaagggccccatgcacttttgtgggattgtaataatgcaaacagcagtttgagatggcttgcatccctgttgttgaagatgccacgggcgttcttgggctgagttcatatttccaagacagaaaagctcaaagatgagtttctggcttgtcaacgctcagctgatctacaggcggctacttgtaattccttgaatgcagtgcttgcttgctctggctctggctcccctgctttggaagtaataatccccagtgtctacattttaaaacttaaagatgttaccttgggaaataaataggtagcctcaaaacattagttgctggcatgattattgttatattcttggaaacaatatgttagtaaaagctacagtgctgttttcttcttcggtcactctttggtagaattttattttattttttgtatcttcatgtaagaatttttgtgcaatgtttatgcaatagcagtttaagtgcatttgattatttaaaaaccacgcatgtttagcacatttcactttgtatctaattgtcttagactaatcaattttttggaatagatctttggcatcctgtaccacgggaatcgccatggtatctgttgtgacatgtacgcagactcttttctgataaatgaagccgctcatttaaaaaatgtataggagttaggcagctctggtatgaattctttcccattctttagcttttcacttccttatctgatcaccactttgattattatggagatttggggttcgctgcaaatttgaaagaagggatcacagtaattttcttacagcagttaaagtggaatatttgttacctatttcttcagcagtatgcatggaagtatagttgctcttttaccttggaaagcaaaataagagaaaaaatagccctgaggttttttgtttctccttcttagcaaattcatgtttcttgctgtgcagtaaaatgacattggcttttctcttctatgaaatagttaatcagtgtagcac

SEQ ID NO: 5102 - DNA, 1198 bp, Homo sapiens
ccctccacacctccctgcaagctgagggagcccgctcccgccttggccagcccagaaaagggctcccacagtgcagcggtgggctgaagggctcctcaagtgctgccaaagtgggagcccaggcagaggaggccccgagagtgagcgagggctgtgagggctgccagcacgctgtcacctttcattaggacctgctaattggtttcacatgtgtgtggaaccatcccaggactggattccaatatgaggagagaaatgggttatttcactgaaaggtatgactgagttagactgaagaaactcttatatgacactgtactatggctttaatgagcattagtgttaggatgacattttgtttagagagatattgatggtaaaaaagaaaaggatttgaactccagttcaccatttcctaagcatgaccttgagctattcattcactctatgtagtcatttaataaatatttattgagccctatataggccaagcactctgtgaggtgatggaaattctcctgccctcaaaaagtaacagtaattattatttgcaatctacctccctaaggcataacaatgcctatctttcagagttatgtgtaataggatttgtaagtggatttttttttgtctcataattgtctacttggctccaaagttagagacaaataggtgaaaattaggagacaaatagatgattggtaaacaccagtcattaagaggcaaattcattctgctactccgcttaccactgtactcactaatcttgaggggactactgaattgtaaatcttcagcctcagaaagggttctgtgtcttttccttttactctttctcagtgccccttatgcataatccaatggagtattccaaggaaaatatttttaatgactgggggttgcctgcaataagttgagcctgaaatctcatttttcagttggatacctactcatgtcatggatctgtagtattctttttgcttactccagcagtaggaaataatatagggacagaactcaagagagagaaaatgagcaatagggcaatgaggcacactcccattgtctggtagaaaaaagatgcatgagtcttccatatgtcaagtagatactacaaaggtaccaggcttgaactattgtgaagcaagttcatcctagactgtgacttactaagagaagagaccccagcagcaaaagc

SEQ ID NO: 5103 - DNA, 1239 bp, Homo sapiens
ttgggattacaggcgtgagccaccgctcctggccccgatttattaatagatcttataaggacattttaggcctcacgcatcagtttcttaggacaagcttttctctgcactgcataataaatcagacggcagtgcaacaaaaaaacggtgatgatttcccgaagaacaaaccaagttcagaagcctccctaattgtcagaacagcaggtagcctgggcggagctctgaggctatccttaaacaggcgcactgagacgcaaggcgctggaaacaaaagagctcctccttgcgcccttccgccgccccacttagtcctgctccgccccggacaccccgcggccccgcccctgtgcgcgctggttggtcctcgcaggcatgatgaaacttcccgcacgcgttacaggagccaggtcggtataagcgccagcggcctcgccgcccgtcaagctgtccacatccctggcctcagcccgccacatcaccctgacctgcttacgcccaggtgagccgggtcctgcgccccgtgccctgcgccccgcgccagcatcctcctcgcgtgccctggggctgctccggaaggaaggggtggaggatgcggtcttcagcctggcacccggcagacgcggttcgcgggcgcctgctgatgctgcggctcctgcggtagggagggcggggcggacgcctagcgattgttacgcacctgacagctagcggaaggacctttctgtcctggttccctgaagcatcgagagggaaccgcggccggcaggccggaccgctccggagaggaggcagcggcagtttgagcccctgtaaatgttatatgtgtacttttttttactatgtggcgtcgaagcctgtggacattttcgcggtccgggtccctgcggcggacgggtcggatcgtgctcgtggccagggcgcagtcaggtgtcgcgtggtcctgatctaggaagagactgcggccttatcaccgtctcggtgtctgctttcaccttcaactgcccccctcctcacctggaccgctcaccctcctcctcccctctcaccccgccatccccaccagtccccacctgtctctgtagactgcaagactcatcaagtgacttgctgagcaaaccctgccgagaagaggtctgtttagggacacaggcgaccaagtacagaaaaaggcaaaagaactagcatgcctttttcaatggctgtcattttgcagggctggcttcagatgattgttat

SEQ ID NO: 5104 - DNA, 1166 bp, Homo sapiens
tcccaacccggtcattgtcatctcagatgccggcgatggtcacagaggcacagaagtgacccctgagacgttcacagctggctcccagggttcataccgagactctgcgtacttctcagacaatgactctgagcccgagaaaaggtctgaggaggtcccgggaacctccccatccgccttggtgttggtacaggagcagcccctacccgagccagtcctccccgagcaaagtcctgctgcccaggatagctgcctggaagccagaaagagccagccagatgaaagttgtctgtctgctttgcacaactccagtgacctggaattaagagccacgccggagccagcacagactggtgttccccagcaggtgcatcccacggaagacgaggccagcagtccctggagtgtgctgaatgcagaacttagcagcggcgatgacttcgagacacaggacgatcgcccctgcaccctcgcttccacggggaccaacacgaacgaactccttgcctacaccaattctgcgctggacaagtccctgtccagccactccgagggcccgaagttgaaggagccggacatcgaagggaagtacctggggaaactcggggtgtcagggatgctcgacctctcagaggacgggatggatgcagacgaggaggacgaaaacagcgacgactcggacgaggacctgcgggccttcaacctgcatagcctcagctccgagtcggaggacgagaccgagcaccccgtgcccatcatcctcagcaacgaggacggaaggcacctgcggagtctgttgaagcccacagcggccaatgcccccgacccactgcccgaggactggaagaaggaaaagaaggcagtcacgtttttcgatgatgtcacagtctacctgtttgaccaggtatctgttccctctaaatcattttctatacacatccatataaggattccaaaatgtgctaggaaattgagtgtggtctgttttctagttgccattttgaggcagcagattgtgattactcacaaaaagtaatttggggttggttagagttctaagaatatgcagaaatgtcatttgctcagggagttcgtattaaattaagagaaagagacccgaatgctcttcctgggtcttctaatggagtcttcctgaattagtcacc

SEQ ID NO: 5105 - DNA, 1148 bp, Homo sapiens
ggccgctctggcagacctgtgcccgcctcttagcagggtgtggttctcagggtacttgggtgtgatttaattcttcccttctccttgggttcttttgtgtcccattttcctcgttcaccttttacatttgatctcatttcatcatttcagcatctttttactgagagcctgctctgtgtcaggtgatgttctggacactggaaacacagtggtagctggtcctcagtagggtgtatgttctagtgaggggaaataatgaacagaaagaagtgctaatccctcaggaggcgagatgggtgccggggtaaagcagccagggctggtggggttggagagggtggtgtcgtgttatttcatcttctgtgtatttatgggagttgagatttttcatggagcaagatggggttacaaatcattgtgtttgttgtttccaccctgatgttctccttcctggagctcctctaccctgtgaagtggtcaggtgccaccagctcttcttagactcttggattctaaatgtggagagggcggtcctcaccccaggcacacaggctctttctctttcacctcatttcccaggtctggccattgttccctgtgggaattctgtggaggcagcaacccctcgctgggctcttttgacactgtggggccaccacggggtcctcacccctgcacctctttgggacagtgtgtacatcagaacaagccatggacttggggagcaggagcggactgtaatcctgagacacaaaaccctgaacatcataatcccggatgttgaaatccctaaagatcaaaatttctaacctctcaaatcccgaaaatataatgctggaaaaaaacaatttaaaaattctttaaaacatacacagagataccccaaataatactttactaggtaggtttccaggtattccttagtccagtcaagttgatgctgtaaacatggcacccataggcatctccttaaaccatgcagacagtaacatgtaatagtttctaacctgatgcagctgtgctgtgatgatgattttttcagggattttgatctttgaggatttcgacacttggggttagggtgtatagaattgtgtcttttgggattctgatccaaacccccacggttggagttgagcagctttatc

SEQ ID NO: 5106 - DNA, 1229 bp, Homo sapiens
ccaaagaggtcatgagaaccacgtttgcaggtgcttagtgtggctgtggggtttagcaggcacgttgggaaaaggcacgcctgcagcagggatgccaggctgtcccgaccttaggcattgctggacaaagagccgggcagggagggtggcaaagggcatggacagcaggaggaggagttttgaggactgcccattagctaggtttggtgtctgtaccatcgttctcccagtctcctgtctctcaggagccacaagctgaggttttaaaattggagacaccataaggaaagtagtgtttggggtgaacagtaaatgaaatgtgggatctcaggtgtctgtggtgtaaatgagagtgcttcctttggtaattgcatcataagatctttgcgataatcatgtccccaatggactctggtgtgtttttcccgtttgatctttactgacatttaccgcagagtctcttatgctggtcccatcaggcagcccagcaaatcatcgaactccaggaagctgcacaaatcaacgcaggcttacagccaaccaacctgggaaggaacaacagcctgcacgacatgaagacggtggtgaagacctggaggaaccgactgcccatcgtgtctgacgacttgtcccactggagcagcatcttcatgtggaggcagcatcattaccagggtaaaccgacctggtccggcatgcattcatcatgtaattttccagacgccccacggttctggtttcgtctctgtgttttggtttggtttggtttggtttttttttcccccaggttttctattttggggtagggaatgacaggtcggggtggtaatggtacagggaaagatgaaggtggtagaagaagtaaagttttgttttttgtttctgtacctgttacatttttctagttggggcagaatcgtacaggccggggggatcaatgctctgagccatggcactctgcgttgaaggtcccatcccaggacgagttgtgctcaggtggctctgcgtggccttttctggttttcctggtccccctcttatcccctaaacctgtcaggcatccacgtgtttagagcagcctttgtcattttatgatttggttagccaagatggtaacactccactcaagaattagcaccttttaaaagttgcttatggcataaaatacaaagtaacgagggtttatcacagagctgcccattttcataagccatgtgtgtgtgtgtttc

SEQ ID NO: 5107 - DNA, 1099 bp, Homo sapiens
ctccagcctgggcaacagcgagactccgtctcaaaaaaaaaaaaaaaaaaaacaaaaaacaagcaatataatcaaaaacaaaaacacaacaaccttaaagctgaaacagcaataagtcaaactgccgcggcagttcacagttttacctggggtacctgctccctcattgcaaggcaagactgcatttagtatatatgtgaccaagaagaatgagagaagtggaaaacactggagaacagaaagtatcaagaacctttcatcaggcaatgccaaagcgctctgctcttttcctcttctttgcctctgtatcctctgtggttccagttccagctgaacttgtgacaatcccaaatcgctccttcctctttttcagtttcttatcatcttcagactttctggaaattgaagagacattcaaaccaaatctttgagctctttccttcggcttatccaagttaaccataggtgtgttcagatgacagacttttgttggaactgaagaaatcccaaacctagctgcctgagcagctttcttactctccaagctcacaggtacactgaattgttcggccctcttctgcattctctcagcctgtggtatttcagatgtaattttcaccactttcttctctgctgccacatcaacagtttttttcagggggttcttcctatttgacaaggggtttttttcttcttctgtttcatctcctagtacatcttcatttgcctcctcttcagcatgttcttcaagatatgcctggagtctgtggataagatcttgctttattcccttggtctccaaaccacaagaagacattcttgctttagtttagcaagcttcagcttatggagctccaccatctcagttaccatcttgttacccctccgggtgtgctcttttaataattgtatgtggggtggggtgcggtggctcaatcctagcactttgggaagccaaggcaggcggatcacgaggtcaggagttcgagaccagcctgtaataattgtatgtgggccaggtgtggtggctcacgtctataatcccagcactttgggaggccaaggtaggtggatcacttgaagccagtagtttgggacc

SEQ ID NO: 5108 - DNA, 1175 bp, Homo sapiens
aaaatacagcacactgtgaaaatttggctcgattttcctagtagccaatgcagaaagagaaatgagttgagtgggataatctggtaccccagaaaagcatggctgttccggctctgaggcttgagaggagcttgtctggtgggagattggcgggaggtgtcggtggcagcctctgactaggctgtttctgacagtgtagtgtacaccccctacccccacctcactcccattctgtggcaccagggcggtcctgcctctgaaggacgggttctctggggctgtttgtctgagcgtgtgttccctctgttccttctggaaagaaagtggttggccaggtggcaggttggctcctgaggtgtctttgtgccccccgggtctgctgattctgcagagacaccggcaggcgggtcatgggtcatctctgaagggaattctcaggaaggctttgtgtgatctcagcctgcttcctgccatgctgtgccttcactgtaaccttttaagatacttaccatcttgccttcctgacttcagagcacgagcggctccgcaaataccactgaagaggacacactctgcacccccccaccccacgaccttggcccgagcccctccgtgaggaacacaatctcaatcgttgctgaatcctttcatatcctaataggaattaacctccaaataaaacatgactggtacgtgtgctgattgcctgcctgtctgccgtagccattatcccatgttccaggggctcctgtggcacaaggtggggggaggtcgtctttccaggccgttgaccggtgaaggcctttgtggacttcccagaccaccactctggtcgtgtcccagctccctggagggcagggtgtcatccagaccttcccgaagcagcagtgccgaagtccgtcccttgccatgagtgctgtgggcaggtgcatttgcagacattctggcctttagttggctggccctttatggtgtaacacaaaggcttgcgtacctgagagcgccagatcccaccccggctgtcctgtggctccaggcagggatggcccgcatcctgtgtttctgcatcaccctggggcatcaagggctacagggtgaggtgacccggcactgtctggagagacctcaggcagcactcacgcccaggctgcagggattgtggccctccggctgag

SEQ ID NO: 5109 - DNA, 1184 bp, Homo sapiens
gtggatcgcttgactccgggagttcaaggctgcagtcagccgtgatcaagccactgtctgaaaagtaaatgctcgtctgaaaagtaaaaaataaaaataaaaatagactgggcgcggtggctcacgccggtaaccccagaactttgggaggccgaggcggggggatcacgtgaggaaaggagttcaaggccagcctggccaacatggtgaaaccctgtctctactaaaaatacaaaaattagcttgctgtgctggtgcacgcttgtagtcccagcgcggcctcttcccaccttttaaggtagagagcccaggctgaggcgcccctctctctaactgcaggaccctcggatttttgctgtccaggcacctcgcccttcgcttcatggccttctagtagttccagggtgttcgcagttgtgacctgcttcccgtgagcctctgctctacgcccctggatggggcgtgcattccctacccagcagccctcgcgcggtccggcacagcggacaccaggactccaaaatggcgtcagttggtgagtgtccggccccaggtaaggctgtttggactccgtggtggaagcaggagccagggtccagggtccagagccacactgggagagaaggaagctgcggagctgcctgccctttgctcaggcacttcgccacgacctcacttgaggcgcgccagaccccgctccgcctgcccaggcgcgccttcctgctgcccagggcctgcgccaaccgggttaggcgtggagggtgaaggcatctggggcacgcgcttctgggcctgggaatgcgccgccttgggccactgttcctctttccgctaagaaatagccgcttccctctcccgctgcgacccagttgctttgcacttgaatgttaggcgcagcttttgcccttttttcccaaggcttaagctcagatgaagctccaggaggagctcaggactaggactgtacctgataccatgtaaggttcgatgcatatatgttgaatcagagaggcgaggtgacctgttcaaggtcacaactcgtgcgagggctgagctggtattcaaacctgaggattcgtggtaaatgaactttattctctaggacggccttatgactagcaggcttttccgagacacccatgtgtaaatcgctacattcatcccgctgtgcacactgatgattt

SEQ ID NO: 5110 - DNA, 1184 bp, Homo sapiens; identical to SEQ ID NO: 5109

SEQ ID NO: 5111 - DNA, 1099 bp, Homo sapiens
gcaggggacgctccgggtttgtgcggcggctctcggggcctgtggcaccagcttttgagtatttttggcggtgtcaagtcttcggcagcgagaggagcaaagtccgaagaatgaatggatggtgaacgcctggacttggttttgttagagtgggagatgagccgtggttgttagtggaaggtgttcacgtgattgtgaagcggcattttggattttgtcaaaagttaacagtcccctccagttaaagttttaagagtttattgtgcatgcagaggaacagctggcaaattgttccaatggcagcttggaaagctaaatgaggaagtgcagtgatcttgattgtaattggccattatcaacttgcattccttctagggtaagtcgagctggatcagcctcgcatctgtagctgattggttcagtttatcatgcggacgagaaaaaagcttctttcctggtcagcgcacacttttcagggaaataaggaattgttgttgctgttgtgtttgagacgaagtgttactctgttgcccagtttggagtacaatgggccaatctcgactcactgcaacctccaactcccgggttcaagcgattctcctgcctcagcctctcgagtagcggggactacaggcacgcgccaccatgcccggctaatttttgtatttttagtggagactgggtttcactatgttggccaggctggtcttgaactcctgacctcatgatccgcccgcctcggcctcccaaagtgctgggatttacaggtgtgagccaccacgcccggcctgttgtttttaagagagacagggtcttgctctgtcacccagggtggagtgtagtggtgccatcatagctcattgcagtctccaactcctgaactcaagggagaaatcaatgtattttaaatgccttacatggctgtgggtggttggcctagggccgtacccaaaacatggactccatttaatttttcattagcaagtctgacattcagatgcacagccttcacaaacacattcagtaaatatagtgcaggggtgtccaatctcttggcttccctgggccacattggaagaagaattgtcttggactacac

SEQ ID NO: 5112 - DNA, 1177 bp, Homo sapiens
aacctgtcatatttccaacctttttagacatcagagactacataaaggggaaagaccctataagtgtgaagaatgcgagaagagcttcaaacagcgctctgacctctttaaacaccacagaatccacactggggagaagccctatggatgttccgtctgtgggaaacgcttcaatcagagtgcaaccctcattaaacaccagagaattcacactggggaaaagccttacaaatgtcttgaatgtggggaaagatttagacaaagtacacaccttatccgacaccaaagaattcatcaaaataaagtgctgtcggctgggcgtggtggctcacgcctataatcccagcactttgggaggccaaggcaggcagatcatttgagatcaggagtttgaaaccagcctggccaacatggtaaaatcctgtctctactaaaaatacaaaaatgagccgggcatggtggtgcatgcctgtaagcccagctattcgggaggctgaggtaggagaatcacttgaacccaggaggcggaagttgcagtgagctgagatcatgccactgcactccagcctgggcaacagagcgagactccatctcaaaaaagaaataaagtgctgtcattttgatatgtttctatgtgacttggcctgtttcttttcttgtccagaaccacattccttgccatttggagtatatcagtcaattatggatcttccttgagtatctcctacaagataggttcaatctgtcctgagcctcattacagactgatagtttcagtgagtgaggaatgaggaagtagggggccttctgaaatgtgagctgatgccaggtaagagacttctgatgataagagccaggctgacatgtaacggggttctgtccttgttatctgcgctctacctttatgtattatttttgagactgggtctcgtcgtagccctccagcgggagcccagtggtgtgatcgtggttcactgtggcctcaacctcctgggctcaagtgatcctcttgccttaacctcctgagtagctgggaccacaggcacacaccaccacacccagcttttttttttttttaagagatagggtcttgctatgttgcccaggctggtctcaacctcctgggctcaaggaatcctcctgcctcagcttcccaaagtgctggaattacagacac

SEQ ID NO: 5113 - DNA, 1190 bp, Homo sapiens
tcgctcaggctggagtgtggtggcacaatgtcagctcactgcaacctccgcctctcaggcccaagccattcttgtgcctcagcctccagagtagctgggactacaggcatgcaccaccatacccagctaatttttgtatttttagtagagatggggttttgccatgttggccaggctggtcttgaactcttggcctcatgtgttccacatccagccttaaaatcaaaaggttttaataacttaattttaaacggaaaaaatgtaaagcaagtgcatattttgaaagcatagagtcggccaggtgctgtggctcacacatgtaatcccagcactttgggaggccaaggcaggcggatcacctgaggttgggagttcgagaccagcctgaccaacatggagaaaccccgtctctactaaaaatacaaaattagccgggcatggtggcgcatgcctgtaatcccagctactctggaggctgaggcaggagaatcacttgaacccaggaggtggagttgaggtgagccgagatcgtgccattgcactccagcctgggtgacagagtgcaactccgtctcaaaaaaaaaaaaaaagcattcacgtcaatgtcaagagaacctgctactaatgctttctttgataggcagtatgataggttggaaagaatataaactgggatcaagcttgggttccacttaccagctgtagtatgttgagcaaattatttaatctgacactcattttcttggtttataaaacatgaaaaataatgtctaccttctgggtacaggattgaattagattatgcatataagtacctggcttgtgtcgggtgcggtggctcacgcctgtaatccagcactttgggagggtgaggtgggcggatcacaaggtcaggagttcgagaccagcctgaccaacatggtgaaaccccgtctctactaaaaatacaaaaattagctgggcatggtggtacatgcctgtgattgcagctacccaggaggctgaggctggagaatcgcttgaacccgggaggtggaggttgcagtgagccaagatcatgccattgcactccagcctgggcgacagagcgagactccataccccccggccaaaaaaaaaaaaaaaaaattaagtacctgccttgtgctagttactttaatattttggaaagaatagcaagcgatatgagc

SEQ ID NO: 5114 - DNA, 1207 bp, Homo sapiens
tctgtttgcaaatcttgatatatgaagtgacagtggagattgtacagttttttcctcgatttgtcaggatttttttttttttgacggagtttaacttcttgtctcccaggtaggaagtgcagtggcgtaatctcggctcactacaacctccacctcctgggttcaagcgtttctcctgcctcagctttccgagtagctgggattacaggcgcctgccaccatgccctgctgacttttgtatttttagtagagacggggtttcaccatgttggccaggctggtcttgaactcctgaccgcaggcgattggcctgcctcggcctcccaaagtgctgagattacaggcgtgagccaccacccccggcctcaggagcgttctgatagtgcctcgatgtgctgcctcctataaagtgttagcagcacagatcactttttgtaaaggtacgtactaatgactttttttttatacttcaggaatagtaaagaaacacatcataaaacctcccaggacataaaggtgagcacagaccctgtttggatcaagtcagttcctggagcctgaatgatgactgctgaatcacgggaagccacgggtctgtccccacaggctgcacaggagaaggatggtatcgtaatagtgaaggtggaagaggaagatgaggaagaccacatgtgggggcaggattccaccctacaggacacgcctcctccagacccagagatattccgccaacgcttcaggcgcttctgttaccagaacacttttgggccccgagaggctctcagtcggctgaaggaactttgtcatcagtggctgcggccagaaataaacaccaaggaacagatcctggagcttctggtgctagagcagtttctttccatcctgcccaaggagctccaggtctggctgcaggaataccgccccgatagtggagaggaggccgtgacccttctagaagacttggagcttgatttatcaggacaacaggtaaaaagaggtgaaacctattatgtgtgagcagggcacagacgttgaaactggagccaggagaagtattggcaggctttaggttattaggtggttactctgtcttaaaaatgttctggctttcttcctgcatccactggcatactcatggtctgtttttaaatattttaattcccatttacaaagtgatttacccacaagcccaacctgtctgtcttca

SEQ ID NO: 5115 - DNA, 1090 bp, Homo sapiens
aagcagcagcttggcttgttttattaaagacataacaattagagggtttgagggctgaaaagcgagtatcgctctgtgtggcgctgcgttctcccctgtggatgcccagagcctgtgctgagttctcagtgatgcattttcacatatgaacactggtgagcaaagtgaatgtggctctgaggtgtttctgtctcttccccacttgaggttcggctggctcatcgggaacaggtggctctgtatgtggacctggacgacgtagccgaggatgaccccgagttggtggactcaatttgtgagaatgccaggcgctacgcgaagctctttgctgatgccgtacaagagctgctgcctcagtacaaggagagggaagtgagtggttagagaacaatggcaaacaaagggcgaggcgtttaagcttctgtagagaggctgctcagatactgatgttttctgagcaggcagaaaggaggggcacttctgcctggtgttctctgtgctctcctttccccatcctgttgctcttttttttttttttttttgttcttctcctttaggtggtaaataaagatgtcctggacgtttacattgagcatcggctaatgatggagcagcggagtcgggaccctgggatggtccgaagcccccagaaccagtaccctgctgaactcatgcgcagattgtgagtggtctctgtcgggaaagatgtagggattggttctccaggatcttgtttgtgactgttttctccccttagtgagctgtattttcaaggccctagcagcaacaagcctcgtgtgatccgggaagtgcgggctgactctgtggggaagttggtaactgtgcgtggaatcgtcactcgtgtctctgaagtcaaacccaagatggtggtggccacttacacttgtgaccagtgtggggcagagacctaccagccggtacgtgtggagcaagaagcaggaaagcacttacccattagttgttttgtagagattaatttgatcctgtgatgcctattgttttatttggttgtaaaagttgcctgtgtgttcgcctttcattcttgggtatgtagtggtctttctaccta

SEQ ID NO: 5116 - DNA, 1205 bp, Homo sapiens
gcaaaggaggaggtggcagtgcccgctacaaccagggccggagcaggagtgggggggcatctattggttttcacacccaaaccatcctcattctctccctctcagccctggccctgcttggacctcgataacgggggaggggtgccctagcatcagaagggttcatggccctttcccctcctcccccctcagctgggcctggggaggagtcgaagggggctgcagagagggtagagaagggactttgcaggtgaatggctggggccccaaatccaggagattttcatcagaggtgggtgggtgttcacaatatttattttttcatttggtaatgggaggggggcctgggggtatttatttaggagggagtgtggtttccttagaaggtatagtctctagccctctaaggctggggctggtgatcagccccaacagagaaaatgaggagtttagagttgcagctggggaaggggtttgaaggaagttggaagtggggaggggtgggggcatctggtctcagaaatggaccagctggatgcagggcaggggactgagggtgcttgagtaggatgtgagacttcatgggcctgggttctgttgagttttttcagtatcaatttcttaaaccaaattttaaaaaaaacaaggtgggggggtgctcatctcgtgacctctgccacccacatccttcacaaactccatgtttcagtgtttgagtccatgtttattctgcaaataaatggtaatgtattggaccccatgtgtggcttctgtgctgtcaccatcagtgcctgagccctggctcctagcagaggtctcagagcctctgtgactggctcattttctgccggcttttcacttcccttggcacctgtcccccaggaggcgggcctagacaataacctctgatctccaaattgcccaccctctgggcctctgagcatcttcgtttgtacaacagggagaattgtggggaccaaatagaatctgtgtgaaaaagcaccttgtcacctgcaaaatgctctttgaacatgaggcttttttttttttttttttgagatagagtctcgctgttgtcgcgaggctggagtgcaatggcgcgatctcagttcactgcaacctccgcctccccagttcaaatgattctcctgcctcagcctcctgagtagctgggattacaggcgcctgccaccacagtcagctaa

SEQ ID NO: 5117 - DNA, 1186 bp, Homo sapiens
ccccgcctacggtgggtgggatcgcgcggcagagacaaaggagatcagtagggccggacatagctgcgcagggaagtagggtgtcagtttggggtggtgggcttttgcgggggctgtgggggggttatatttaaactcccagagccgttaagttggttcgtagtctgatgcgcgcgcaaccagggtggtggcggagtgcgcatgcgtggttcccgggcgaagggaacgcgcgctcaccgtgcgcgctcgcggccgggtggtagtggcggaggagaaaggggtcggcgcacgcgcggttgagtcctcgagtagttcgggtctcgcgggcctcttgttttggtctcgcgggctagtagggcgcacttggcggggaggcgcttgggcgcgagactaggcgtgaagagcagagctgcgcgcgcactcgggaaaggggggaagggagcagggtccaggcagggggggttaggccccctgatccccctcgttaccccgactggcacggaataaggggaggaaatgatcgagatggcggcggagaaggagccgtttctggtgccggccccgccgccgccgctcaaagatgagtcgggcggagggggcggccccacggtgccaccgcaccaagaggccgcctctggggagctccgcggcgggacggagcgtggtccgggtcgttgcgcgccatctgcggggtccccagccgctgcggtcggtcgggaaagccccggggccgcggccacctcctccagtggtccccaggcgcagcagcaccgagggggcggcccccaggcgcagtcgcatggggaggcccgcctgtcggatcccccggggcgagccgctcccccggacgtgggggaggagcgccggggagggggcgggacagagctgggtccccctgctcctcctcgaccccgcaatggctatcagccccaccggccacctggggggggcgggggcaagaggagaaatagctgtaatgtagggggaggcgggggaggcttcaaacatccggccttcaagaggcgcaggcgggtgaattcggactgtgactctgtgttaccctccaacttcctcctggggggcaatatctttgatcccctgaacctgaatagcctcctggatgaggaagtgagccgcactctcaacgcggagacccctaagtcatccccccttccggccaaagggc

SEQ ID NO: 5118 - DNA, 1105 bp, Homo sapiens
gctgctgctgacgtctgtcccttgtccttgtccacctgctctcctctcccccaggctgacctgtgctcgccctcggatctcctccagggcactgcccgggggctgcggaccgcgctggaggccgtgaagcgggtggggggcaaggccctaccgcccctctggcccccctctggtctgggcggcttcgtcgtcttctacgtggtcctcatgctgctgctctatgtcacctacactcggctcctgggttcctaggccccaaaatcggccctccctcacccctttcccttcctctctatttataaggtccctgctccacccgaccccacctgcggtgccttcagccccaaccaaagacactagtgcacccccttcacagacactgacctcagaggccccactctggtgcccccagaccctgggcccccagcctctggcctccctccagtagccccacgagtccccacctctcagtgctgacggtgccttcatgtccccgccggccctgcccctgccctctgtaccccgtgaggggtggcaggagctggagtctcccccttcctcctgtgccctccccttccccccccaacagctgctatgggggggctaaattatctctattttgtagagaggatctatatttgtaggggttcggggcccaggccgggtccctatctctgtgtataaactgtacagaccgtggccgccctgcctgtgtgtgtgtgtgtgcgcgcgcgcgcgcgtctgctccgcgtgttggtggctgtggccatggctctgtgcccaccagcatctccctcctgagatgccggcctctcatgctcccggagcgtccgccaaccccccgtgtcacctcccttctgttatcgctgacagctttcttgcgtctcatttgtcgccgagccccgagcgcacggtgatgctcgggtctgcccccgaccccctgccacaggccggaagccgcagggggcaccgtggggaagctaacccggccccttcccccaggagtcactgtgccagccccaccacatcctggaagaggagggggccccgggaaggggcctcccctacatcgctgctgtcgtccacgccctgctggaccggcctt

SEQ ID NO: 5119 - DNA, 1158 bp, Homo sapiens
agtatataaaacaaactgtaaacgatctgatttgatcttgacctagcaaccctctgatgctggcagggcgcagatgagcagctgtgttagaaacgtggacacaggcacagaaggggagctggtgggtgcatcagctctaggtagactggcaaggtcagaaggggccttcaaggtcacccagcagccctgctcaccccagcaggggctctcaaacacctgagtcgggatgctccgccactcctcccggagatgccagggccagtgccagagcccaggtggcccatctaatgtgcttgttgtgatgcactgatagcctctgccccaaagcaggcatgccttttgttcagcaggcagcagcatgtgtgtgtgtctgtgtgtgttatgtcttgtgtctgcgtgcatgtgtgtgtctgtgtgtatgtatgtgtttgtgtatgtgtgtgttgtgtctgtgcatgtgtctgtgtgtctgtgcatgtgtgtctatgtgcatgtgtatgtgtgtctgtgtctgttcgtgtgttgtgtttatgtctgtgttatttatgtcgtgtgtgtgcgtgtgtatgtttgtgtgtctgtgtttgtgtgtgtgttgtgtttatgtctgtgttatgtcgtgtgtgtctgtgcatgtgtatgtgtgtttgtgtctgtgtgtgtctttgtgtgtgtgtttgtgtttatgtctgttgtgtgtgtttaggtctgtgttgtgtgtgttgtatgtgttgtgtgtgtttgggtgtgtgttgtgtgggttgtgtgtatgtgttgtgtatgtttatgtgtgtgttgtgcatgttgtttgtgtctgtgtgtatgtatgttgtttgcgtgtgtgtgggttttgtgtgtgtgtgtgtgtgtgtgtgtgtgtgtgtgtgtgtgtgatgtgtgtatgattcctgtgttgggatcaggtagatgcgggtgatgtgactaagatctggggccatctcttagggatttaatggcttcttgaggagagacagtcatagggaagttccgtcagggggttccccagacgggggctagagggaggtggcactggactctgcgtgggggtcctggggaagacttcaccggaggcgcaggcgcagtgggagccgaacattgaaggagaattccccagccttctgcatccaggcagaggac

SEQ ID NO: 5120 - DNA, 1333 bp, Homo sapiens
tggccagcaggaccaggctcgatgctgagtcaaagatcaacttaggaggaaatttgagttttgggtgagagcgactccctggtggcctcagccctgtgacactcacatccaggacagttcccggtgccaagcgctggttatgtgtggggggcttgactccctggtcccaacgaggtctcagtgtgttgcccaggctggtcttgaactcctgagttcaagcaatcgtctcagcccagcctcccaaagtggtaggattacaggcgagagccactgcgcccggcccctggtcccagttctcaccacagcccctgcagtaagcagtcgggtatgtcactgacagagcagaagctcaggggactaaaactccccgcctgagttccctggtgaatggatggtggggccgagttccattccaggctggatggagcccagagctgtgggtctcctaccctcccatcccctcattccagcttgatcttccttaagagactcatacgccccaaccccttggtctgagtatcttagattgttctcgtggttcctccgtccttcaccactgaaggctgctgttcattctctctccgtctctgtcccttattgctctcacgtctgtctctgtcatcttttcactccttgtccctcttactccgttctttggcccccaatgaaagctgagtcagagacagacgcttcccctcagttcccagtgcctcccttgggggcccctccttggctgtatccgtcagtggctccagggtaagtctgccccccccaccctcgtggggcggggagcccggggcagcccagaggctggggggagggggtggacttttggcccgtttcggttattccctccatctcgtcaacagctgccgcgcgcaggcttagctcattcctctgacctgccaggaagcagagagacccacagagcaggagggaggcagaaagtggagacggacctgagcccgaggaagaggcaggcagaggctgaggctgattccaccccagcctgcctggacaaccctccttagccgcagccccttccagttccctaggggttctgcccctccccctctctggggcaccagccccccagggtcctgcatcccaccatgtcgatggctgtggaaacctttggcttcttcatggcaactgtggggctgctgatgctgggggtgactctgccaaacagctactggcgagtgtccactgtgcacgggaacgtcatcaccaccaacaccatcttcgagaacctctggtttagctgtgccaccgactccctgggcgtctacaactgctgggagttcccgtccatgctggccctctctggtat

SEQ ID NO: 5121 - DNA, 1202 bp, Homo sapiens
gcacccacgcaccccgcacacgcagatgtcttcacgacagccacttttcttctgctcggagcgttccttctacccaccatgcccggtcaacagatcctcaaccactagacaccagaggtgtctacaccgcaggctcggcgaggctcggggacggtcccctcctctacgcggcctcccgtcccttcggctcctaggaggcgcggcatcctgtaccttggaaaacaacgctcttccagtcctactgtcctttagctggacacggaccgtgcctcgttcatctctctgacaaaggccgggaactcaagaaatcatttcttgagtgaatgaaagagtaacggtaggaggtccgaacagaacgctcagaacctccgggcgactaggcttccgggtgtcggtttcgttggctcccgagagggaggaggaagcgcttcttctggggccgctctaggaggaggactcggtgggctggaggactcggagcaacgctcaaggcatctgcgcaggagccaccctaggcggggaggcggggccgagcgaagcccggtgcggggcacggggaccccactggccaatgaacgactcagctctgcaggaggggcgcggcgccacgccacctggaagtgaaagagaatgtccatcgcttttatcagattattttattttcagaagttgtcatctcgggtactaggcttagtacctgggtgacgaaaccatctgtacaacaaactcccgtggcacaagtttatctatataacaaacctgtacgtgtaccctgaacctaaaagtttttaaaaagtactgatcggccgggcgcggtggctcactcctgtaatcccagcattttgggaagccgaggcgggcggatcacgaggtcaagagttcgagacaagcctgaccaacatggagaaaccccgtctctactaaaaatacaaaattagccgggtgtggtggcgtatgcctgtagtcccagctactcgggaggctgaggcagagaattgcttgaagtcgggagaaggaggttgcagtgagccgagatcgcgccactgcactgcagcctgggcgacagagcaagactctgtcttaataataacaataataatgcatgaaagaaaagaatcaagtattataggttgggcacgatggctcctgcctgtaatgccagcactttgggaggccaaggtgggggtaccacttgaggccag

SEQ ID NO: 5122 - DNA, 1188 bp, Homo sapiens
cagtttgcaagctctttcaggtaccgtcagccacatgccaggccttcagtggggtgatgttttttgttgtttttagaaaatactgctattcactcatgggaaatagggacgagggcttagatttcagctgctttgcattagacaatgatttctcttattataagcagagctctctattaaccaaaaacacttggctgttagacatggtgtttaattgctgttagaatgtatttttgtcacactgccctataataagccaaagaactgtttgtgccaaacagtgaagggaagctaggggaggatgaaaactgtgcctgctactccacctcccttctttcgaggtcgtggtgttttgtttgctgttttagctgtggtgtgtgtgtaccactcgtacctttcacaggaggacacctcatctgaataccagtcaggacctgagacgcgttgagcccctccccacagtgcccacgggtaggtgcgccgctctctgccccttccgggagctctgctttttctacctttagagatttctttcatcctctattacgtaggcctgactttttgcctaataaaggaaaaacaaccatctatttagcactctttttttttttcccaaaatggaaatgactttctctctgatttttacaaagcaaaaaatgagagtaaagattaagaaactacaagaaattatggtgaagggagtaaagatggccatgaatcctatgactgccgatggtttggtcccaggatgcattattcagatattttctccctgtgggcttatgtaaacagaaagctaggtgagtggaagtaacacgtcaaatactgatttgtggctgggtgcggtggctcacgcctgtaatcccagcactttgggaggccgaagtgggtggatcacctgaggccaggagttcgagactagcctggccaacatggcgaaaccccatctctactaaaaataaaaaattaaccaggtgtggtggcacacgcttgtagtcccagctactctggaggctgaggcaggagagtcgcttgatcctaggaggcggaggttgcagtgagccgagatggtgccactgcgttccagcctgggcgacagattaaaaaaaaaacaaaaaaaaaacctgatttgcaacaattttgtgtcctagcctagagtttaccgtgctattgaaaatatctttcggc

SEQ ID NO: 5123 - DNA, 1197 bp, Homo sapiens
gtctttttagtagagacagggttttaccatttggggcaggctggccttgaactcctgacctcagctgacccacctgcctcagcctcccaaagtgctaggattacaggcgtgagcccctgcacccggctgaaccttcccatttctaatcagaactgaccctgggatcaactgacctccttggagtgtagaggcatcctggttgtctggggactttgggtgggatctctgccagttttgcctgcagcagaaggaaagggaagtgacttatcttaggcacctgctttgaacaaggcactgagctgagcacgttcacatgtatctactaatttaatcctgacaacagtcctgaaaaagatactttccccattttccatctggggagactgaggctcagagaggtcactggcctgcccagtatggcgctgccagcaagggttgagctcatattgagtctgggtcggtgtgaccctacagccatgcccttgacactatgccattcctgccctcctggctggttgtgttctgctcacttccaagaatgatttccaatggcttgcaaagttacagttagcacagtatgacaagcaaggcatgagactgggagtgagtgggaacgaagaggaaagaaagtgagaggaggctgggcatggtggctcacacctgtaatcccagcactttgggagaccaaggcaggaggatcactggagcccaggagttcaaggtcagcctgggcaacatagggagacccaatctctattgtaaaaataaattgtaaataaagtgagaggaaaaggcagttagaaccagaattagacaactatccaaagttccccaggccctgtgtactttgtaaagatgagatacagacttgattgtgagcttcccagcaaccaatgcaaaaagggcaaccagataagtcatgtgacttacgctgtccacaagctcaaaacaaagcatgtgttgagggaaagcacagctcctctggtgttggcaaaaaaaattctccctaaagatcctcgtaaaaagaagtcacttggtttcattgccggttacaagttgctggcaaccaagtgccactggcaggtatcttacagcttaatagaagcagcattacattggtctaaaagaagacaagagaattacaggcccatttttaggagtggatacacctctttctataggtagaggaacttctgt

SEQ ID NO: 5124 - DNA, 1195 bp, Homo sapiens
cttctgaattaccaaattatggggtttcattagaagaaatgacagcgataacatgattaataggagtttttttagcagaatgccctcatgttaagccttccgaagcctttcttttaaacccctagtttttctcgcaatgatgttatttttgttttttaatatggaagactagaggttactctcagtcaaaaaaatatgaaacagttcactaagacccacagaaaaccctaccgtctgcttctcctacagagcgtttaattagtatttcctagataaggaacgtagatggtcgtggtaaaagacagctattttcaggcacggtttctcgtgtgctttaattacagaaagcactccaaagacctccgccagctgcagccctgcccctgagtccccgatgagttccagtgagtcggtgaagagcctgaccgagctggtccagcagccctgtccccccatcgaggcgagcaaggacagcaagccaccagagcccagtgacccgccagcatccgactcccagcccacaaccccgctgcctctctccggacactcggccctcagcatccaagaattagtagccatgtccccggagctggacacctacggcataaccaagcgggtgaaggaggtgctgacggacaacaacctcggtaggttctcctctcggctgctgagtcaggaggtggcagggagtttgcaggaggagcaggtgaagggcgggccctaggccaagccaaccacagagtctcaacttgtgtaggcaccctttgagaacatgaaacatcctatagttgtgaacagtaaggagcgtgccgtctgcaggtcagtccccacctcctccccaccctgcacccccacggggaccagttagaagatgagcatggagtcagagtggactcgggaggatccacacagactgtctcttttttttctttttttttttttttttttgagacagtcttgctctgtcacccaggctggagtgcagtggcacaatctcagctcactgcaacctctgcctccccggttcaagtgactgtcgtgccccagcctcctgagtagctgggattacaggtacctgccaccactcctggctaatttttgtattttcagtagaggtggggtttcaccatgttggccaggctggtctcgaactcttggcctcaagcaatctgcccacctcagcctccaaaattct

SEQ ID NO: 5125 - DNA, 1317 bp, Homo sapiens
aaaatacaaaaaattagctgggtgtggtggcgctcgcctgtagtcccagctacttgggaggctgaggcaggagaatcacttgaacccagaaggcagaggtagcagtgagccaagatggtgccactgcactccagcctgggcgacagagggtgactcctcaaaaaaaagaaaaatagctaaaatatgattgtaccactgcactccagcctgggtgacagagtgagaccctgtctctaaaaaaaaaaaaaagaaaataaagaaaaaagaatgtcagcatgtcagcgttcctccaaggagtggctttgggtcaagaagacaggctggctctcctaaacaaacggctccccacggctgggagaggcagcaggcccttactctggcctgagtcttttgggaggggccctgctgggccttctcctgccacctaccttcctggaccatctgtgcccctgcccacgcagtaccacactccccagactgtggaacgcatctccagtgccatctgggggccagttactgtacctggtccccaggcagagctcttggcctggcagcatccaggcaggtattaagtgcccagtgatggtggcacatgggtggggacggagccacatccaagtctagccctctgattaggaggatgacagtcttggaatttcttgttctctttctcctagggttctcgttctcccagctccagcctttctagtttcgaggcatgaggcaaaccattgctgtgggaatagcagtgaccattggtagggccatggtggccgggagaggaaacctcagggtcaccccagagcctgtggggagacggagggtgagctgttgttggagctgcagaaacgccttgaagggcagcatgggcgatgaggaatgccattgcagcctagaaattcggtttctggaggtttagcctgattttgaagagtatttaagaacagagggctccagaccaggtgtggtggctcacatctgtaatcccagcactttgggaggcagaggtgggcggatcgcctgagatcaggagttcgagaccagcctggcccacatggtgaaaccctgtctctactaaaaatacaaaaattagccgggcgtagtgacacacgcctgtaatcccagctgctcgggaggcagaggcaggagaatggcgtgaacccgggaggcggaggttgcagtgagccgagatcacgccactgcactccagcctgggtaacagagcaagactctgtctcaaaaaaaaaaaaaaaagaacaggggcctctgcctcagtttgcccgggagccagccagggcccatcctaatttggagcac

SEQ ID NO: 5126 - DNA, 1164 bp, Homo sapiens
gccgggatcgaagcctgtgagggacccttacggtaggggtgatgcagggtgaggagatgagggctttaaggagcgggcttgggagtggggaaggagctggaacgtgggtgggttcgattacaggtcacctcggggactctggggggatctgcctgtaaacctcgacgtagcctctcgggtctggcgctgggagcttcacgggcctgcagggagatgacacggaaagggtcgatcgagggtgctgaataccagtccaacggtgcctgaaggccgtggactgcaatgggcaaggagacagtgaattccagttaactaacgaaaaggaactcaaggatcgctgcaacccaggagctggaggctgcagtgagctatgatcgagccacctcacttcagcctgggcgacagagcgagactctgtctcacaaaaagaaaataaataaaaaaagaaaaagaactcagcgcctttgggctggcatggaaggactgtggttggttgcaagggcattccaacccagaaaactgcgtggggtaggaaggtggattggtgatgcctcaggtgagagagatgaggctggagaggttgtggggggggggaggtctgatcacagatgctccccggtgcatcagctgagcaggctggacttgtcccaaaggccctggagagctcttgaagggttttaaaggagtgatgaagtcaaatgtgaattttagaaagatcctgggaagggaacgggcagatatgaaggtgtggaggctggtaagccagtgaagactgccccaacgtccatggtaaaagtgcccaaggtcctatggaaacagcatggcatgcctcatgaattaaacatagaattacccatgatccgcaatcctgcttctgggtatatatccaaaggaactaaaagcagggtctggaagagatatttgcacacccatgttcatattcacgacattattcatgacagcccaaagatggaagcaaaccaagcatctatcaagatacctgggccgggttcagtggctcacgcctgtaatcccagcactttgggaggctgaggtgggcagatcacctgaggtcaggagtttgagacctgcctggctaacatggcgaaaccctgcctctactaaaattacaaaaacttgccgggcttggtgaggcacatctgt

SEQ ID NO: 5127 - DNA, 1182 bp, Homo sapiens
tgcccaggctggggtatggtggcgtcttcatagctcactgtagcactgaactcctgggctcaggcgatcctcccaccttggcctcccaaagtgctgggattacaggcactacaggcacctagctaactttctttttttttgtagaggcagggtctctgtcacccaggcttgagtgcagtggcacgatcatagctcactgcagccttgaacccctgggttcaagcaatcctcccacctcagcctcccaagtagctgggattataggtatgtgccaccacccagctaatttttttattttttgtagagatggggtctcgccatgttgcccaggctagtttggaactcctgagctcaagagatgctcccaccttggcctcccaaagtgctgaaattacaagcataagccaccatgcctggcctcccttcctggccttctggtctccagactggagagagggccacaaagtcctgcccagacagagggctgctaaggctggggtggggctgggggtgtgcagaagggactctgcaggggctgacctctgagtctcaggggacagggcaaattttttttttttttttttttttgagatggagtcttgctctgtcgcccaggctggggtacaatggcacgatctcggctcactgcaatctccgcctcctgggttcaagtgattctcatctctcagcctcccgagtagctgggattacaggagtgcaccaccatgcccagctgatttttgtatttttagaagagattgggcggggtggggggtggggtgcgggtttcaccgtgtggcccaagctggtctcaaactcctgacctcaagtgatcctcccgcttcagcctccccaggtgctgggattacaggcatgagccaccgcacccagcagggacaggacaattttgccagctggagaaggggtggcccccaaatgtccccttcaccaccctcctgcctcttccttcagaacactttttccctgaagccctcctgggtagccccctacccacatgcctcagcattgggaggtggggagtatgggggtcccccttctcctcagccccatttggagtaatgtcctgtgcagctgagctcacaactcctcctccacctgtcccttcacccggtgtcactggcaattgctcacttcctgggcctgcacccactcagctcccct

SEQ ID NO: 5128 - DNA, 1188 bp, Homo sapiens
ggaggttgcagtgagccgagattgcaccactgcactctagcctgggcaatgagagcaaaactccatctcaaaacaaacaaacaaacaaacaatttatttggactcttaaatgcttttggttggttggcatttctttgtgaattatttgtcaaaataattttttgtctataattggatgaatgctttgcgacaaatttgaagttttaacaaaagaaaatacatttttttaaaaggtaacaaaacttacttacttttatagtcttgttacgtgaaattaaggaaagaaaaatgaaaaaaattcagtaacttaggcttttaaagccatatgaaattctagaatgttttatctttcacctgaaaaacaactcagttggatcaaaaggtcctatttatcatatattctttactcttcaatttgcattttttttttttttttttgtgagacagagtcttgctctgtcgcccaggctggagggcagtggtacaatcttggctcactgcaacctctgcctccaggttcaagtgattctcctgcctcagcctcccaagtagctgggactacaggttcgggctgccatacacagataatttctttttgtattttttttttttttttagtagagacagggttttgccatgttagccaggctgttctcgaactcctgagctcaggcagtctgcccacctcgtccttccaaagtgctaggattacaggtgtgagccactgctcccagcctcaacaatttgcattttttttttgaggtggggtctcactctgtcacccaggctggagtgcggtggcatgatctcagcccactgcaacgtccaccgcctgggtttaagtgattctcctgcctcaacctcccgagtagctgggattacaggcatgcaccaccactcttggctaagttttttgttttttttttaatagggttttgccatgttggccaggctggtctcgaattcctgtccttggcctcccaaagtattgggattacaggcatgaggcaccacaactagccagcaatttccatatgtatagcactttaaactactaactcatggtctccttaaatgactaacagacatttaaaacaacgtttaggagttacaatctttattgaacagatgaataagcccaagtttagagaggctgagttactccctgcaagctaacatctctagtta

SEQ ID NO: 5129 - DNA, 1126 bp, Homo sapiens
agaggccattttgctatgccttcaccttttggtagagaataaatgagattgtctgcagaaagggtgaatatgagtttgaagagaggtttgaaatggccttgtggatgaataactcagtgacccacagacttgtcaattagtgtccaaggctaatggaagtcacatgacatgagtactgggaaaatcaggcaggctgtgggcagttcttggtccctcaggcagacctatgcagactggaagccagagtgaaaagctggtgcttctttttgggttggcctgagaggagtatggggtcagagtgagaatgacattgagagttgaggaccacaaagccctagccaggaagagagtgtagaatagcaatacagtatacttctaagtccctgacttatgatatttgtgcagatagaagaaataaatgagcaaatcagaaaagagaaagaggaagctgaggctcgtatgcgacaagcatctaagaacacagagaaatcaactggtggaggtggaaatggaagtaaaaattggtcagaagatgatctacaattactaattaaagctgtgaatctgttccctgctggaacaaattcaaggtactggttttaatgaaacttttcttcaactcacactggagcctggagataatgtagacagactccaaatagcagcacttgttatcacagaaacttgcagagataaattctgtgccacagcagaaaagtgtgaaaagtgaggtgcattttgaagctgtcagtcttacccattgcatcagtacacatgcacatatacatatgacagaatacttgtttctcaggaaattgaagatcatgagacaagtcttgatttatgttggcttactctgtcatggcttgttctagggattaggttttctgtagtttttcttttacagtcttgctctttgttttttcccacctcaagctggagcttgagtttaactgcaagaaagccctagagatccagcgtccctaattctatagatgaaaccgaggctgttttcagaatgattgatcttctgaagaaatgtattaaactggcagtatacacaaataagtggttttatttatgttgatttgtacaccaaatctgtaagatgtatggacttaaaacc

SEQ ID NO: 5130 - DNA, 1198 bp, Homo sapiens
ggtttgataatggtaagatgattatgtttagaaaaaaactatcagggttgaaaactgaaatatgtacacctgaaatttagaaaaagttaaaaacagccgggcgcggtggctcacacctgtaaccagcactttgggaggctgaggcgggtggatcacaaggtcaggagttcaagaccagcctggccaaaatggtgaaaccccgtctctactaaatatagaaaaaattagccaggtgtggtggcaggcgcctgtaattccagctactcaggagactgaggcagaagaatagcttgaacccgggaggtggaggttgcagtgagccgatttcgtgccactggactccagcctgggcgacagtgagactccgtctcaaagaaaagaaaaagttaaaaacatttacactgagataaaattatacctgttcagttgtcattgtctgtttttttgagatggagtcttgctctgttgtccaggctggagtgcagtggcgtgatctcagtttgctgcaatttccgcctccaggttcaagcgattctcctgcctcagcctcccgagtagctgggattacagctttgtaattatgttgatggatgtatttttgagtgtagatactatttttgtgtttgtgcttttagacctggaatcatttttctgataatgaggcagagcgggttaaaatgatggaagaagtggaaaaactttgtgatcggcttgaactggcaaggtatacctatggaactgctattgaagtcttcacttgagcttaggataaagtttcatttcttctttttttttctttagcttacagtgcttgaatgaaacactcacatcatgcacaaaagaagtaggaaaggctgctttggaaaaacaggtaatagaggaacacatcactcctacctatatgtagcatttaattctgctttgacctgtttcttcacctaatatataagtcaccaagtgcagggagtatctgatttctctttatgtttcccactgttttgttgttgttgttttatgtgttcggttttttggttttttgttttgagacagagtcttgctctgttgcccaggctggagtgcagtggcacgatcttggctcactacaacctccgcctcccgggttcaagtgattctcctgcctcagcctcctgagtaactgggattataggcgcacaacaccacacctggctaatttttg

SEQ ID NO: 5131 - DNA, 1099 bp, Homo sapiens
ttttctgttttgtttttgcttgttttttaataatagctatcttaataggtatgtggtggcatccaactgtggttttgatttgcatttcctaacagtgatgttgtccatttgtatatcttctttggagcaatgtttattcaggttatttgcccacttaaaaaatcaggttgttttcttgtgtggtaggagttctttatatattctggatattaactctttaccagaaatagattaccttcactatatttgtagatgtggccactacttattgtgtctaatatgccaggcgttttacaaacactgtaaagtttccttctcacaggtaatcagtccaaaaaccagcgtgccaaagcgtttccccagggctctgtccggactctgaagcactgcataaaggggtctgtctgagcccaatttacttccggtggggaagggaaagggaagacaccaccggaagcaaggaaggtgctgtgtaatcattaaggagcggaggcttttggagctgctaaaatgccggattacctcggtgccgatcagcggaagaccaaagaggatgagaaggacgacaagcccatccgaggtcagttgacatgggccggagctcggagctggggcgggactggagcggagctgccttggcactggagaggagctggattcccgctcctggctctgtgctctggcccttttgtgcccctagtaatttagtctggacaccggccggattaacttgcctgccttctcagtctccctcatccactacaagttctgtattatctgctgatggaaatttttattcattctcagctctcgggtcttgaagaagtcacgcaccctgcttggcctaataggccttgaaaagttctgcctggcggtgctcggtcacctgatcctctttcctctcctcctccttccccctgtgacagccgggagctgtcactgtgtagccacaattctgagacataattttcttaaaaaaattatttgaccagataatacattcacagggttcacaattcaagaggcagaaaagatatctttgaaaagcctcgcatccttggccccagccaccaacttctccacagaggcaactaatgtt

SEQ ID NO: 5132 - DNA, 1102 bp, Homo sapiens
catattcttttacaatctgtaataatgttgaaataaaatttagtttctctttactctgtgccagatgaaagtctctttttaccaatgtttttcgtgatagaagacactctaattcattcacttgagctactttgcttcaataatgatgtatttttgagctaatcagttaaaaataattttgtatctcttttgctttttatgtggacagtgataattaggggtagcaaaaatactgttaaatcttacttaagtacaataaaactattatattaacttaaaggatattataatttcaaaataaaaaacgattttttttagagacagcatctcactagtttactcatgctggtcttgaactcctgagctcagcaatcctcctgcttcagcctcctgagtagcctagcatattacagtaatgttttctaaaacgaatcttcttgtagcaatacacattaaaatatttacagatgatgttatgactgggatgtgtttcaaaataaaacaagagaaagtgaatgtcagctataaaggaaaccagattgaccataaattgatcattgttgaagctgagtgatagttcacgggggttcaatatactaaaatctttacttctatatatttttgaaattttccataatcaaaaggggataaatcttttgttgaaaagagagcctagcccacctccctgattatgctgatagtacgacaccaggcatagaggtattaaatgactcgttcaagaggatgcttacccctgccagagttttcactccaacagaatcaataaaattgacttgagtgaaatccaaaatgacagtgtggacgttatcccctgggggcataaatctttgcatttcctcaggaaatgtgcttttgatcactattgggggatattttacttcaccatcctcttcttcaggcttggtagcatcctctccatctacttctgcatcctgtgtcaaaaattaaaccaaaccagaattttatgaacaactcacatttctggttgtgagaaagatttataatggaaaatctgctcttgtgttcttaagctactgactctaccagaccccttgtaaaatatttgtcatattctagcctt

SEQ ID NO: 5133 - DNA, 1176 bp, Homo sapiens
ctatgggatggactctttctatcttagggaagagatctctttgctgatgctgagctacactcaccaccactgctcaatgaaaagtcctggttgccctagaaagaactgaaagagaaatgacttcaaggtttgggattaactggagaagaaaatgttacatttctaagggagaggacaacagatgtctcatgaaactgcatctaaccccataatgtttcaaatttttgtctttgtgaaggcaaattataatcatgtgggtgtttgcctaatcaccacttgttacacaaagtgtcttgtgctagtggttagcttatatcctgagatggctatggggccatacagattttcccccaaaacctatgaatatgagtgtactattggagttattttcatttactaaaaatggaatcttaaaattcattggaataattactgaaagggactgaaaatccagttattagtgaggttttatgacgataagcatttggaatatattatactgaattccatttactctgaatagcacctaggttagttagaataattaaaatcaggcattcacttttatgagttgaatgaattgcaaactcctaataccagctttttttttttttaattttactttaagttctgggatacatgtgcagaacatgcaggtttgtcacataggtatacgtgtgccatggtggtttgctgcacctatcaacctgtcatctaggttttattattattattattattattattattatattttggggtacatgtgcacaatgtgcaggtttgttacatatgtatacatgtgccatgttggtgtgctgcacccgttaactcatcatacagcattaggtatatctcctaatgctatccctcccccctccccccaccccacaacagaccccagagtgtgatgttccccttcctgtgtccatgtgctcccattgttcaattcccacctatgagtgagaacatgtggtgtttggtttttttgtccttgcgatagtttgctgagaatgatggtttccagtttcatccgtgtccctacaaaggacatgaactcttcattttttatggctgcatagtattccatggtgtatatgtgccacattttcttaatccagtctatcattgttggacatttgggttggttccaagtctttgctattctgaatagtg

SEQ ID NO: 5134 - DNA, 1100 bp, Homo sapiens
agcataatgcctgctgtattaagacaggcactgtttggccaggcacagtggctcacgcctgtaatcccagcactttgggaggctgaggcaggtggatcacaagttcaggagattgagatcatcctggccaacatggcgaaaccccatctctactaagaatacaaaaattagccaggtgtggtggcatgtgcctgtaatcccagctatgcaggaggctgaggcaggagaatcgcttgaacctgggaggtggaggttgcggtgagctgagatcacggcactgcacaccagcctggcgacagagcgagactccagctcaaaaaaaaagacaggcaccgttcaataaatagtaactttgctatttactcttttcttcctgctgtgtctgttcagttatctctggttttttgggcttagccagtccttgaccctaggactttcacatggatatttgtgaagaatctctgattacataggatattaaggtgtggttgtactttaatgctactatatgttattactctcttttcctaattcttttttttttttttttgagatggagtttcactcttgttgcccaggctggagtgcaatggtgtgatctcggctcactgcaacctccgcctcccaggttccagcgattttcctgcctcagcctcctgagtagctgggattacaggcatgcgccaccatgcccagttaattttgtatttttagtagagatggggcttctccatgttggtcgggctggtcttgaactcccaacctccagtgatccgcctaccttggcctcccaaagtgctgggattacaggcgtgagccaccatgcttggcccccttaattctttcgtaggttcttgacaagctctgatttcttcctcccctccatcccctcccctcccctcccctccccctctttctttctctctttctacaaaaatctcactctgttgcccaggctggagtgcagtgatgcaaactaggctcactgcaacctccgcctccgagttcaagtgattctcctgcctctgccttccaagtagctaggattacaggaaagcgccaccacgcccggctaatttttgtatttttagtagagatgg

SEQ ID NO: 5135 - DNA, 1133 bp, Homo sapiens
atactgtaaatatcctggcactgcttttcagaattctcaaatttactttgggggtttctctctcagctttagatggtgcttctgcctatttaaaaattacttttcattctgtttttttcttcttcttatctatgaaacgtgtattatttgtgtaatttttaaagatttttttggtaaagccaagagaataatgcttctttctctcttttgttcattcattgttaaatatgttatttaaaattacaacatagtgaacatgctgttttgttgtacacccgagagctacagataaaagcaatagtctgtgtttttgaagcaattataattagtggaatagacggacatgtaaatcagaacttctcctgcagtgagataaatactgaaatagagatatactttggatgttaatgtatgcctgtcaacaagcatgggagttgatgtggagggaacacaggaaagctttcatagaaaatgggatgctgagttttaatttagttcaaggcttctcaacctctccactgttgcccttcggggctggataattctttgttgtagggactgtcctgtgcgttgcaggatgttttgcagcatccctagtctctacccactatgtagcagtagcaactccttgcccagttatgatagcaaagaatgtctctaggcattgtcagatattccctgaggccagaattgcccccgattgggaaccactggtctagattctagaaggatgagtagagatttcctggggctgggtaggatttaggattgttttttccaaaccaaaaaagcaggttaagaaaagacgttggaaagcatatttggtacctggcatgtactttagtttttgaggagcatagcgagaaataaggatctaggagttaggcaggatgtagatcctgaagggcctgttaggtcaggttgagggtctttgcctcaaccttaatctaaatggggattggtgtatagaggctggattatggatcgccggtggagcaagacatgcaaaactagagaccagggctattgacgtattctggggagggagaataagggtctgaacccagttagtcacagtgaaggtaaaagagaaaggatgaatttaatagctgtactgtgtcagacacatttag

SEQ ID NO: 5136 - DNA, 1317 bp, Homo sapiens
tacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgatttttttttaattgcaaagactaggtgtatatttttttctgtttttctaaatgacccgtggtacttaataggtgtactaaaattgtgttgggagcagggatttggaaatttctgagagatgtgtagttaatttagtaattctgtttcatgagatatgatctgttatgctagtggtttaataggcttgctatgtaagtagaacgtggctcaactagatatctttatatgtatgggcattactcttagtgatatttgtttcctgtcctttgttgctcatgctgtttaagtgcaggctgagacccagcctctttgtaagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcacattttgcttcctaatctttttgttgtacagggattcaggtttcttattcttacaacatgattgtttatatgtgaagcacatcttgctgttgccttatttttgatgcttttattcatgacaagaattgtcaatataagaatgtatatcttttttgcaaccaatttaataaaggagttgaaagaaagagtgcactgattgttaatattacaaagaa

SEQ ID NO: 5137 - DNA, 1226 bp, Homo sapiens
catctcagtatggttttgatttgcatttccatgataattagtgatattgagcatcttttcatgtgcttgttggccagccatttatttatttgctttggagaagtgtctactcaagtcctttgcctgttttttaatcatggtatttgtttttttaattgttgaattgtcagagccatttatatattctgaatattaactccttattagatatatggttagcaaatgttttcccccattctgtaggttgcctttttactctattgattgtttcctttcctgcacagaaaatctcaagttaggtatagtccagtttgtctatttctgcttttgttgcctgtgttcatggtgtcctatacaagaattattgccaaatccagtgtcacagagcttttctcctatgttttttttctaggagttataatttcaggtcttaggtttaggtccttaatccattttgagttagtttttatacatggtatgaggtaaagtttcaactttattcttttgcatgcgtatatccagttttcccagcagcatttattgaagagactgtccttttcctattgtgtagccttggcacccttgttcaagattgtatgactgtatacttgatcgtttatttttttgtctctctactccattggtccctatgtctgtctttatgctggtaccatactgttttgattcctgaagcttggtaatatggttttttccatttggatgggttttatttgggtttttagagataggatctccctttgttgcccaggctggctgcaaacacctaggctcaagcaattctcccacctcatcctccaagtagctgagactacaggtgtgttccactgcacctggctctgtaatatgtcttgaagtcaggaagtctgaggcctctagctttgtttgtttgttttttccctcaagaaagatatttggatatttgggatccctggagattctctattaattttagtatttttttatttctgcaaaaatgccattgagattttgagaatctgcagatcatttggggagtatggacattttaacattattaggtcttccaacccataacacagtatgctttccatttacttgtgtcttctttaatttctttcaaccatatcgtgtagttttcagtatacaagttttttaccttcttgaataagtttattcttaagtattcttttggatactgttataaaagtagggtagttttcttcatt

SEQ ID NO: 5138 - DNA, 1166 bp, Homo sapiens
atctcaataattttctggtttgaaaaattgagtttctgccaggtgtggtggctcacgcctgttttcccagcactttgggaggctgagacgggcgggtcatgaggtcaggagattgagaccatcctggctaacacagtgaaacctcgtctctactaaaaatacaaaaaattagctgggtgtggtggcgggtgcctgtagtcccagctactcgggaggccgaggcaggagaatggcatgaacctgggaggtggagcttgcagtgagcggagattgcgccactgcactccaacctgggcgacagagtgagactctgtctcaaaaaaaaaaaaaaaaaagaaaaattaattgagtttccttattttgaattttagatcacaccagcttttctaaggtgtaaatgggtgatataggagcctaggaacactcaggtgtaacttataagagcatcctgactttggattatacattcgtattggcagtaattaaatagcagtacactgaagtgtctatcagcttcaaaaacttcttgcatcattgtttgtgtgttaatgtgaatgtgtctctctgtgtgtgtgtgtgtgtgtctgtgtctgtgtataggtgctgtaatttagtcatgtgggtaaagttaaaacttgtgtgcttggctactctgtttaccagttctagggccaaaagagtcgtgagaagcctggctccttggagggatatatttgtctgctcagctttactttaggtaattggattctacctagaattcccatcagactgttgattggttttctgttcttttgtaggagttgagaagattgccatcaactttttaattaggccagagaaattgagcccctttcatcttcatatatcttaagtttattgatattgataaatgcattgtaggaaaggatacatgagaatacgatatggctcctgttgtttgggtaattaatcagggagtggttttaattgacaggatgaaatatgaatatgttaaagtgtctaaatcactcattttagggctaaagaagaggataacttgtttgctaataaaatcgatagaatgctttatgttttcattatgctattggcaatacaatcagtctcttagcataccatttttgtagctagactagaataaatggtgatcaatatcttaaaaatttgtg

SEQ ID NO: 5139 - DNA, 1149 bp, Homo sapiens
tctgagttcccacatctgtgaaatagtgattattataacacgtatcccatagggttattgtgagagttaaatgggatcattcatataaaacatttctgtttaaagtattattactgctaagaaggggttagcaaccactgaagtcacgcatgtgctagaggaagctgctacagtctctacctgagccattggtcaattgttgtcgatggttgacaccttcccattttcacagtgaagtgagtattctaaatgccacatcttgtcactgaggttcatgattaagtagatcagctagcattgcttattcccttctagcctgtgactgtgaccccaggggcattgagacgccacagtgtgaccagtccacgggccagtgtgtctgcgttgagggtgttgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagtaagtagttaatgagccagaggaattactcataaagctgaaaaaatattgtgagttaacagcaaagatttcctggcatggtgcttccatcaggaggttttgttagtcctgtgggtgagaacagattctgagccatttattttccagcagtcttgactgggcatttgggtgagtgaacgttggcacatcagtggggaccagccttctggaggctgcagtacagaatatgcaagcattatattcagtgctcctccttgcaaatcatgttctaagtcagtaaaatgggaggaatgctggatttagaagacaaagatccataattgagtcttggctctgatgctaggcttgtgaacttggatgactcaattcctgagcctgtattttctctcctgtggagaaggggtaggataatatatgccattaccttatgaagtaatgaaaggatttatatataaaataacaac

SEQ ID NO: 5140 - DNA, 1180 bp, Homo sapiens
tcctgatggagtgtgaagaaagaatctggagaagaacggggactaaatttctgacttggttgactcagcaggtggtagtgccttcaccctgatagagaccatccgagggattgagggcttctgtcttagatccgttggtttgggatgctctgggacagccaagctggagatgttcttcagggagctggatatttgagcctaaatctcaggaaataagcaaaagatgtaacatgccaaagcaagaaggtttgggatgtggaaaaccttcatgtgatgcggacggcgtgttagtcaagagagggcaagggaggtaaaaccgagaagaccaggttctcagccacgcttctggagtttgggattaatccataggcactacttttttccacatatgtattttctgaagaaaacaagaacatgctatgtatttggtcctgtgtactgagtaatggcagctgtagagctgcttctggcgggttgactcgcgtgaccatgaactcagctgatgtggctcctcctcccttccagttgctttgcggagtcaggccagtgctcatgccggcctcacatgattggacgtcagtgcaacgaagtggaacctggttactactttgccaccctggatcactacctctatgaagcggaggaagccaacttggggcctgtgagtaggggagtgtgtggcaggtcggtaaagcagtgttttggggtgtagtggaacatacatgctttgtaaagaccccatttcagaagcatttttatagctttgtcagtgagcacaaaataaggatcaggaccatgccttcctgagaagagtcatatttaaagctaagtaattctataactcacaaattggctttggagcattcactgataaggcttttggttggtttaagaaatgtgtctttacaagaaacttttcttctctctacttatgctccaaagttatcaacctagcatggtaaatactgaggcaaggatattttttcatctattcatccccaaatttagtgactttaaatgtatgcctggctcttgagctggggtggctgaaacagctggaggctggctgggcatttctctccacacgaacacgacctttcttttttctttttttcgagactgagtttcgctcttattgcccaggctggagtgcagtggcactatctcagctcaccacaac

SEQ ID NO: 5141 - DNA, 1243 bp, Homo sapiens
gaacagatgggggccatgtggctttaattaaccatctctgtttgtctccggatggcaccagaaacagcaggacctggcgcttccctggaatggagaagccttgaaaccactccagagccccagggactgtccatgggctcccctagctccggaaagcggcgtccaccgcgagccccggcgcctcgtccccagcgaagcgccggtgaccctcgcgcgtgcacgcacacgcactctcgcttcccaagctcacagatctccacgcgcacactcacaccgaggatgcgcgggctgccgcgtgcacgcgggttcacgtgcgtgggtgtgtggccctttgggggtcagcctccctgcgccgggctccggacacgtcgaagtggagggtctacacatccaccctttgttgggggagctgctccccggggctgatcagggtgggcgcgagcgtcggtgggtttcccgggagggaggctctcgctgctggacagacctgatgacgtgtgtgggtttctttccgtgtccttctcctttcggagtccctgccttcccagcctctcctgcgctcatctctccattgtcttttctgtgcattttgctttcttccgaatggactgtcctctctccgcacccactcccccgcccccgcttgttcgtttttttcgggctccactccctgcttgtgtccccccaactctgttgcctgtccttcccgcagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggtgagggctgagagcggggttcgaggctctgctagcgcctcctcccgtccagacctaaggggcaggccctggggactccgcatccttccagcaatccagataggaagcgcagccagccggggagtcccgggattaggcttgtagctcaacctttcgccccatctcagtttgcacagttgcatccgccacacatttcctgccggcgcggtgagtatggaaaggcaggactgccgacagccctggctgccctgacccagagcctccaaaaggcctgattgtgtgtgtgttttttaaaactttagttttggaagtgtgcattaaaggtgatttatcctctttttaaaacccttgggtt

SEQ ID NO: 5142 - DNA, 1191 bp, Homo sapiens
aagaaagatgtcaacatgctagaaaattaattttaaaactaagttattccaacactaaaagcatacaacagcatgccaacagtaatatattattctccaagactttacctatgtaagtgttcaaaactctgcagcattaaacaacgtgtatgcaaattgttatggatacatttcagaatctaagaaatcaggcaagtgcttaaaaggccaacggtccaagggattacatctgcagtttaaaaagtaaatatatattctatcgtattcataaacaatatctatcaaatgggttacctccaaatatgaaaatctataacaacctatggttgaaggaatgctcagtttcatttgccaataaattggtttctcataacttgcatcaagtttaattttaagtaaagctttttatatgtagatattttgttgaatttgtaaatacacttaaaatgtagatgctatatgcttataggtgttacatacaaataaacatgcaatgtttatgttgtactgtataagaggtaagctaattaatgcagtgaatgggattggaaagcatctacttaaatatctattgggttcccccctccccccaccttttttgctgtgaaactgaaatagtgaacttttctacgtattgacagcagatttttcgatgaaatcttcagagctttgcctatggggcacagtaggcctagtaacctggcatgtttgatatatgtaggtaaagcataatttaaagtaatcccaggtaaagatggccctaaatactttcatgtctctatattcatttttcacagatccacctgtctcttgaaaatataaaaagacaaaacaggtttgccttggcatcagagagcacaaagattaaaagttactttaaatttgccaatattttgggagaacaataaaactacattttttcctcttccatactggtagatgcgaaatttatctgtgcatgaaagggtcacttctgtaatagtgcaacagatttggtattaaaaattaaatgtggttttaaaagttcctctctcttttgtaatttatgttcccaattgagtgtgaatgtccaagtaatggtgtatgtaatggtacaggcaaatgtgactggatttccctcaaaaaagtaactattaaacagtcttgatctctttgtgacttttaactttttcaaacatatattgcctaatg

SEQ ID NO: 5143 - DNA, 1177 bp, Homo sapiens
gtgcagaatactcaatagaaaactattgtgtaaatacatctggtgtatgtttacatagatttgaaaacactacctgaaaaaagtcaatgtaggtagtaattccacaactatttgtagcagctttcttactctgccaggtgctaccccagccactttacactcactttgtcatttcatcttctccacagccttttcaggtaggtactgttatagctcccattttttctacggtaaaactgaagtagagagatgttagtgaagtcatccagtgtcacacagctcataagtagaggacttaggatttgaacgttgttccctctgacttctagatgccaagttatacttcatgatgtgatgtaaactgcctaaaagtaagtattcttttttaaacaccgtactcctatataatctattttttccggttattagtaaagtttttatcatatgtgggatgtcaaaaaataattgtttactttagtaaaaagaataatcactgtctttaaaattgtcatttctgcagtgttgatgaatattatttctaaaaagagatttcccaatgatacctattatttgactgtctggaaaaaaatattccttccaaacagaattcagaaaatcaataataaaacaaggttttatgtctttaggtagaatttaagattatatcaagaagataaagagtataaagtgactgtagcagtttctacacttagtaaaaccagagtatagttttcaaagtgactatcattgacaaaattttgagaatactttgataactcagaaaaaactcttttaattatagtttaaaaacatttagtttgctagaataaagtatcttggatgatcacagcaattttggaaagcctgaatttccaaaatactcaaaatataacatttcttaatttgggctaaatcatgtggttgaacaaaagtttccttaggctaatttaaaaaaaaaaaaaaaaaagccaccaaagagaatgaagagtggtgacgacaagggcaaacagatgaaggctgcactggaagcagcctgttcaaatgaagaacgccagagtggcaaaatagtcaccaagcaattatttaagagggacatgtttattagttgtttttaaaatgcagttccaataataatttcaagctgtctccaataaagcttaaactcaataaaaataca

SEQ ID NO: 5144 - DNA, 1255 bp, Homo sapiens
aaaatttggtgtatctggtaaggtcccattttgaggtattctgtcctgatttccccataaaacattgtagtagcccagacattgaatacccctgcatctaaactctgtttctcccaggccatataaaacattcctagcaaacagcttctttcttatgataggtcttgcaaaagagcaagctgtattattaagagctgactatgaaagtaggaaagcctggggttgagtgcaggctttcacacttcctaatcttgtgatttcctgccaagctacctaactactctaagcattgattttctcatctataaaatgggggtaacaccagccctcatggttattgaatattacataaaacaaagtatggaatgtgagggcgatctggctgtgacatctgtcaccccattaatcgccagggttgattcggctgatctggctggctaagtggctgtccccttcctccctcaccactccatgttcatgcctcccaaagctgtgttctcagtcaaagaggacaaccatctccactagaagaggaccagtctttggtcaagggtatacgagtagctgcgcttccctgctggaacctccagacaagctctcaagtccatttgtaggagaacatagggtagtcaagcttccaagattccagacacatccaaatgaagtgctgcatgtggcagtctgcctttcttaaaaaaaaaaaaaaaaaaaaaaaaaaaagaagagtatgtgtagcatctgctagtgcctgagacatgtgtacctgataaatggtagataaaatgcaaaattttatttgtatttttatcaccgaaggtatatttgaaatcttagttttctgcagctatcgtttgagttttccatttgtatttatgctaatctaaaaacctaattatcatttgtaaaatatagcttttgagaaaatttcattcaagtttctaaataatctaaatttttggaaagatagtttaagttggaatagccagcatacccacaggggtaatgataactattctctagccttcatctctgtccttattgcctagcaccaatactgaatatttaccatgtgccttctgtgtatgttgccttatatcgactcagcactactatttttcaagagattttggtgctgccttatcaggtctcagagataggaggacagttaattgaatgatatatattgccaactgctaaaataaactaattccctacatgctctcataggacatactctctgctcctcattatcatt

SEQ ID NO: 5145 - DNA, 1229 bp, Homo sapiens
tgtagtttatgacttggcagtccttttattaatacaaaatccctaagtgactgtatatttattcctgaagttaatgaagtttaaagaaagattctagtttttaaaaagaagattttatttttttagtaacagcattggtacttttttttttttgagacagaattttactcttgtccacaggcaggcagtgcaatggtgctatctcggctcactgcagtctgtgccacctgggttcaagtgattctgtgcctcagcctcccaattagctgggattacaagcgcctgccaccagggccagctaatttttgtatttttagtagagactgggtttcgccatgttggccaggctggtctccaactcctgacctcaggtgatctgccggcctcagcctcccaaagtgctgggattataagtgtgagccaccgcacccggccagcattggtacttttaaactcttgcacattgtagaaactttcccttaaaggtagtttatctgataggcttttatactatatcaaataccaaaacttctattttaagccttttttgtcttctctcacttcaagttgtctttaaaactaccctgccttaactccttaattccccttaacataagacatgtgtaacctaaaaacccattcaccagttcatgtttgctaagtccagccattctcattggaaaatatatttgtcttattcttatgattatctatgatacaacactatttctggatctgttttcattgtcttcatgatttgaaatcatggtctagaaataattatttcatcttcatatcagtttttttttttttttttttttttttttgagacaaggtcttggtctgtcgcccaggctggagtgcagtggcaccatcttggctcactgcaacgtctgcctccgaggctcaagcgattcttctgcctcagcctcccgagtagctgggactataggcacgcaccactacaccgggctaatttttgtattagtagagacggggtttcaccatgttggccaggcaggtctcaaattcctgacctcaagtgatctgtccgcctcagcctcccaaagtgctaggattacaggcgggagccaccgcgcccacctttgtatcagtttttgtgtcataaaaaaatgagtgcgtcggctgggctcagtggctcacacctgtaatctcagcactttgggaggccgaagtgggtggatcacgaggtcaggagttcgagacca

SEQ ID NO: 5146 - DNA, 1188 bp, Homo sapiens
ttttttttttgtttctctgaaaacttggcatttgtaagatatctatgattttgatttgtcttggccaaagcccagattaccaaggaattacattttgaacatattcaactaagaattatctttgtagcaacttttcctttgccatattgaaattttgggaataaaatcagattttgttttaaaaaccagctatgtttctttctagtgccagaatgattttttctgtgttaaagcagaataaagcaatgcttatagtctatctaaaacttattttaagcatactgtggagaaaagagccccatttttgcatttgcagacctgggttcaaatgtttgctctgccagttagaatttatattgatttttggtaagttttgcatgtgaaaaaaaaatactaataataatttctttatttggttatataaaatttaaatgatcaaatatttaaaatacctgacacatagctggcacttacttgatggtagtagtctctcttttgccctttattctttctatatgtagggataagtgtgcaaataaataaatgtgtgtgtatgcttatgtgtatatatgtgtttgtactcccacacatacttatgtatgtacttatgtgtctgttgtcttctctctctctctaacctgtattgtgtaatattttatgtagccacttattctattaaattcagagggaaagaattcttataggaatgatatagttgttgaattcaggaaatagggattttattcaccacgtaaagttattttaaaagttattatgtttttgtgtcctagtatttctgtaactttatgttaacctgaatttttaaaactggaatatttataaatccttaaaaggggatctgatagatatttatgtttcttctacaaattcccagcaggcattggagaaatagcttttttcttcttcttcaacatgtaattcacagaataatatactgctccatcttgattagtgttcagaaaaatgtgcattagtcaacttgagatgtatgggaatataagaaacaaggtaatttatttattaaatgtccaaaaagagaagtgtcagttttgacaagatggaaaaatgcaagatgggagttgaatctttcttaaaaattgatgtttgtttcattcaggttttactaaatagcaaggcaccagtttcctgagaaggtttgtacagctg

SEQ ID NO: 5147 - DNA, 1112 bp, Homo sapiens
ctgggcttcctaaggctcactccatcctgagaagtttcactttaatgttatacatacagtgcttctaaaataaacaattaaacaattgcttccacaattgacacaaaattaaaattgatgcttttgggagatcaggcaaactgtagtaatatgatgaataaaatacagcagtggctgggcatggtggctcacgcctgtaatcccaacactttgggtggctgaggcaggcagatcacttgatgccaggagtttgagaccagcctgatcaacatggcaaaacaccatctctactaaaagtacaaaaattaaccgtgaatggtggtgcacacctgtaatcctagctacttggaagactgaggctcaggaatagcttgaacctggaaggcagagttgcagtgagtccacattgcgccactgcacttcagcctgggcaacagagagggactgtctcaaaacaacaaaaacaaaaaaactacagaagaatattgccaattattatcactgggtattgagattacgtgtgtttttcttccctctcttgcccactgtctcactctcttttctatctgtattataccctggaaatacctcatttatatgatgggaaaattatttttaagtgaggttgatacatttttataatgaaataattgaggaacctgaccaaatgcttatctgggtaaaaggctcctcctctgtagagaggtagtcccagagagaagcatctaccagcagggttaagattttctttaggagacagtgttaggtttatctcaatgcaggttaaaatgagtgatcaagaatgtgactttcttggacattaagcattattgtggtatttttaactaggaaaaaataatttaaatagcattactaaacatccaatgcagtcgtaaaaatattctgaatgaggtacaggttgtttaacgttagcaatatagcttctgtaaactgcaaatcaatagcagattttaaccctaggttacgacatgaattacttggaatttaaaacaaacaaacaaacaaaaaaccttcggaaatgattttgttttaatttcttacatgaaagatgaaacagccaaggctctgagttgttaatgagctttctacag

SEQ ID NO: 5148 - DNA, 1258 bp, Homo sapiens
tgcttttaaactaaagaacgaagaattggaaaattttttttctagggcagagagaggccacttttcatacccagtgtaatataaattccagtgtgcatccggattgaactctacttacacagtatctataaattataactgtaggtggatctttggcaagacagttaattacagtgtgcaaataaaagttttgtgaaattgctcatttaaaatatagcttttaggagcttgctatttaaaggacttctgtggtagatactttttgaagataaaacattttaaagcaattaattgccccaaaagatttgttttataaatctttagtattctatgttagggtttctttaaagcaagtatacctgtatctgtgtcttgtgtgtgcattttgattttcttttcctcataagattagcatgccagaatttttgttccagggctctgaaataaaatgcacccacctttttagaaggttcgctttatgtgtggtactacattgaagcaggaaggaacacattttagccatatgcagagaaatcaaatttgtaaaatcctaccacagagctttactatgagtatgcttttagttataaatttgtacctcctcccacaaagaacaccatcattgaagaattctttcattttctatagtttgtatattgccattaaaacatttgttgttcttaagtaatactttatatatgtataattgatagtttaagatgtacagccttaacattctaaatagacatcaagagaatcctaagaaactaagaactttagtgtgaacaaaggaggtgactttaaggaaattcacatgacactttcaaatttagttgtgtgtgctgtagagaaaaaaatatggtttaagttcttaccacattaataaatacattaattaaattacctgtctgatgtggtgagaagcccttttgaatgttgtctttcatagtgatttttataaacatttacacattcattgcaaagatagctatatttaatctattaaactttgaagagaacaactcatgttttcagttcatggcagagtgatttttttgtattagaaaagagcatttattttgctttcagcacaatcacttttgtactaatggcatcattatagcactgaaggggatatctttcaaaactgatatttgatgattcaagaacagatttattattaaaataatttaaggggcccaaaacacttctattaaggcctttgcatgaaacactcttccttccacgtggttttcag

SEQ ID NO: 5149 - DNA, 1197 bp, Homo sapiens
tcttgcaaattcttaggacagctcactcattcatggccacctctaaccaactacctgctttttcctccaggtagaatatcttacatttccttaagtcttctgtgcatgacatgatttctacacccattatcacccatattgctgccttggatgttccttagtttatgggcctacactacttgttattttcttctactccctagccaatctctgagtaaaagtagttgccaaaactctgagtagagtgtgacttagtaaaatttaaaataagaatatatttacattaaacaattattgctcttttatgttttctgtttttctgttaaacatttttagagcatatttgtaaaaatatgtcattagtccagtattcttcattaaactaactgtaatagcacttggtgggagttttgaatcagtagagattcccagcctccagtctatatattcacctggccgcaccaccagaaatccaaaatcttgagtattagcaggaggtatctgtatttttcacaaagcccccagcatattctgaggatggagattgatggcattctcccgtctccttccagggacactgcttggaaagctgaaccttcgagcagccacttgcagctgcatggtgtgccatcacagctgttcaggtggaagcttttcaggaatcagtggtttccctggctctaccttggaatcatcgaaaaacttaaaagttactgaggcctgtccccacaaccggaactttcttggtctggggtccgcatgggcaactcagttgtcaagcactcccctggtgatgcggatgtacaaccagtgtattgaatagaatgaataattgcctgagcctgctttaaccagcaaggggattggcaatgcagagggaaggatagtgactagaatacacctgggtgttctctaggactggccgtacagctgtgcttccagagtatcggagaggggtgttcattaaggatgtgggacaggactcaactcgcctcatttcatgttttcaaagctttggttttgagtatagcatcaaatgattgaataaaatagaaatctgcctttagggtcctcatattttctgctctaccaaggtgtggtagtttggtcagctccccatagttttcaaatgtactttagataagtttgcatttcaacctctatctggagaatcacatttatcttgcccttcattaa

SEQ ID NO: 5150 - DNA, 1161 bp, Homo sapiens
agacaggcccattttttttttttttaatgccaatgttggcataatacttagaaatgtcataaaatttactagtttatatgccccatttcaaactcaatctaaggaggaatgtttgctctagagctaatgatatttgctttttgttttgattttttaggagcatattaatgaaaagtgccataaactgaaaaaccaaacatgagggtagcaggtaagatatttaatttagtagaagtaattgtactttttgtgtaacctgtttgttaaagaataactaaaggagaggttaaataatctttatattgagaaggttaaactgaaataaactaaatcattcagccctttgtttttaggtagttggcaaatcacaaattggacatttagtcagtatcacataaatttttttttttgttcaagtcttttgttgaaattacacattgagcttcttaaatctgaagatctgaaatgctccaaaatctaaaactttatgagcagcaacacatgatgctcaaaggaaatgctcatttgagtatttaggtttcagattttcagatttgggaagttcagctggtaagtatgatgcaaatattctaaaatctgaaaaaaaaaaaaaaaaaacctaaagactgtatataatgcccatataaagaatggtttgacaacctagggaggctgatttttgtttttgctatgttctagcgtcttgagaaaaatgagttataaagttttaaagtttaaatgtctcatatgtatgtacttaaattaagatgtgtgtgaaggattcgataaaatatgtgtttttgctcagtatttgttcaagtttaatctgcataggtgagtttatgtgtaagaactttaatctgtttattaagcagcatattgagaaaattgaaaaacaccattagatgttcataatattaaggtagttatatttaaatattctaaaaagacacgtttataaataactggaggggctgatgacctcttcctgtgtagtaaaaataagtctgtttttccccacccttcccatcaaccaaagccctagaagaaatgcatactttacatggaaatttctactaagcgtgtgcccaacataggtaacttgtaatttctcaaaatcaagataattagtctttttcttaattgtcatctcagcagcaa

SEQ ID NO: 5151 - DNA, 1161 bp, Homo sapiens
ctgtgggccatggtaaaataaagtttgaaagccactgacatagatgaaaagacatacttctgatgctcaaaaaacttgtgaaatattattaagataaaaaacctcaccagctaaacttttaaacactatagcctatttcaatcaaatagaagataacaaaagatatcctttcttactcctgattatgtagatgtgagaattaaggtaatttaattacttaatattcaacatttgatggtggaatagattatgagatattaaatgaaagtagtaactaatagttaaatttcagttgttctgataaatatctgttgaagagtaaaatccaatgatcttttaaaaaatttgtattaacaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaatgcagagaccataatcaaaaagtaaactttctttagtagtatgttcaatacatcatttaattttttaagttatcctgaagaaggaaaggtccttaattattatagtctaaacaaatttatagattactgtttgaagtaaataatacgagtgaatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaattttattatattttgttgttactgtattatatttgaaaaccttcaaattagaatacattgtacagttaaagaaa

SEQ ID NO: 5152 - DNA, 1171 bp, Homo sapiens
ataactgctattgcatgtcaaagaaaggaatttttaattttatttctagaacctagcacttgtgttcttccattgcaggcactcagtaaattttgttagatgaatgtgtgaagagtggctgacagcaaggggccaaccacaaaaaagattgttacatgagatcaaatgagttcggtggaggaataatgagatcagagataaaagagacctttgattctttcagccccattgtagtatcatttttacagatgagaaaacaggtctgagtacattcagtcatttgaacctggtgaacaggaagatgatataaagatattgtattggagaaaaattattcttgggtggaaagatgaaaggagtcaaggaagtgagaacaggaaccatgggctccaaggtctataatggtagacctgacacagcagaggccgtgatggagggacatgcccaaaaatcatgcagagaaagagccaggagttagtgattaagaggagagctgagaacaccaaatgcgcgtatgtgacaaaggagttagtgccagttatggcctcttagctggtagcttcggagattatctgggtgaactcctgtttgctatttgtatgaaaaaccctgaatttaatgttctgacttcagggattggagactcacttaaactatgcagacagacatgcagttcttatttcaatttagatgttaaaaaaccactcctgcttgctttgacatgagaattctttaaaaaagtaaatcctctctcaaaatagttttgttttggcactggggataaaaagcatatacatatacatataatgtctcagggtgtgtagtgttggggttatcataacctagatgttttgatattaaacgatgttcttttaaacagcttgtacttgtctttgtcagggaataccactaggaagaaggcagttctgggctcattaataaacactatgttcttattgtgtattctcaactagagtaggagatctacagatgtgtatcttgctctcactgtctgaggagatggatgcattgaaggtaagaggggcctcactgaattgtgcagcacttgctgtctcttggttgttcacaactgtggaagccaacctcaggtgactgagttcatataactccaactgccagaactttagggattcctttatttctcagatcc

SEQ ID NO: 5153 - DNA, 1109 bp, Homo sapiens
actttctcttttgccactggcttttgttttgttactaggtcttcaaatatggattaaggtttccttaatgtctttttttctttttatatactcttagtgattcctctattcccgaggtatcacttatcacttccataaagatgactccaggtccgttttctagtctggctgttctccttattataagaccatttgttttcaaagttgaatgtcagacatctccacatgaatgtgtcaccagtatcttaaatgcaacaaaaaactcagtaatccaaacttatcttccttttaaaatttcttcctatgtgctccatgtctcagttgttctaacccctacccttccggttacctatgctagttggaatcctggcaaatgccttaacttctttcttttatactctccctaatctgtgatcaatgcctatccatcctgcctctgaatgtttttcacgtttgcttccccttcccatctccacttttagtagttttgttatcacttaccttcactattgcagtagtctcttaactgacctcttttctaatctgtcttccgtgctgttgttagaaatatcttcctaaaacacagatctgttgttactgtatgttcatcgcttgactaatttacttatctttcaggtctctgccaaatgtcacttctaaataaagtatgtctgtcttctttgttgtttgtttcatgttcctttcctactgtcatctaatactgtttgtaattgtgtttatatttgtgcattgatttgtttaatgtctttcttcccactggagagatttatgtaagggactggggagagttatgtagaccctgggcctagcacaatgctcgggacatagtaacacttaaaacatatctgttgaatgagtggatggataatagcaaagtacaggcagtgcaggcaaacagataccaagtagcaaaggcagggaaattacagggtcctagactcttagtacattctcacagaccttaatctgtagtttaaaatagtaatgggcttctctcttttgctttttgcatttatttccctaaggatgagagtgaacaacttactaccccacactgacacttcagtgagggcactgtggaacctttc

SEQ ID NO: 5154 - DNA, 1177 bp, Homo sapiens
gtcaggctggtctcaaaactcctggacctcaggtgatccgcccacctcggcctcccaaagtgctggggttacaggcatgagccaccgtgcctggccaaaaaatactacttgttaaagaaggttttggaacaaatgtagatttttaaaaaatgcaacataaaatgagtagactccctatacttttcgcaagtctatatatattttaaaagttcaccttctatacctgtgtcccctgtattaaggcatttaatgtatttaatgagtattaaattagtttcagattcaggttctaaagcaaaatattagtttgagtgctgtgagggttaaatgttgtggtttgattatcacacgtttttttatttgtgtggaaaacttgagatgaaaccatcttttagaagtaatttactgttgcatagttttaaaaactaggttttattagtaaactcaaaagtgttcatttattcccatttctcctcagataacttcaagtgatgtacgaaaaggtttggagttcatttttgtggaaagactttaaattggtgttagaaccactaaacatcttcaaatggtactatgaggaaaaaaagaaaaacatttttctaaatattcaactataactgctgttttctgactaaaataaccatctaaccacttgtttctaaggcactgcctattccagcactttcaagtagctgtgatattacatgttgtcatcacagtccatcagctatccacccttgaccttgtgcatttggtcgacagtttctacaaaaatgttacaaattttgttttctaaacaatttgttgattaagtgatcaacaacctgaagaaaatatcaatttttaattgacaaagactttatatcttagtgattttagttttgtttctctttatttggcaacattttcatctgaattgtatagatatatgattttctagtgagtgtatgttaggaacaaaagacaaaatagtatcaacacattataaatatttagcttactaaatatttgtaattatttttacatccatttatttctagcttgttctccagcacttcagtgtttgaaagtttcatcctaaaatatatactacaggaaagctgcagttcattttcatgcatggatcattacatttttcacttgtaaatgtaggtttttatgaaaattaaacattccc

SEQ ID NO: 5155 - DNA, 1203 bp, Homo sapiens
acgtgtggcggcggcggagatcgcgtctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatggcgtcctccgcgcagagcggcggctcctccgggggacccgcggtccccaccgtgcagcggggcatcatcaagatggtgagaacgggccccggacaccgacccctctgcctgccttcgggcgggagtcaggcattgactccaccttccgccagcctgctccatgtcccagatcccctttcctctgcccccttcctcacttttcgtcgattctccgaatcctctcactagacggaagcagacacggagtccccttgttccttgcctcccggacaccttgacatcaggggtcacagtgatttccgaggttgcggcattcggatctcctgtctgtttaccaggacagatcgattactgattgattaacagagacaattcgttgatatctgtcctcccatcccccgtctttctgttcattttgacatatgctgagtagttagtagtttttcgagatcctgacatcggctcttctctactagtacttggccatcatgaaacttttctgttcccacaaacgctgttacttgactcccaagttttctcactctgtggccctcttttcctctctttccctccacctcttgtgtcgacctgaaagctcctgatctttgtgtacttttgacttctaaaaggttaggccggcaagaatcttagtaatcatcattgttctcccgtcccttaaagataaggagataggcttgaagaaggcaagtgacttgcttaaggtcacatggtggtttgggttggagccatagcaagagcccaagtgttcggattcctggtctagtgctcatagcactatagattctgcctgattttatataccctcaactttttgaaaattcttcaattttgaatttgaacctgcaaagtttatttttacaatttactcctagctccatgataatttgataatataaattcagtttatcacttgcccccagttgtcctccccaaaacccttccaaatcttggaacctgacatttcttggtttta

SEQ ID NO: 5156 - DNA, 1130 bp, Homo sapiens
aggctggtcttgaactcctgggctcaagtgatcctcctaccttgacctcccaaagtgttgggattacaggcgtgagccactctgcccagcaaacaagcccctctgaaccacacttgagttaatgagtgactctgggaagctcctaagtgtgagtggggcctggttactagagatcgagttcaatcactgatggccagtcatttaataaatcatgccaatgtaaggtaacctccttaaatgatggggtttggagagctttggggttggggaaaatggggaggtgctgagagggtggtgtgcccagagagggcatggaggctgtgcactccaccccccatatattaccttatgtatctcttccatctggctgttcctgagttgtatacttttatataaatctagttactagtaagtaggctgttttccagagttctgtgagctattctagcaaattaataaacccgagaagaggctcatgagaacacacacctgatttatagctggtcagtcattaagggtggcttgagcttggcatcttcagtgggaggagtattgtgggatggcacttttgacttgtgggatctgacactaattccaggaagacagtgtctgaattgaattgaattgtagaacacccagttggtgtctgcagagaattagaggattgcttggtgtggaaaaaaacccacacacatttggtgtcagaaatgtttgtgtgactgtagaagaaaaacaaaaacaatttttttgtcctttttagggtggtaggtggtagtaggaatgacaatatctggcacggagaacacttgttttttagagttgtttggggagatatcactggaccaggggatctggtttgcagcctttctggatactgggaagtgctcatcctaatcctggtattggtttacccaaagtttcccaggcttcacatgtttctgtactcctgcagtggttttgacataccactttattgagttttggaaatcgttttgacagtcaacatttttttttttttttgagacggagtctcactctgtcgcccaggctgcagtgcagtggcacaatcttggcttactgcaagctccgtctcccgggttctcgccattctcctgcctcagcctcctgca

SEQ ID NO: 5157 - DNA, 1237 bp, Homo sapiens
aattttctgtgtctgggtgtacaactactgtttcttctggagttttccttgtcatctccccagaggtccaggaagaggagcatctacaatggggattcccagaaaccagcttcttatgggaaatctgagctgtgaggggctgaggatggctgtggaaagtggctgggtctggcaggtgtcttgccagtgagtgtgtctcctccatgcaccccagctctgcagaagggcagcctgagccaaatgcacccttgttctaaggatggggacaagggcaaccacgcctgtcccagctgactgactccttcccaccaaggtgccacctggccagcctgcatggaccagcttgcccatgtggctgcaagtcccaaggaacagctggtcacctccatccccacagggaaagagggaaccgtcatggctgcactgcctgaagggccaaaggtcagcctctcctagaaacacagttcctttatctgaggagacagctgtctctctcctaccctctgtatgcttcttggcaacctcaagtgccagccactttgtgtatggagacaccttgcttctgctgtcttctcaattcaggtggcagtgtgcaccaccccacccaccacgaagtgagctgtggcaccttgttacaggactggccctagtgctgggggctgagggccatccccaaggctttggtttgcatcttccgtgacctcacgcctgctgcccacctgagcctgctgggaaagaagctccaccccactctccccaaggaggacacctgatgctgtcacccaaggcacttttacttgaggagtctttagcagtttctgctttcatcctgtgtgttccgaattcatcaacactgctgaggggccgccttcccccaagccaaaggagcagggtggggctaggatgggagccctcaacagcttgcaggctcaggggccatggcccactcaggaaccagcacagaatgccggtctctgttaacaagctcagtgccgggaaaggagggagctggcaggaagagggaagagcacctgcatgggatgcagagcagaggacgtgctgagggattcaggactgcaggggtgcctgctggtaggaatgagggagcagactcctgggtcaggagggctccatcccagttcacttaaggtagtgctgacagtctcgtctctgaggccgagtgagtcccactgatcctcagagctgcaagcgtcccagaagggctgggagcccaggt

SEQ ID NO: 5158 - DNA, 1179 bp, Homo sapiens
tagtgctgggtagctgagagcccagaccggtttctcagggctccgggccttgatcagggtccgcggaagagtattggggattggggaacggcagaaccgtgttagaggtgccctggggagaagggcaaggtgggtggccccggctgggggagaactcgggggtggggggggtggggggtgtgggggtgtgggggggtggggcctctgctggggggtcctgggtggctggatgtagagcggcggagggggcgtgtcccggcctgacccggtactctcccccgcagccccacacctcctacccggtccgggcttgcggggtcgcagcgccgctgcaggcagctgggggcgtgcgcgcggcgcggctgagccctttgtgcggcgcgggcggaggcggcggtttccgcgggaggggcgagaagggcgggaggggcgggaggacagggcggcgccctggcccgccctgccgctgccgcagcccccgcccccgcccccggcccgcccggcccgcggcagcagcgtggccgcggcgcggcgtcagcagtagcagcagcagcagcggcggcagcggcgggcggccgcgcgggtgtttatgtcgggtcgcggggtctcgcggcagcatggcggactacctgatcagcggcggcaccggctacgtgcccgaggatgggctcaccgcgcagcagctcttcgccagcgccgacggcctcacctacaagtaagcgccgggtctcgtacccctaggtgcgcgcatccacgcgccgcgacccccgggccggccctgcacgtgcgcggctcccccggcgttccctgcccggtgcgagtgcctgctgtgggcgctgggggctgggcacgggaaggaaggaggcccgcgccggagcagacggacgtggcacggcgacaccgcggccctcagagccctgacccgtttctggccagatccgggttcggcctgtccccttcctcctctcagcggcatggaggggccctcgggcgtgtgggaactggagatgtgggcattatggggagacttttcccagccgctggtccaggacgccccctcccagcctcaccacgagggcagagggtccccggagccaagcttaagcagccgcttccgcatggccccaggagaggcccagccaggtggttggggtggcttcttttccaactgtctagtcc

SEQ ID NO: 5159 - DNA, 1226 bp, Homo sapiens
aggctgatctcgaactcccgacctcaggtgatctgcccgcctcagcctcccaaagtgctgggattacaggcgtgagccaccacgcccggccaagaccctgactttttaaaaaatgttaaacataggccgggtgcagtggctcacgcctgtaatcccagcactttgggaggccgaggtgggcggatcatttgaggtcaggagttcgagaccagcctggccaacttaatgaaaccccatctctgctaacaatacagaccaggcatggtggctcacacctgtaatcccagcactttgagagaccgaggcaggtggatcacctgaggtcgggagttcgagaccagcctgaccaacatggagaaaccccgtctctactaaaaatacaaaatagccaggtgtgatggcgcatgcctgtaaccccatctacttggaaggctgaggcaggagaatcacttgaatctgggaggcagaggttgcagtgagccgagatggcgccattgcactccagcctgggcaacaagagtgaaactccgtctcaaaaaaaaaaaaaaaaaaaaattagctgggcatggtggtgggcgcctgtaatcccagctatctgggaggctgagtctagagaatcatttgaacctgggaggcggaggttgcagtgagccgagatcgcaccattgcactccagcctgggcaacagtgagactccgtctcaaaataaaaaaacaaaaaaaatgtaaaaaataaataattgtattgaatttattagttgtgtctcagtctccttcagtctacagtttaggcttgcttttgcacctttgcattttaaggtaagaggctattgtgtaaactcgaattgggtttgttggtgtttcttcatgatttggttcaggctctgcattttgggcaggaatattcagaggtgatgctgtgttcctcccataggatcgtatcaggcgacacatgattatgaatttccccattattggtgatgtcacttagttgtgttgtctgccaggttctgccactgtaaagttaataagtattttgtagggaagtgctttgagactaaatatcctgttcctcatcaaacttctaccccctagtttcagtatctattgctgttttttgtctgaataactatgatagttgccaaatagtggtttctgatccttccattccttctacactgattggttggtattttgtacagaaaagctttctcatatctgatttac

SEQ ID NO: 5160 - DNA, 1168 bp, Homo sapiens
agagaactgcctgagtgtaggagatcaccaccaacctggtcaacatagcgacactttgtctgtactaaaaattaaaaaaaaaaaaaatgagctacacgttgcagtgcacacctgtagtcccagctactggggaggctaagactggaggatcacttgagtctagaaggttgaggctgcagtaagctatgatcacaccattgcactttagctttgctaagagcaagactgcatttcttaaacaaaataaaaattagatgggaatattgcttaagccctggaggttgaggctgcagttaactgtgattgcaccactgcagtccagcctaggcgatagagcaagaccctttctctaaaaataaaataaaataaaataaaaattaaccttctatcatatttccagtaacaccttctctcctacgtttctcctagaagcgcttaaattttgtttttcacataccatttaaaacttttaagtgctgatgtctgtctgtgtcatccctcttttttttttttttttttttcttagaatgtctttttgttacttctagctggacctaccatgaaagacttctgaatccaggaagagagactgactgggaaacatgttattcaggtacaaaaagacttggactgtaactcaaaaatggtcaaataatagtgcatgcatcaagtgcaatgggaagctcttctggagagtgagagaagcttccagttaaggtgacattgaagccaagtcctgtaagatgaggaagagttgtatgagagtggggagggaagggggaggtggagggatggggattgggctgggatgggatggagtgagctgcccagtcaggtaaaccagcactatacagacctgaacaatgaagatggcacattttgttcagggaatggtgaattaagtgtggcaggaatgctttggagagacggtcatttgcttgtatggaattttgcccaagagacctcattacagttcctaattttttgatgttatcatgcatcactgcccttgtcagatagtatcatgatcacagtaacatcaagcataatatttcattgattctcacaaaaacaggtgggtgccacagttatccccattatatgcacaaaatgatgaagacttggggttaatgagcgatttgcccaagctcacctgaatattaagact

SEQ ID NO: 5161 - DNA, 1231 bp, Homo sapiens
cagctcctgcccagctcccagaggccctggtaggcccacaacttccctaagccaagctccccaggcccagctcaggcctcacggtggcctctccaggctcagctcctgccctccgatggcatctgcaggccccaaacggcctccggttggtgggcttctctaggcccagcttgggcctcccggtggcctctgcaggcccaaatcgtcccgaagtcggcctctccaggcccagctccggcctcccagcggcctctgcaggcccaagtcgtcctcaagtcggcctggaagtgggcctggaagagcagcaagtcggcctccccgggcccagctccgtcctctcggcggcctctccaggtgcaaaacttcctcgagtcagcctctccaggcccagctcttcctgcctcccagtggcctctttcggcccagcccagttcatggctctcggcggccttcccaggccccgcttttgacttttggcagcctcttcaggcgcagaacttgatctccagtcggcctttgcaggcccggcctcctgcctctcaaaggcctgcacgggcctggccttggccttggcctcacagtggactctccacgcccagctagctctcgcctcactgcggcctcccccgtccaaagctcctgcctttcggccacttcggcaggtccagctactgcctgccagtggcctctttaggccaagctcattcctcacaacggcctttccaggccccgtttttcccttccggcagcctcttggcctctaatttgtttatcttttgtgtataaatcccaaaatatggaattttggaatatttccaccattatatattttggtaggtaatttatttggagtgagtttctgcaccatgcccgaactttttgttttattttccttattatttggtgttaaacaggtttaatgacggtcatggcaactttttggcacaatgaaaaatatcgcccatgatcaacgtgttctgttctggggaagggggcaaaggcagggtgaatcactttcttaaaaagtatagctcaagttgggagtgcagagggaatggggagaaaacccttccgctgcctgtgtcgaagtgcaggagcccccacccccatactcacctgagtccagcccctctggggaaagaaggggtgcatgaactccccttagtccacaggcgcctccctgtggcccaaggccctcttcacactccatcttgtagccccagcaggagct

SEQ ID NO: 5162 - DNA, 1394 bp, Homo sapiens
tctagaccctaactcccccaacccactcacccaattttaatatacacagaattttccaggaagttaaccatcatgtaaatcaagggaagatggtactttggggtttgtgtgtgtgttttgtttgtttgttcttggtgcttaaccaaaagttgttcacagtttggaaaatcattacaaagttgctcctaggacagtaaaacctatttaataagtggggttcagatcccctacacaaccttggttttagttgggattcactctgagtggggcttggagggaagggtaaagccagcaggaaaagacaggcggctcctgcagggcagctctcctgggtccagaattctccctacaggtctccccagatcaagccaaggaaatgggcgccaagtaaccagagactgctggagtcattgccagtggtcccgtgaatcacagccagcctcaagacctcaatttcttcacccggccatgtaagcagagcggacaactctgagggcgtggctgggcggggttcttggggcagcccggcgccactgccggcatctacgcaccctgaacgcgcccgatctggtctcatctcggaagctaagcagggtcgggcctggttagtacttggatgggagatcgcctggaaataccgggtgctgtaggtttttggcttcccgctccctctctctttcccccttttgtcgccgcgcttttcaaccgccccctaactctgctcccccttttactccgtcgcagcccgggacctcctggtgggggtccgccactgcagcaccaggcgccactgccataccaccctgaacgcgcccgatctcgtctgatctcggaagctaagatgtggccgcatttaggaccccaccggcttggctgtgcctctcccagccccctggcggagcggactaaccctagcatttcattgattcacaataacgccaccccaccccgactgactattttgagccccatttgccaatctgtagtggatctttactgttttggagtagtaaattcaatacacctttatgggtctatttttgtaactactgcattctgggtacaagcttctgattctatttcatggcttcgaatgaagtcgtgcacaagcatttacatattgacttatgcattgttttatattttccttgtatattacagttggggcaggatatcaatttttaaaatttgtatgtataggtaggttacaatcattattaattttatttcaggctggtgaaacggtgtgacaaaatatttgtcgtaaaaagaggacttgggtctgacagggttgagaaccacaacactggaggagtgttgacctccccagtgcttctctgttgactttggtggcacttagacagctcctgcaccatctctgccttctcttgccc

SEQ ID NO: 5163 - DNA, 1165 bp, Homo sapiens
tttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgt

SEQ ID NO: 5164 - DNA, 1160 bp, Homo sapiens
agaagcaagtataaaagtttcagctttagacaactatccttgtcctgattcatataggctgttttaccaagtaattcatccctcggtataattgtaactccctgagctttgcattctttcttacattgccatattcttaatacctggattgccatatatgctcttaagtcagtggtttacaaactgctctgtgaatccctgggagttaacgttgactgccctgagggaagaaatggaagatgaaatagatgggtctcagggcctgttgacaatatgtaagtgagatcagctctatttttatgtgttttatttattgtggttctgaacacatttcactttttaaaagggttcttttgctttaaaaaaagaaaagcaagtatacctctgttttaataaactagaagttttcctttagtttcagatatgtaatctctgcttggcttttcttcttagaccctgtgttgggctatttgatgaaaggcctgtgtgaaaagcccctggcttctgctgcagccaaagccattcataacatttgctctgtctgccgagatcacatggctcagcactttaatggactcctggagattgcccgctccctcgattccttcctgttgtctccagaagctgctgtgggcttgctaaaaggtactcacttgatgttaaccactaatagtcacctcaaagccactacctggggtaatcttacatctgtcatatcccagtttttcagttgcaatgtacttagtgtttaagaatttataagatgaggaagatggcttttccactagaggggatagtgttgactatatgtacatgcattcttttcttggattatcttaagcctatataattaattaatactacttgcggtatatatagcaccgacctagatttgggtagagacaacatattcaaactaaacacggctgctttttaagttggaagaataaaaagggagaccaaagaagcattgccataccaaagaggtaaatgggagttgaaaggtagtatacatggatcagtgccatgagtagaagtcaggggtcctggtctcttagcagcctttaaccattactgatcagcttatactgagtgattgtctatccagaggcaaacagccattgtgatgaggctcggacttaatagaagaactagagata

SEQ ID NO: 5165 - DNA, 1100 bp, Homo sapiens
ctgatttcaaggcagactcagttaagaaggatgatccctgtctactgttatttttgctggaaggagcaagttagggattagtcctgtgttctgattccttgcccatgtctccggcaggctcgagggaaagtgagtgagatcatcaacaatgccattgtgcactaccgagatgacttggatctgcagaacctcattgattttggccagaaaaaggtatgggtcagccagtggtctgggggactgtgggtaaaagtgaatgtcatcccaagagatgcctcaccctctatgcctgtggggctcttcattacctgccaggtaatggcttctgggaaggggtttggcaaaaaagcacacgtagcagagtgctttaaatgtacttttaaagacacagaacagtatatatagtaatctactgtgttataaatggttacctacagggggtgaggaactgggcagattcttgaatattacctcttcaaaagtgacattttaggctggtccaaagggagtgagttatctcatttgattgttcacagtcagctacagatccaactccttgttctactctttccccccttctcactgctgcacttgactagactaaaaaaaagaaaattacatttaaaaaattgtgataaaatttacataatgtaaaatttaccatttttaagcatacagatccgtggcatgaagtaccttcaattgttgtgcaaccatcaccaccatctccagaacgctcatctgccccagatgaaactctgtatccatcaaacactaactccccatttcctctcttgaatctctgtatccatcaaacactaactccccattttcctctcttgaaactctgtatccatcaaacactaactccccattttcctctcttgaaactttgtatccattaaacactaactccccattttcctctcctgaaattctgtatccattgaacactaaagccccattttcctctcctccagcaaccaccattctactttctgtctgtaaatttgacaactctaggtacctcaaatgaagggactcacggtattaatgcttttttgagtgggttatttcacttagcatgtcttcaagtttca

SEQ ID NO: 5166 - DNA, 1199 bp, Homo sapiens
gcgcggggcggcggcaggcggggtcaccagatccccctagcccgggcccctccaggcgccagggacgctgacgctcgcgctcttcctctctcgcctcccctccccacctctccgctccttcgtccagtccctcccccagcctcggcgcaggggggccgggcttggctccgcgaggcccgtgcattccagagagcccagcgagctagagcaacaaaggagccgggtcgccggcggggagagttcggggggctgcggcgcgctggggcgaaggtggctgctgggccgcgggctggcgcgggggcggagccggagctgcactcgcacccccggcccgcgtctggcctccctcgcggggcggggaggtggctttaatggtgggagagggaatggggctggggattgggggcccaggggtctcctagggctgaagacaacttggattgcgaggctagggcttggggagtcgtgcatcccgttccgggcctccgcagcccaacatgggccccgggttccaaagtttgcgaagttgggcgccgaggggccggggcgcgcggagcgtccgggggggcccgggcccggattctctgggcgcacaggtcgcctgagccgcctccgcggccgccgaggtcgtgcgtgtggccggggggctccgaggagcaggcgggggcgccggggcttttgctgagttggcggggttggccatggccgctgcccgcccagcgcgggggccggagctcccgctcctggggctgctgctgctgctgctgctgggggacccgggccggggggcggcctcgagcgggaacgcgaccgggcctgggcctcggagcgcgggcgggagcgcgaggaggagcgcggcggtgactggccctccgccgccgctgagccactgcggccgggctgccccctgcgagccgctgcgctacaacgtgtgcctgggctcggtgctgccctacggggccacctccacactgctggccggagactcggactcccaggaggaagcgcacggcaagctcgtgctctggtcgggtaagtgcggcggagccgggtctggggggcgggaggtgccgcggtaagatgggggcacccttggaaagaacaggctcaggcctgagttttggagagggcggggacagcacccgggagagttggagggacagatcccgaaactttgggggcaggttacgtgcaggatg

SEQ ID NO: 5167 - DNA, 2022 bp, Homo sapiens
ctgtaatcccagcactttgggaggccgaggtgggtggatcatgaggtcaggagttcaagaccagcctggccaacctggtgaaaccccgtctaaaatacaaaatttagccgggtgtggtggtgggcgcctgtagtcccagctactcgggagtctgaggcaggagaattgcccgggaggcagaggttgcagtgagctgagatcacgccactgcactccagcctgggcgacagagcgagactgtctaaaaaaagaaagaaaaaaagaaagaaagaagtggggaaactgaggtacagagaggccaaataatttgccaagccagccctgggattcaggtcctggaagtgtatctccagccaccctgccatgctacctagatacctttccctaaacaagaggctcgtccctgagctgccttgacaccgtcttttcccatccctggtgccagaatgaggtgcagaacatcaagttcaacagttcaggccagtgcgaagtgcccttggttcggacagacaaccccaagagctggtacgaggacgtggagggctgcggcatccagtgccagaacccgctcttcacagaggctgagcaccaggacatgcacagctacatcgcggccttcggggccgtcacgggcctctgcacgctcttcaccctggtcagccgcgggagggcaggcccggggggccctcagcctggaacgtgggaagagagccagagggaaggggggcaaagaggtcttggtgggggtccccagggaagggtcatgatcagaagggtctggggctcagttaagggtgtctgtgtcagcagaataaccctaacctcacagaatggcccacttctctcttctaggccacattcgtggctgactggcggaactcgaatcgctaccctgctgttattctcttctacgtcaatgcgtgcttctttgtgggcagcattggctggctggcccagttcatggatggtgcccgccgagagatcgtctgccgtgcagatggcaccatgaggcttggggagcccacgtaggtgtcttggggacccagaggtgaaggtacagggaggaaggctgaagtgtgcgtttaccccaaagggagcaggtgcgtgtaaaaccgagatccagggcaggatctggctctgccctactgcatactgcatgcaagatctccagtgttaggatcttagtttcagaatcaggaccttcatggtttgtatctgctcaaaggggcggctcctagagcctcctcagatctgacctgggtcctgtctccaagccctgacttctgggaacctccagacctcagcagctgagggtctgggcacagggtggggagaccaggtagagggagtacagagtgaccgcctcaagtgacacctcacctctctgcacagctccaatgagactctgtcctgcgtcatcatctttgtcatcgtgtactacgccctgatggctggtgtggtttggtttgtggtcctcacctatgcctggcacacttccttcaaagccctgggcaccacctaccagcctctctcgggcaagacctcctacttccacctgctcacctggtcactcccctttgtcctcactgtggcaatccttgctgtggcgcaggtatagtgactggtaggaacgggagacctggatggggtgagtttgagggagggggccagtaacccaccttctgtcccaccccttcctgctgcaggtggatggggactctgtgagtgggatttgttttgtgggctacaagaactaccgataccgtgcgggcttcgtgctggccccaatcggcctggtgctcatcgtgggaggctacttcctcatccgaggtgagtgaagaccaggccaggaccagttgggcaacaaaatatactgggcacttgctgccagtactgggagctgccagcacggctgcccccatgctgaaaccccagctagctcctatagggccttcacacagtagaaggtgaccctctaggcagacgaaacaccgtgagcacttgctgcgggacagcaccttt

SEQ ID NO: 5168 - DNA, 1199 bp, Homo sapiens
ttgattcacttagagacagttctgtttcctgaggcaaaggtacttgaattttcaagtgaaatggccaaaaagcccacagtatacttagatttttttaaaaagcttatatctcttcttttacatctgggcttcttgacttccatctgcttgtctacagaagccatcatgtgattttaaagataatgttgggtatgaagaatgtggagtcaggttctatttaactaggcaattgagtctttcctcaattaactaaattatcttatgctccctgtgtcagtgtggatcctccaagacagacttagaggcataaaatttattgaaccacaaacaatcaattgggagggagccaggagtaggcagggagagctttttgaatatggtgcaagtctaatacctgtgaaggaagaccgggaagaaaaggctgggtaggaaatcttgcagaccacagcatagttgagaaaatcccagccatgcagatgtagagtccccaggcaaaagttgcttgttagcagaatcccgtatggggcaggtgggcaggcactactacccctgccttgctcagtcactggctgggagcagcttaggcaaagagtgctttcagtgttcatggggttggtggctagaggctgaactgtggtccatacaataggttctcttgaagcagatctgagcaacacatcttcttggttactacacttccctagcaagcttatttattcatttcatgacaaggttcaccaagttttaatgtgtcttgccatataacatttacaatagcataataaatactagggaagatagaaataaaagtagaaactcaaagaactaactattactattcctctagataaacaaaaattttctggggtatttttcaaggaggattcacactgaaaatactgagtgataatgacttcattgtctataatactcgtgcaataaatatatttagttgttttattttctaatggctcttttatgtagtgtgttttgagaaaacccaagggtttaacattataacacaactcattgatgataagtatgtggaagctaagattatatggaagagtcaggtagctgacagtctgtatggttagtatggagaatagatctctgaattttcagagaaggaaatggactgaacagcatttaaataatcttgcataaatatgacttctatcaaacaaattttgtgttat

SEQ ID NO: 5169 - DNA, 1165 bp, Homo sapiens
cactgcagcctcgacctctctgggctcaaggatcctcccacctcagcctccccagtagctgggactacaggtccccaccaccacgcccggctaatttttgtatttttagtagagatgaggtttcatcttgttggcccgggctggtctcgaactcctaggctcaagtgatctgcctgccttaacctcccaaagtgctgggattacagccgtgagccactgcacccagccccaattagatttttaaaactgttgttccctgtcagttcttactctggttcaggctactgtcatctctcctagagacactgcggtagactcctcttggtctccctgccaccgaaattgccctctccaaatccactacagcttgaatggtctttcaagaaagaaaatcatgttttttccctgtttaagactcttaaaaagatctgattaacacgtaggataaagtctaaaattctttgaggtggctacagggccattggtgatctcatccctgttgccatctctgacctcatctgccacagatatttctcaggctacactcaaaactgggaagctctcaggtcatttaagcctggaaattgtgccacctcacaactgttgcaagggctgttccctttgcccataacttcatttctctctacaccatctatgcacttacttgaatcctcacctgaataattcttaccattctttcagatcccaacattaataccatcgcctccaggcagcattttttcatctcccaagattgggtgcattagaccctttgtcatcacacccagtactccccacgtttattgagcgctcacgatgcgtcaggccctagtggaagcctttatgcacattatcttctttctcatttaattatcaagtagagcccacaaggtaggtactaccttttttttaacttttgagacagggtctcactgtatctcccagactggaatacagtggcgcaaacacagctcactgcagtctcatcctgggctcaagcaatcctcccatctcagcctcctgagtagctgggaccacaggcagatgcctgttgcccaggctggtctccaactcctgggctcaagccgttctaccttagcctcctaaagtgcagggattacaggtgtgcaactgtgcccggcctgggtagttactaatattatcc

SEQ ID NO: 5170 - DNA, 1160 bp, Homo sapiens
agtaattggatacaaggtcttgggggtaaagccacaggtcatccttcctgaagaaccaagtatcatttaaaaactagcatgaggaaggaatgaaactgagtagcattcattttgtgtgtgtgaaattttagttctggtttgtttgatttgttttttttttaattctaaaaagaatgacataaattttcactcgctttgccatctggctgctaggggagctgagcaagaggctcaccatgcgcatgtgtaagccgcaggtgtactcaaggtgctgaaggcgtgcaaggggcagcgctggtcctcccggggccaactcacagcaggagactcgcatgggagagttggaacacatctttcctttaagtgcctcttttttcacctagcttttaaagttattctttgtccttcatctcagaagggatctctttagcttatgtgtggatttaaaatgacctttgagctacggttaaaaagctaccatctggtgttcagttctgggaaagagaaaaccgtagcctccagacatgctcctgatttctaggccttatcataccatcccctctgtgatgggttgagttcatggagcctgtattctgggaagtcttataataaccacgcacctgtgaacgtgggtcctttctggggagtgaggaatgtgggagagaggcagaaaaaggagcagctcctctaggggcccatcctcccacatcttgccattaccagtctgtgtagcacttaacctcctgccaccactgccaggcttgctcctccgttctctcccagagcaagtcagtctgagcagctccattagtccaaaacagagctttgctgcatgacttcagcctggcctctggatatttggtggaaatatattctaaattgaacaagccaggctgtccagggtggcaagaggatttttgacctggatttatacagggaccaaagactgaatgctcagcctctgtgcttagactttcatggtccttaggatagaagtgagtctctagccctgctacaccagagagctgaagagagatgtggtctggttccatccatacttgctggcatcctttgttaagccttctgagggcagtcttctttgaggtagaccttggaggcctgacatcgaagacctgtgtgttttattttcataaaagtat

SEQ ID NO: 5171 - DNA, 2160 bp, Homo sapiens
tggtatatacccccaacacccacacagtggttataactgtaaaatgaaagttttgcatgtgtaacatgtcgtaacattcttatttcactgccttgtttgaaatgcatataaatttaaatgtgaacattttatactattcttttaaagattttaaatattatatatgtataatgctttattagattaatttcttcctgttaaattccctatgaactgtgtaacttgagataaaaatgttacaatcatttaaaagtgttaaaacatgcagtaaaatcttactcatttggattcatttaatttacaatttgtcagaaaattagagaagaattatgtttacttacactaacaggatgggaaaggggtcatggggtgagagttggggagggtttggtaagaaaattcccctaaaggaaatctcaattgcctagcgaattattttatgaaatcatcatgtgtgttggatgttactatttatggagaataagttggtattctaattactagtttcattaaaacagttcccctaaggacccctacctgataacacttttaagactggatccagcctttctttgcggaatcaccatggcggctgggaccctgtacacgtatcctgaaaactggagggccttcaaggctctcatcgctgctcagtacagcggggctcagatccgcgtgctctccgcaccaccccacttccattttggccaaaccaaccgcacctctgaatttcttcgcaaatttcctgccggcaaggtcccagcatttgagggtgatgatggattctgtgtgtttgagagcaacgccattgcctactatgtgagcaatgaggagctgcggggaagtactccagaggcagcagcccaggtggtgcagtgggtgagctttgctgattccgatatagtgcccccagccagtacctgggtgttccccaccttgggcatcatgcaccacaacaaacaggccactgagaatgcaaaggaggaagtgaggcgaattctggggctgctggatgcttacttgaagacgaggacttttctggtgggcgaacgagtgacattggctgacatcacagttgtctgcaccctgttgtggctctataagcaggttctagagccttctttccgccgggcctttcgcaataccaaccgctggttcctcacctgcattaaccagccccagttccgggctgtcttgggggaactgaaactgtgtgagaagatggcccagtttgatgctaaaaagtttgcagagacccagcctaaaaaggacacaccacggaaagagaagggttcacgggaagagaagcagaagccccaggctgagcggaaggaggagaaaaaggcggctgcccctgctcctgaggaggagatggatgaatgtgagcaggcgctggctgctgagcccaaggccaaggaccccttcgctcacctgcccaagagtacctttgtgttggatgaatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagagaggagacccagacgctggttcgagagtacttttcctgggagggggccttccagcatgtgggcaaagccttcaatcacggcaagatcttcaagtgaacatctcttgccatcacctagctgcctgcacctgcccttcagggagatgggggtcattaaaggaaactgaacattgaaaaaaaaaaaaaaaaaaaaaagactggatccaattgctgaaaggacttgaaaagaattatagatgcatttttttaaaagtatcatatatgtttagattttactcatccttgttgctttcttaccatttattctagatagtttaatattatatgctttagtgaaagctaacttatttttgctgtt

SEQ ID NO: 5172 - DNA, 1199 bp, Homo sapiens
gcaaacccctagcctcaagtgatcctctcgcttcagcctgggattacaggcgtgagccactgtgtctggcctgccttctcatattattacacaagatgtttaagaccacaaaatactgtctggtcctgccagctagactgagttactggaaggcagaaatcgtgttgccgtcctgcacggcccaggcacagtgctgggcacatggggagggtggtgtccctcacacatgtgctgcttgatgacagtagtggtagaggggtctggagggtgagttgcttcccccagctgcagaaccatcatctgcacactcagaactagcttgttgcctctgaggttctattttatttcttcagtgagacacatcatttctctgttgggagttgggtatagtcaaaatcacctcttcaaaaagcaactgttttctcctttctcctgacagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtgagcttggttttgtgagctttggttttttaaaacaatagcaaccttctatctcacttcaaccatcactctccacatacccataaggcaggccagtcagtgatgcaaaaggagtgaggacttgacttttctacaagtcctcaactgcaagttgggggcccctcaccccagtactttacccatttagctttagggttgtgggtctcatcctggctgcacaccaggtcacctttgggggctttaaggctggtgatgtctggacctcgccctggaggctgatctgattgggctgtgatcaggacagcaggagtgtacaggctctccaggtgattccagggtgcagccaagg

SEQ ID NO: 5173 - DNA, 1185 bp, Homo sapiens
taatttggatctgtgtcctggctcaaatctcatgtccagttgtaatccccaatgttggaggtggggcctggtgggaggtgattggatcatgggtgtggatgtcccccttggtgctgttctcgtgatagtgagtgagtgctctcgagatctgtttgtttaaaagtgtgtggcatctccctgctgtctgtctccctcctcctccagccatgtaagatggggttgcttcccctttgccttccaccaggattgtaagtttcctgaaacctccccagaagccatgcagatgtcagcatcatgcttcctgtacagccagtgaaaccgtgagccaattaaacctcttttctttataaattacctagtctctggtatttctttatagtaatgtgagaatggactaatacagaacccttagctaggagggcttttagcaactctcccaatccagaactctaacactcctcccctcccatggagaaaacccatgctcgagactgcccaagttcaaagagaccattctacattatctaggcactagagcctagagccatagaatatatctatttagggccagatgctccctttaccaggctggagtggcaaggagagctgggactacactcacttagaagagaacctggccatttctattttctgcttcctcttcattttgctggctggtgggctttggaccagccttcttcctcaatgcagtaataaggtccaagattcaaccgaagattcaactgtagtccaactaagatcagttggaagataccctgcatttggaggccaaggctccagccaataggaaaagtgctctttcgtccagtactggcctctgtacatatttcttcccttgggaaactcacagagaaggttgcctgatggtagggagccaaactgggggttcccaggtccgttcctgctaaatactacccttttaagatggtttataagctgcaaagacctgattgcaaatatttcaaaaataataataataatacaaataatggtaaatgtctattggcatttttcatccaacgggttgtgccacccatactatcatcacttttcttttctatatccccatgaagttaattggcaaatgttataatgttcacttacaagaagcaaagacaagtttagaacctgacctcaggacacaggaagagttctaacacagaa

SEQ ID NO: 5174 - DNA, 1150 bp, Homo sapiens
agccaatatcacagcttttgaaaaattaaaaaatcacactatattaatattttatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccatgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctt

SEQ ID NO: 5175 - DNA, 1254 bp, Homo sapiens
ttggaatggaaagtattaaagcatatattatacatgttcatgattgcacatgcctaatttacttaattgcttgtttctttaccattcatttacattttcaaactttttattaaaacattctgagacagtgactgtcatttcagtaatgtaatctttgatctgtgttttctgtgaagtaaataaaatttttgtgatctttagatagcatgatttctattttagaatttatgtgcagaaaaaatgagtgtctaacttttttcttgtttatttgtagtacacttataaaaatgactgaaaatagtgaaattgaaatttaggattattgtcattttctttttttgtttttagtatgtgtacaatcaacagtagtgtaccttttgggatgtagaaattaatgttaattggtcattattcttctgtgagaatgctcagattttctgacttttggatattattcctgtgtatcagaagtgagaatttatctggtgatcggtaaagtggtctatttttgtgttttcagatatgattcatcaacttccactgttgacagaaaaacagtacattgcaacaattcactctcgtcttcaggactcacagctttggaaactgcctgggctccaagccactgttagacttgcctgggcgctggcattgaggggaatatcccagctacctgatgtgacaggtgaattgattgtaggtaattttgttatgagaaacagcatgttagcacttaatgacatttttggaaggagtattatctttgacatacataagcataagcataggaagatatccagagttgtattaaatgaaacctttagtgtagtagtgaaatacagacttttttctccttgtctctcaaaaatatcatatgaaatactatttcccattcttggagccactgacaatgctcttttaccttcagggtatgagtttaaaatttggaatgacagtgtcacattaattttttttttttttgagatggagttttgctcttgttgcccaggctggagtgcaatggcacagtctcggctcactgcaacctctgccccccgggttcaagcgattctcctgcctcagcctcccaagtagctgggattacaggcatgcgccaccacacctggctaattgtgtatttttagtagaaatggggtttctccatgttggtcaggctggtcttgaactcccgacctcaggtgatccgactgccttggcctcccaaagtgctgggattgcaacacgtgagccacc

SEQ ID NO: 5176 - DNA, 1203 bp, Homo sapiens
tagcaaaaacttatttaaatatagcctatcaaggatggaatttgattctcttacaacaaataaaatttaaagattgtgttgaagggattagaaaattaatgggaatttaaagtttttgaatgaaaattgttttacgaagatttctgattttctcttcccaggctgtttatgaggaaaaaaaaaatcctggtttatttttgtttcttgtgtttgtattgaaaccaattcagatcttgaaatgaaaagttgaaaactaattatggtagaaaacagttttaacttagtttattgacatggctaacaattattccaggctaatgcagtcttatcgagattctactttattttctttttgaccaacttttaacagttttctgaattcagactatattcagacagtcttagtctgttgagttttttaaaagtttagcttgtgtcatctttatgttttaggaagttgaggctcacacatgccataaacaaatttctattactagtaattgtcagcatctaatttaccttttagagtaatggcgttagacctctgagaattatctaatggcaaaaggtttttcactctattttcataagtgtcttatttttagttctgggattttgtttaagaagcttttagaaaccctctttacacctaattaaaaataaaaattaacatcttacctattatggtatgtgttttataaaacttcatttagctttgcctgaaattattattagtattgttatatggttaattttatgtttatactgtcacagtttagggtttcaatgtcaagcatattaaaatagtattggattaaaaaaatcttattgtaggaccaggcacagtggctcgcgcctataatcccagtgcttaggtaggctgagacaggaggaacactgaggcaaggagttcaagtacagcctgggcaatagagtgagaccctgtctctacaataaaaaataaataaataaaaataaaaactattgtataagtgattctcagccttaattaaatgttaaaccacatcattaattgaggtattataaaatcatgcaatttaagtttaatttttcttatgtatttgttttgtgaaatcaaaaccaaactatgatagttttttgagttatgtatttgaaaattactttaaaatattgttttatatatcagtgtcaaaatacgatagattcaggatctttgtgaaa

SEQ ID NO: 5177 - DNA, 1144 bp, Homo sapiens
caaataggaaaagaagtcaaactatctttgctcatgatatgattctatacctagaaaatcctaaagactgccaaagggctcatcgaattgataaacaactttaataaaatctcaagatacaaaatcaatttaaaagatcagcatttctacacaccagcaatatccaggctgagagtgaaatcaagaacacaatcccacttacaatagccacaaagaaaatgaagtgcctgggaatacggctaaacaaggaggtgaaaggtctctacaagaagaaatacaaaacactgctgaataagatgtcttatacataggtccttttaaaaatacgtttaatcagtttgattactaaatgtacttccatttaaaagcactactgaatgccaagtactatggactgaatatttgtgtcctcccaaaattcctatgttgtaggcctaacccctagagtgatggtattggagatggggcctttggaaagtaattagggttagatgatgccacgagggcagggccttggtctgatgagattagcacccttctaagaggagacactgtgtgttcactccttcgcccaaagccctctctcttctctctctctctctgtacctctgtatgcacacaaagaggagaagtcatcatgtgaagacacaatgagatcattgccacctacaacccaggaagaaggcctccacctgaacccaaccatgctgacaccctgatctcagacttccagcccacaaaactctgagaaataaatccctgttgtttaagtcatgcaacctatggtattttgttatggcagtattatttacagtcctcagggacagcagaaaagtgggaattttaaagttgtgatttatctacatatttgattttatatacttgctgtactatcatttatttgagtcattagcaatttagaaagctttgtatagcattgttgtaaataatgatttattgaacaccaattttgattctgaaaggaaagaattctaattttaaaatataaagaaagaagaaaggaacacaattggatatacagagcttataaaatacagctcataaaactgctggtctttaagtttctgggatgtgagagagtcaaaagtgtatatcaagtactactttctctcatttcttgtta

SEQ ID NO: 5178 - DNA, 1144 bp, Homo sapiens; identical to SEQ ID NO: 5177

SEQ ID NO: 5179 - DNA, 1118 bp, Homo sapiens
tacacttgtaaccaggtttcccagagttgttgataggcttctgctgaacatatgccaacccacctgcataatatatttttgttgcttttataaatcatgcattacataaagtgtgacaacttcaaaatgtattctctgttcttggaatacagtgccctaaaatggtgttcttatgacctgcagaaaatatttacacatatttccaaatatttatttcatgagcagtacagctaattaaaatatataagcttaaattttatatcttacatttaaaatattaagattcctttgacttgccatccatataagcttgctaaaaatattaagaccaagtcatgcaataattgaatgtacctcaaatttttaggggagggtgggttagggactgatactcagattgtggataataattgaattggtttttaaaggcaacatagcattctacagcagggttaatctattatcaagaacagtcaccctggttaataacaagttttactgatcagttgctggttggttggttggttggcatgtgggtgtgtgggtgtataggtgtgtgtgggtgtgtgtgtgtatttttccccatgagtcctttttttaatcctgtggctttttcacttacaactagcctaaccctgtaattttcctacatccaagaaaacaatcacaaagtagtggtttaaatactttgttgtatttggctaattttgctgtcttaatgcagcctattaagagttgggttaaaaatcagtaatcagtactttattacatcactgaactaaaatatggagacatcctcattgaaaatggagggcactctatcagtctataactatcaacgtagtgcaacagggtgttttgatacctttgttttcacctcttgacataatgctatttaaaggcttgaatttttccctttatataattttcacctttactttcaaagtgttttgttgtagttggctattgcagagagtgcattgtcctatcattcctaaacctggtctgctttctacattcatggtatggaaaccatgtgattctttgtacagtttatcctgatgttgcttgtaatgcagtagaggctatttcgccttcgcttttctttctcgaccttt

SEQ ID NO: 5180 - DNA, 1118 bp, Homo sapiens; identical to SEQ ID NO: 5179

SEQ ID NO: 5181 - DNA, 1194 bp, Homo sapiens
accgtttgtaaccatgtagagctgttgttttatatgaaagagattttcttctttttgaaatcagcatagtacattttagttctgctttttcaaaattaattactttgattttattattgcataagcttctttaatggataccctgtagttttgttaggcagattttttttgaaaattgattatactctttcaaaaattcttagttgctaaaatagagttgttccagtgcatcttttaaaagttataatcagtgtttatattaagtctaatttgttctgccttttatcaaaagtagaattcttatggattattatgaattcacttgaaaagacttggtttaagaactttccagattcattgacatttccaatacattatccagttgatttatccttagcatacgaaaaaaggcaaaataataaacagggatttagaaactcagtatgatcacaactaataggggagaaatcagaaaaacaaacatgattgctagaatatttgaaatcaaactttatatgatatgctgtatcatttataatttattataaacccaaatacttaggtattattatctctcttttatggataaggaaaccatttatctcggggtggtctaactgcttgaaagtcaaatacaatgtaatggaatcaagatttgttccaagatgtaggattcagcagcctgtgttcttactattacttgaaattgcctttcagaagtactgtcaggtcagttaatgagaaatggaacatgtacatatctgcaggtaaaaagacttgtggcctcatttttaattggcaagctggtaaatgagaaaaatgtagagatcaacagatgagaggcttccatttcaaagtttaggtgtgagcacattctgtggtgttctctttttgcccccagtgacagaaaagatgtttttaaagtgagttgatcagtatctgctttggaccagaagaattggatccatcaaacaagaaatgataaggaaaccttgaaagacagaaaacaagcagggtagggccaaagaagaaattcccaaataagagcaagagagtattgttgcaaaaggcaagagctgatccaaggccacgcccagaggtgcctagtacccccaagcaacaaatggagtgacaagttggatgcacttcaggaagaagcaaattaaacccaaaaggaaagactgagatgcaaga

SEQ ID NO: 5182 - DNA, 1194 bp, Homo sapiens; identical to SEQ ID NO: 5181

SEQ ID NO: 5183 - DNA, 1127 bp, Homo sapiens
ctaacagttgtccctttaggaggacaaaatggggtcaagaggacacagaagagttgtatagcaccagattggttccaaatagttaatggatgtgtgcacattttctgttcagggattaagaccagaatatcagtggatttgttttccccaccaagtggcctcttagactagtcattaacttatgattagctctaaagatttcaaatagtggcagacagtgtcttctgaatgtaagttttgagaaatacgagtctgtcagagcggccataagccataaagagtcaatctcttaattatatttttcatcatgtaaacaagtttcccatttccctttcttagattgcaccagtgaaggagatgttttgcaaagattcagagaactaatttttcactggataagacctgagtaacccagaccccccaccgtggttcttttcacagccctcgactttgcacttaaaaagggatattgtaaatgaaaggctgcagtgccagttttaagaaagaatttctgtgaagtgtgaggactctggagtctagctcacataaagagagtgttatataaaaatccgacagctgaactaggttgctcttttttggcagggagtggggatgagatttgacaccaatatgggcaaaattagataaccttttggttaatataaatgattttgatttggaggcctaatttgtagattgtgaaagcagcttttagtttaacttattcacagaccccttataattaccatgtttttttttttcttcctaaatctcttggttcagcttgtgaatcttacgtgcccgtaaagttgggatgttgaattggctcttctttgttctggcagtgagtcaagtgtccagcattttttcataagtgttttttaaaattgttctccagcattttatggctcctccctcccatgtcctcagacccagcaaaagcgtagaggcagaattagaggcctctccaggccagctcctctgcccacatgtcatacaaggtgtgaatttgagcacagtccagaaatggagacatcccacccccagttgaataatggcccattcatgccaaccttgccaacacggagagggcagagatgcactagaagaccttcatcctccccttc

SEQ ID NO: 5184 - DNA, 1162 bp, Homo sapiens
ggggaccagggttggctgacggggcattgcctgttgtggcctcggctattcaggtattcctgcaggagagagatgctgattgctgctcatcctctctgagggcagtgtattagtctgttttcatgctgctgataaagtacccaagactgggcaatttatgcagaaaaagaggtttaatggcctcacagttccacgtggataaggaggactcacaatcatggtggaaagcgaaaggcacattttacaaggcgtcaggcaatagagaaaatgagaaccaagcaaaaggggtttcatcagatctcatgaggcttatttactaccacaaaaacagtatgggggaaactgcccccatgattcaatgatctcccgctgggtccctcccaccacatgtgggaattatgggagctacaattcaagatgagatttgggtggggacacagccaaaccatatcaggcagctatgggtaaggtcatcttttttgggtcagttgttgtgtctcaggagagcccttcccatccatagtatgctgggtggtctccattggaagaagggacaaggaggtgatgtgctgaggcttcccgtggccttcagcagttagttctctggccgagcagaaccagctgtgtgggccatgcccaccacggggctgctgtacaggggaatccattgtcctgggggctccaggagtgaagcgtttacctgcagttatctcccttggctcagtagcagtggctggtacaacagaaatgtgcactgttcagaaagaacagtgagacccaagagtgctttcattcacgtggaagcctggttggattcctccttcagaagcccatctctgctgccctggagatgcctgatggacgctgaccaaggctccataggccctggcagagagggtgttgtgcctccttgaggaaagacgcgggagactttagaggagaaagtccccccactgcactctcacttatttttcctgtgctcactcccgtatctgaagatggatttcatgttttctgaatgaagaatgcctggcgtcttgcctgcgggcatgaccacgcacattgctccagaaacaaaccggcttttttcaaagcagccactccggctttttgagatggattctcgctctgtcacccaggctggagggcagtggtgtgatct

SEQ ID NO: 5185 - DNA, 1169 bp, Homo sapiens
tctttcttacaggtgcgttctttgaagaaaacttgtgaagcctgtaaattgagtggaaggagtaggaattatttgggttattaatatattcttcactttctaaaaatgaagaaaaaatatccatcttctcaagtttaagagttctttactagttgaggggctgggcctagttgttgagtttggagttactgtatttttttctgatgcgaagtagtctgggcccagtggagattctagggtgaaggaggacttggggttgtataattaggcacccctgtggacagtcaggatgctgtacagacggtggggaaaggaatgaggttgtgatgttaatggatttctcaagtgtttatttgccttctgttatgtctaggcattgtagattcctgtagtcacatctttgaagagagagaaataggtttaaaaaaaatgcagaaagtaagtggtaaatgtgttaagagaaggaaatgtgtgagtccttgagtgcactttgggtgcctagtgacatgatttcctgggtgagtggaaaaaggctagattgtggaagtagcagttttccaggtggagaagggagggaagtggaattccaggctgtaggaacctgtgttcaagatggggaggagtgatgagcgctgtgttcagggaactccacgtcatcattacatctgactagaccagagtgggaacccagtggagtggagaggccgaagaagaaaagacaaaacattttatgagttttaatgtacactggggggtggggggcattggattaaatccacacacactgcttttctaaaaggcctctgtttgacaaaaggaaatgctgttcagctctaaaagtagctcttcactactgggttaattgaatttgcctactttcctgtaagtgacaaatccctttttctagaaaaaggtgaacagattcacctagctctgtgcggaatgttgtttcacctgtctgaatggtctaactcttttaggtggggccttatgctgtatgctagcaatcgcaaatgtttgcccaactcaaagaattcagaacctggattgtgaaattcaagttaaagtaaaataactatcattgttaaattgtgctgtttcaatatggcttacctgggctgctggcttctcgagaaatattcggcatggctgtccgtgtgaaggattgc

SEQ ID NO: 5186 - DNA, 1161 bp, Homo sapiens
ggttgcaccaatctgcattcccacctaaagtgtacaaagggttccttttatccgcaccctggccaacacttgtcttccttgtctttttgatattagctggatcctaacaggtatgagatgatagctcattgtggtcttgatttgaattttcctattgatcagtgatgtggaacatcttttcatatgcctattggacatttttatgtcttctttggaaaaatataaattcaaactctttgcccatttcttaatcacgttatttgggtttttgctattgagttgtgtgagtttcttataccagttgagcatcccaacggaaatctgaaattctccaaaattcaaaactttttgagcaccatcatgacaccacaaatgggaaattacacacataagaattgaacacaccttggattcatgcacaaaattattagaaatattgtataaaattgctttcaggctatgtgtgttgagtatatgaaacataaatgaatttcatgtttagacttggaccgtatccccaagatatctaattatcaatatacataatacataaaatctgcgtgtgtgtgtgtgtgtgtgtgtatctatatattcacataaaaactatcaagaatcttactgtcttgccttctcttcctggcgtggaggcaccagcatggtgactgaggtcactgcacattggagagggttggggaaccgcaacaggcatgaagctggcagccacggatgtgaagtggtgagggaggaatacggaagtggtaagaagaattagccagtgtcatttggattttggttacattgagtaaataagtaaatggattgaataagtaagtaaatatattgaaggtaatcgcagccaagtttccagagaaggtgtttagaaagaagttaggctaggaagggcccaaagatgtgttggattggaattaagagtacaagtatgaacttagagttttatttttattcttggactcagatctagcaataattatagatgtatatgtccatctgtatgtgtgtatgtattcgttgttggtgtgctgcatcccaatagcagtgaggtcacttccttccagatcttggtttcaaaataccaaagaaagggggggaaagtaaaagttgtgcccagaacatgttgttataccagaaaactaccaaaat

SEQ ID NO: 5187 - DNA, 1177 bp, Homo sapiens
taaacccagaggtgctttggattttgcatccagctttttctcaacacccccgctggaactcagcggctccatctcttcgccttcggaagcacctgcgtctctgtctctgatgccgagtgacttgtcccccttcacatctcagtctttttctcccttggttgagacatttacattgtttgactctagtgatctgcagtcatctcagctgtctcttcccagttccacaaatcttgagttttcgcagctccagccaagttccgagctgcctttaaacaccatcatgttgctacctagccgttctgaggtgtcaccatggtcaagcttcccttctgattctctcgagtttgttgaagcgtctacggtttcactgacggattcagaagctcattttacctcagctttcattgaaactacctcctatcttgagtcttcactcatttcccatgaatccgcagtcactgcactggtgccccccggctctgagtcttttgacattttgactgccgggattcaagcaacatcaccattgaccactgtccacacaacgcccattttaactgagtcttctttgttctcaactctgacacctcctgacgaccaaatcagtgctctagacggtcacgtgtctgtcctggcctctttctccaaagccattcccactggtacggtgttgatcactgacgcgtacctgccatcaggatcctcgtttgtttctgaagcaacccccttccctctgcccacagagctgaccgtcgtgggcccatcactcacacccacagaggtgccactgaacacctccacggaagtgagcacaaccagcaccggtgctgccactggtggtcccctcgactccaccctgatgggtgacgccgcaagtcagagccccccagagagtagtgctgctcctcccctgccatccctgcgtcccgtgactgccttcactctcgaagcaacagtcgacacaccaacactggctactgccaagccgccatatgtttgtgatatcacagtccccgatgcctatctgatcacaactggtaaggcccagcttcctgccgcctctctggggtgggcaatctttctaaggagcttgtgtgcagtgcctgtgaggcttggagcttcatggttaagagcagaggcgctgggctcagttaactcccaggtagtactcctatgc

SEQ ID NO: 5188 - DNA, 1196 bp, Homo sapiens
taaattcaactgtcctgcagtaacataacatttgagaaacagagacaatgtaataagttttcataaagctaaattaatgtagagaaatttttatcatgaaatgctatcttttcaattgagggaaaaagcaaaaatgtcctttttaaagtgagaaatggctgtgttttctcctaatggataataagagtcatgccacttgtgttgagctttttactttcattgtcaacgatatttctgaaagcccttatgctctgcatattttgtttctttttttctagtccagatttctcctggtgataattaaaaaaatttttacatttaattattactattatttacacttaccattttactatgtatatttttgtagtaagctatcttaaatctttaatggaaacagtgtagggtataaatgcatttcctttacattgagagacttgctggacctttacttgtttatgttctgtttttatatcttatcattatgcttttatatgtgatgttattggtcctctgtcatctttgttgcagtattttattcaattctataatagtctactttaatcttagttttgttggtattcattctgtaaaatattttatataaccatgcctttctctgattttcactcatgattaagctgttagaaagttatcgcattatagttggaaaagagttttctttggtaatttatcggggtttttgatgtcaagtcgcatgtctgtagactctacaaattcaatgtattctaaattgaattatgaattttcctttagtcttgttcctgcttttatttccttatttttgaatgtcaccactatctacctaatgacatagacaaaaagctgtaaattgtcctatacttttttttctccttgttccctttgtcaaattggttacccagtgttggagagtttcttcccctcaaaaacctttcaaatatttatccttctctgcccctttctttccaccctgtacatactgccttgtttcaaaccctcatcatcttcctgcatatatcctacagatgcataaactcagtggttttcaagtcatctgttatgggagtttttggtaaaaggtgccctgttcccactgcagtgatggtagccctgttttaatctttaatagaataagcgtttgtggatttcactggtctccttaccactcttcacttctcctgccttccatctgg

SEQ ID NO: 5189 - DNA, 1194 bp, Homo sapiens
agttaacgtttcattaggcaatgtgcctttgtttgactggtgtgtaagtccttcttccaggtttgtacgctcttaaacgcgttattctaccctctctaactcctcccagcagcaaaagggagacacttcagctggaacaaaatagtggaagaaatggcgtctggggttcagtggggattcgcagtgtgtatgcaatgtttgcaagattattttttatgtttttcaattactgtaaataaaaatatatcaatgcttagtgtcaagaagggaacattgtataccagtataaactctcttagtgggtctgcaagttgcttaacctctcggggcctcagttttctcatctgcaatatgaaggagttggactcgataatctttaaagtccattcctgctctaaaatcctatgcttttctgaagtactctatttaacagaatgcattgctttctcactttgactatttgaattatgtatgcagtacacttactgcaactgcatgttgtctaaaatagtttttctataggatgtatataaaaactaatccctcttgagctgatttataatgtgtgtatatagccacacataaaaagctagtaatagtagggctctcagaaaatactttccagttgtctaaccttgaatgttattaactcttctatattacaggagatacaactcgtcaacgaatcaaattcagtgatgacagagtatgcaagagtcaccttctcaactgttgtcctcatgatgtcctttctggaactgtatgtatttactaaatgtattgttagattactgatatgctgcagtaatgaactacttgataaagtcttaattctgtgtcaaaagaattgacttgtgaggggagatttgcatcctttattgtttgtttattcaggatgattacttaaatcttcagtaatgggtttcctcacaaaagtggttgatacgttttgttttataattttttccattcttcagagcagttttttaaaagcatgttttatttggaatacagaagtagttatatagcatttgtacttttagttcagaaataaaataatttatttttaaagttccttttactgttaaacagagtagacttttatctagtacggtatacatttttgttaagatttgtacacatttgtggaatcagtggggaaatatattagtaaatacttatatccacacagct

SEQ ID NO: 5190 - DNA, 1099 bp, Homo sapiens
tttattgatataaagttgttcatagtgttctcttttaatatctgtagaatgtttgcaattcgtgtcttttcttaattaatctagctggtcagttttattttgtttttcaaagaaccagtcttctgattttattgtttttttcttgttttctatttcattgatttctgttcatgtttattatttccttatactccagtggagagaggcgctaaggatagaggatggggataaagggaacctataattttcataacaaaatagccatgcttttgtggtttttttttttttttttttttgagctggagtctcgccccagtgagccaccgtgcccagccacttttgtgtattttttagaaaacacttttggtataagcatagtatattttatttaattgtatgacttttagtgagatttatatggtcattgtttttctcacttttgtttaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaaggtacattggtaaaatattcctcactttatcctcttgttcttttgatctgtatcagttgcctttttgtacaatattcttgactatgattcagtaatatagtatctaatgattaatactaaacagtgtaggattatagatggaaattcaagttggtttaatggatgctgcctgagaaacagacttaatattatcctgttattttgggagttaccattttatattagatatgacaccgagttagggatctttcaaactagttactaaaagagtcccataaaacttcattgttattgttcttttcaataaggtcaataagaatgtaataatataatatttataagaagtttgagaaaatgaacccaatattaatttgaaatattttgcaattctttattaaatagcaagcttgcagaatctctagttttattttatgctcctgcttccacttcagaaaggacttatgaaaaaatttata

SEQ ID NO: 5191 - DNA, 1213 bp, Homo sapiens
ttctgctcagcctaccacgctaccctccccctgctaagccacacccaggtgagaagggggtgtccaatctaagggggtacagatctttctagaccacagaatcctagcactggaaagaagcttaatgattgagtccagctcttcattatagaaatcaccaaggtgtagaggagtagcatgaccataacttcgtgcagcctctaactcctgtgctcaggcaatcctcctgcctcagccttttgggtagctacaggcatgtgccaccatgcccagctttaaaaaaaatttttttttggccaggcacagtggctcacacctgtaatcccagcactctgggaggccaaggcaggcggatcacaaggtcaggagttctagaccagtctgaccaacacagtgaaaccctgtctctaccaaaaatacaaaaattagccggacatggtggcgggcgcctgtaatcccagctatttaggaggctgaggcaggagaattgcttgaacctgggaggcagaggttgcagtgagccgagatcactccactgcactccagcctgggcaacagagcaaggctccgtctcaaaataaataaataaataaaaataaaaataatttttttttaagggacagggtctcacgatgttggccaggctggttcaaacttctggcctcaagtgatcctccttccttagcctcccaaagtgctggaattacaggccatgagccactgcgcacagccaagcacttatgtttttaatcgttggtctctgggtcatcttttgataggctgggcttggctggacagctcagctttataatgcagattgccagggcttggtttgaggctgcaggttgggtctgtgtagaatattccatccccatgggagagggagaggagtggatgtttgctgaatagtaatccagtcagtgggtttgagagcatctacaaaaagggaccaatagataggatccagtccttggcataattttgttttccttttttatttatttatgtgttgtgtctcactctgttgcccaggctggagtgcagtggcataatctcggctcactgcaaccttcacctcccgggttgaagggattctcttgcctcagcctcccaagtagctgggattacaggcatgtgccagcacacctggctaatttttgtatttttagtagagatggggtttctccatgttggtcaggctggtctcaaaatc

SEQ ID NO: 5192 - DNA, 1764 bp, Homo sapiens
ggtggcatctcatgggctcggggaatgtcgagtcactgactgtccagcccttagccagcttctctcccacatcctcagagctctcctgtgcttctgaaatctgttaactaaatctttggcttgcctctggtatttaagcaagaaaattccctcccagaggtgaccccatccgcttccccacaatccatccttttgccatcggcgcacctggggcgtggcttaggttcttcaatgcagggacatttgccccctcccagaagctgctgggcacagtgaggtggcgtaagagtgactggcaggtggtaccttccccaggaaatttcaccacaccacccagttcctcagcctgccccctccccctgtgatgcatgcccccagcacccaattctagccagctggaagtgggtggagggacagcaggaggccagagaaaccctgaacaaagctgggcggctgctcaggcatcacaggctgcaccccctctgaaagcatccccactgggctccggccacatcttcagtgcactgtgctgtgtgcgctgggtgctcacacgctgtccccagacccacaaagtgctaggccccagttgaagaaaggggtgaaatagccagcttcaccgaagggaagggaagggaagtattgggcgatgccagccccacagacgctcagcaaacattagtgcacattctcctagtcctcacccaatggcctcctctacccccatgcatggagctgccacatcagaagccccaagagaagctccctgcaggagaggccagctccctggatgcccaattgcatacctggccgaatctgccattgagtcaccttagcaaataggctgctgtcactaggaccaagctctcaagcagagggatgccaacctagtccttacttagcccacgaatcatctagagcatcctctagtcttttgtgggctccctccttcccatttgaagagacattgttcagaggaagaggggaagatttgaaatgtcaggtcacggaggagtgtttaactggagcctggtgaaccgcagggcaatttgcttctgctcactgggttctgactggcccgtctggacgtgggcccccatgtctctgtgcttagggcctcttcatgatgttttggatgtttccaagggaagtgggtgagcagatcaaggggtgggagagtcgaggcttgatgccagttaatactgtgaagtggagcgtgcggtcagtggaattcagaggaaaaagaagggttggagcaaagcggcattcatctcctggactgttagcctttctagtcttcctggtggctgaggtgttcacgggctgggggagccagctgacctttgtcctcttcaacctagaagactcagcccgcccagacaccaacgtgtgagacggatggacatcaggaagggaaggggagattagcccaactgctgacagaacgatttcccttggttggaccttgggaatggcaaacactcatattggaacaagcttggggtggaagatttaggccgtgtgagcatgtgtgagtgagtggaacaaactttcttggaaactggagggaggagatgaggaggcttcgggaagtattactgatggctcatggttgagagagcgacgtggggacccagctcgccccagcttttgtcccaggttctctttgtctgatgctgagggcagggtggggtgtgggaccaccactcttgttggcctgtcaagtagaccctaggacagaaaatggaaagaaggaaatggctcggt

SEQ ID NO: 5193 - DNA, 1976 bp, Homo sapiens
aagtcaataacaaaaaacccagctcaagaacccattctacgccaaactggaaaggagaagagagcaacaggaagattccagaaacggggggccccagtttttgaagaactttatgaacttttcaaagattattttcatatggcagcaagtgatacggaagactgctgtcagggacacctgatatggaaatcaaatagatttttaattaattgaacataagatttagggatttttccagaactcgaaagggtcaacagccctccagaatgtcgggctgcagcctgaggaggctgatgtttggagctggtgtgggattggcgaagcccagtccgggctccctagtcaggaaagacgggggacggccaggctgctggaaggcccccgggggcgcggggcgagttttctttttctgagcactctggataaatccctaagcaacgttgtttctcaaatgtcattaataatgtgtgttgcaaactttaggtttttttcttttctgaaaatgtattttctctttgaatccacccctagtcgcgtagcgtagggctagcggtcgtcacagacaccctagtagaatgtagcactcagcacccttgtctcctaccttgtgttcaactccaatgataccaatagaatattcctcaatgtaattgcacaaaaaaaagcgatataacataggcatgtaaccaatgtggcggtgcaggtgtgcgggtgagcgagcacgtgtgggtgtgcacgcgccgccctccccgcgtggccctcggcgccgccaccctagctggcgcagtcttgacactgcatccttccctcctagtgccttaccgagcgacagacgcggcgtgagggtttacttccactggtactccaagaaactgaggctagtcagacacaatctcagctcttctgttgtgctgttgtaacagtttacgctggccttttttttttctttttctttttctttttaaaatgttaatgcccgttgtctttcctgggctgtttgctagcggaaggatgccagggaagccagcaggagctaggagagagtccgtggatctcgaaagaaatatgggagacagatgcccggcgggtgcgtctggagatggggacggcgggagttgagttgtggcagtagttgagttgtaatttgtgggcggaggcccagagagactccccacccttcacccctgccccactctgtccccagttccgccatttgtgaggccagaggtttccggactgttggcctcgccaggcagccgtctcccgccccaggcggcatcccccagtccctcccgcctccacgagagcctggagctctcagcctcgcccggggctccactctctcctccggctccctgggctgttttgctctaacgatcttgccagatccctccctctgtagacaaccaccaacctctgtttgctgttgaattctctcctcacattacccaggtctgctcaagacatgattttggttttggtttctgagggttctagtgggcagaaggttggagggacacttatgagggtggccgggggtctgacgctgcactttggaaaaactcacacagttgaatttccaaagaaatctgccctttgccctctttgcacctttgatacattctggaagttttctcaggctttggacacttctggggatggaggtgtggagaagtggggagttccctctcttcatagtaaataactctgaaatatgtgaatgtgaatggcaggagaatctggccaaggatggggccgaaaagggtggttctaattgtttgcttctgatgttgagtctttagctgaccccacaggcaggtttccaaggtgcaaagagatctttcccgagtcagcggccccatcctcatcctccctccctttacttcctcactgtgcagtctccctcaaggatctactgtgaaaggtgtgtttgtagtgatatccaacctaactcagtaacgaagtcgttacttagc

SEQ ID NO: 5194 - DNA, 1534 bp, Homo sapiens
cctatgtcctgatattggaattctgtttctgagtctcagctgtgttgctggcacctaatggtggcaagtggcaccctggaaccacttggttccacaaactcagtgaccagaatgtgcttctgggtggaagagattcactttttcaaccttgttttcaagtgggaggaatatattctgtatggcccaagccacagatgagaactgaaggggatctgttgagtttacttgtaccaaggtgactccgatacttacttttcgttttcctttccttgtaggtatggcctcacatgtgcaagttttctcccctcacacccttcaatcaagtgccttctgtagtgtgaagaaactgaaaatagagccgagttccaactgggacatgactgggtacggctcccacagcaaagtgtatagccagagcaagaacatccccctgtcgcagccagccaccacaaccgtcagcacctccttgccggtcccaaacccaagcctaccttacgagcagaccatcgtcttcccaggaagcaccgggcacatcgtggtcacctcagcaagcagcacttctgtcaccgggcaagtcctcggcggaccacacaacctaatgcgtcgaagcactgtgagcctccttgatacctaccaaaaatgtggactcaagcgtaagagcgaggagatcgagaacacaagcagcgtgcagatcatcgaggagcatccacccatgattcagaataatgcaagcggggccactgtcgccactgccaccacgtctactgccacctccaaaaacagcggctccaacagcgagggcgactatcagctggtgcagcatgaggtgctgtgctccatgaccaacacctacgaggtcttagagttcttgggccgagggacgtttgggcaagtggtcaagtgctggaaacggggcaccaatgagatcgtagccatcaagatcctgaagaaccacccatcctatgcccgacaaggtcagattgaagtgagcatcctggcccggttgagcacggagagtgccgatgactataacttcgtccgggcctacgaatgcttccagcacaagaaccacacgtgcttggtcttcgagatgttggagcagaacctctatgactttctgaagcaaaacaagtttagccccttgcccctcaaatacattcgcccagttctccagcaggtagccacagccctgatgaaactcaaaagcctaggtcttatccacgctgacctcaaaccagaaaacatcatgctggtggatccatctagacaaccatacagagtcaaggtcatcgactttggttcagccagccacgtctccaaggctgtgtgctccacctacttgcagtccagatattacaggtaagaccgtccacaaggagacaggagctgctgaatgcccagtggcactcacagagaatgtgccaccttagtcactgtggggagataaaattatatgtctacagttcctgccttcaagtgatcttaatgtacttacgaaattaggacatgtgcacattgcgatgtcaattagaag

SEQ ID NO: 5195 - DNA, 1188 bp, Homo sapiens
tcttctgtgaactttgtgatttgttttgccattggtcgcttgtagtaggttcttttttttttcattcttccatattcatgctttctccatctgcactctgtcacgtttcttcatctttgtcatcgtgatgtacgtcttttgacattagttgtctagctaatttaatattgagtcctttgttgaagtgaagcctccttttcattttaaattgtcgctttttttctcgttcttcaggtgagaggtcactatcctcctctccactgctttcttgttcctgaacccgatacttgggctctgagccttcagcagcagctaatttcttagctatctggtgccatggcctcagtggtttctgtatcattacacgcgtctccatcaacacccatcacaccatggtaaggggagtgtttggttcatcagtgttcatgaagccacagtctttgtctgctggatgatatgttgccaggaagttcatttcatcccacttccgggattttttctcagctcttcttctgccgacgcaaccatagagagtcgtagaagtcctgttcttcaggatccccttgatgggccggtgcgaggctgttgaggcggcctttgcccggcgctccggctgtcggctcagggtcgctgcttggcatgggctctgcggagagaaggatcaggcactagccaagcccgccaggcagccgcggagcccgctcaaggctaaagaggccgcacatgctgtatcggaaacggctactggagtgattgtcaacacacaacgaccccgacaccaaagcccacgctgagcgggtggcggctcctcgcgcgcccttcgcggccagcactttacccgtggtccatgctttaaatcagtgaccaagatatgacactatttcacccatagccggattcatggggccaggggtcaggaggtggagaagggaggggtctctttcaccattacctgtaattatgcacctgtgacatttttctttcccatgcctacaactttaggttctgctggcctagaagtcttagttcccaaaagaggaatgcatctatcagggaacatagcaatgtttccatgaaactggaagttcaggccgggggcggtagctcgcgcctgtaatcccagcactttgggaggccaaaacagatggctcacctgaggtcaggagttcgagaccagcctggcccaca

SEQ ID NO: 5196 - DNA, 1180 bp, Homo sapiens
acaatgtcatggtaaaacttgaagaaatgagaagttgcttcttatagatgagcaaagaaagtgattttttgagatggggtttactcctgctgaagatgctgtgaacactgataaaatgacagcaaaagatttagaattttacataaaattagttgatgaagcactggcagatttgagaggactgactccaagtttgaaagtagttctactgtggttcagatgctatcagaccatattgcctggttcagagaaatcttttgtgaaaaaaagtcagtcggcacagcagacttcattgttgtcttgttttaagaaattgccggccgggcacggtagcttacacctgtaatctcagcactttgggagaccaaggcaggcagatcacctgaggtcaggagatcaagaccagcctggacaacatggtgaaaccccatctctactaaaaatacaaaacttagcaagtcgtggtggcacgcacctgtaatcccagctacttgggaggctgaggcaggagaattgcttgaacccaggaggcagaggttgcagtgagccaaaatcacgccactgtactcccaccctgggcgacagagcaagactccatcttaaaaaaaaaaaaaagaaagaaattgccacagtcaccctaacctttagcaaccactgacttgatccggcagcagccatcaacactgaggcaagacccaccaacacaaaaatgatgactccttgaaggcccaggtaattgttagtggtttttaacactattttaaaattaagatatgtgcttttttttttttttttttttagaataatgctattggacattactagactacattatagctacacttttttgttgttaatttaaaaattgtgggccgggctcagtggctcacgtctgtaatcccagcactttgggaggctgaggcaggcagatcacaaggtcaagagatcgaaaccatcctggccaacatggtgaaaccccatctctactaagaatacaaaaattagctgggcgtggtggtgcacgcctgtagtctcagctactcgggaggctgaggcaggagactcttttgaacccgggaggcagaggttgcagtgagcagagatcccgccattgtactccagcctggcaacagagcaaaaccctatctcaaaaataaaataaaataaattatggccaggc

SEQ ID NO: 5197 - DNA, 1180 bp, Homo sapiens
cacttgtgctgtattggtgacgcaaatactcttcagtctgcagttgtaactgccacagtcacagtgcttgttgtatatatgtacaaagtaccatcagtgtgttatttattatagtaatagcctaaatattataaaattgcactaaggtagattatctctgaattacatttattttttatttttatttttgtgacggagttttgctcttattgcccagggtggagtacaatggcgtgctcaccaaaaccttcgcctcccgggttcaagcgattctcctgcctcagcctcccaagtagctgggattacaggcatgtgccaccatgcccggctaattttgtatttttattagagacgggggttttccatgttggtcaggcttgtcttgaactcccgacctcaggtgatctgcccgcctcggcctcccaaagtgctgggattacaggcatgaaccactgtgcccagcctctgaattacatttaagggtagtatagagaatgtacaaaatagttgttgtaaaaaggagaaattgatttctgttttcagtattggaagactgggttattcagatgaaaacaattaaaattcttggaaacagtattaaaaaaaaaaaaaaaaaaagaaaacgtagagcagttgcagagctgaaaagatagtggggagctgccaggccaaattctaggaataaacaagaatccaaataaataagtggatgaagtagcttttgccctaaaggcagttgccaatctgtacaagttgggctttggttttggtggaccattggggtgaagaggacagaaatcaagtcctagagttcatctaaagtgacagtcaaaaagaataacctcagttttagatgggaccccagtgactctatcgttaggttaagggtgaaacaactgaactgtctacacactcccatatccatgtgattgcagggaaggttgaatggagcaggaggaggaaaaggaaattaagaaaaataaacctttcaagttgtgaccacagttttagccttcacagtgatttgccttgagggtttgctctgtctgggtggtccagggaccctccatgataaatgaccctccagccatttatcatggttactggtttcagactagtattacttccatggcctggcagatggaaaggcaaatcacgtgtggagaaaggcctttcattc

SEQ ID NO: 5198 - DNA, 1197 bp, Homo sapiens
tgtaaagattcctgaaaatgtggaagcgacattggaactgggtaacaggtgaaatggcagaagtaggcaagagtgagagggcagaagaaggcccagttcagggagggtgttagcaggatgctgacactgaactctgccctgttggtaattacatgggacccagtgagaaaaggggctcatgtgcctggccaagggtggagttgtctggaaaaatggaaggaggcttccttccacttggagaactttctctgctctaaatgggaagcttatcttctgccattccaatggttgttggtactatttcatcttttccctggagatgcatttcagatagcagaattttgaaaagaaattctgtgtggctatattaaatctaatatgagactttcctttatctaatatcattctaataattcagaggcaagctttagtggagatgattaattcaacatggatatttcttaccttaaggaaacaaaatttaaacttacaagaccaacatcgtagagatgaattctttttaaagaaataaaactcccaaaatgaaatatttttggggccaaaatagttaactattggtaataataaaaataactaatttttttttctgagcagctgctgtattcctggcattttagattgaatgtattcactacctccaatcctctcaaatactctgcaagatgcctattattaactagctagttttatagatgtggaaactcagtctcagagagtaacatggccagtgagcttgcagatcacctttacagcactcatgcactgatttattgaatcttcataccagccttatgcataggtactattatcattatcccactttatagatgagaaaattgaagtgcagagagcttaagtaacttgttcaaagtcacacagctagtgagtggcagaggaaggattcgaactgggcagtctggctccagcatcagtgctcatttccactacaatatgtcctctccgtgtaattgggacaggaccagaaggaaatatattgctaaggaaagaaagcatgacagagtagggagaaccacttagttccaggagctcaaaggaaagaacacaggatggagtgtctgatgttctcatgggagctaagtgggggctctgtgctcaccttcctttaatccccctggacttcttgacatttatcacaatcagcctctccatagcaag

SEQ ID NO: 5199 - DNA, 1216 bp, Homo sapiens
ttagaggccagagaccagcctgggcaacatagtgagaccttgtctctcctccccgcaacaaaaaaagaagaaagaagaagaaatggaacaaggcaggggctagtatggtcccttctgtcctgatagctcatctctgcctgtctgcatttgtctgcttcattctactcattctgcagactgtctttcacttcttttggttcttaggagcagatggtctccttgtagctcctgagtttctgcacccatagagcagcagaccagcagataatccaaatcctaaactcttgggagaaagcatctgtttggttcagtttttgtcatgtgttcaccccaattcaaacagctgtgctggggtgaagtgtgaatggtcacttagaacaaatatggttgcaggaactgattctgaggacagagaaggaggtgtggcttactaacacttaaaagacatttactaccttctgtcttcaatctcatggcttagtgtgtccttataggaactctccactgggccaaactcagtggcctccctgcgaacatttacatcctaattctccaaccactgcccaggtgtgaaatgtacattcctccttcacacacatacacatgtgcacacacacatacacgtgcatgcacacacgcacacacacgtgcatgcacatgtaaacacatgcacacacacgcgcgtgctttaaataatacatcaccttccatagtcagctcaagtcagatttctgtagaataacttttctatcacatcaccccacccacaagatagtcttccttccttgaactctataacacctgcccctttcggcctctcctttgtcacagatgaaatgcctgcagatatgacttatcttctgggtagactgcaagctcttggaaggcaggaggcatagctggtttctgctcagagatgatggctgggaatagtgaccacgtccaccttcaagctgtgtcccttcccaagtgattacactttattccgaaataaagtggttactcactcaagagattcctgccacctacccatcgctggctggctcttccttgatgtcagaattgtgtcaagaagagcagtttccctaattgctttctctaccatttgggaggtaaaattgtcagcaggacaaggcaggaatctatttgatgttctacatgtaatagagtgaggcctccaggagatagcaggattctcgatagtgctgctgttgct

SEQ ID NO: 5200 - DNA, 1261 bp, Homo sapiens
ggatgatggggggtcaagaaagaatctgagcactactcacaatggtatgactagtctactgtgtcttctctgtggattcaagtataaatatattcaccattataatacataggtccctgcccacaaggaaactggcagcatgcggctctttgtagcatcgggctgggaggctctgtgattaggttgcttgagagagaaaattccagttaacgcaaacaaaggaagcaagagtgaggaatataaggaaataccagtaaagaaaacttaggattctaagtgacagcaggtatcttagtaactggttggtgatcacctaatataagataaccacaggtaagatgggtaagacctattttagaaacccataaatttcaggggcaggcaggtagacatactgtcctggtacacatttggaggaaggattatttttctgagcaaagaaaacgatctgttcccctactcatgtgggcttgtattcatgcatatatttacttgttaatccattccttcaataaatgggaattcaaatacttacctggcagggaagataccatgatcacgaaggtggtttttcccagcgtggggctcatcgattgcactccggatgtgctgacccctgtgatattcccaaatgtggaaaactcgactgcataatttgttgtagtgggggactgcattcgcgctttcccctgaaaaacggaaacaaaaaaataggaatttgatggggtggggttggagatgagcagtgttctgaaggcatttttgagtaattattacatatactgtacactgttgaaaatacaaaagaagaaaatgaaaaattgtccttgcttaaaataagcttagaagtccagcttctcttggatatacagtcatccatcttggaaagattagctttgaagcatccctaacctgatttcttagtattaataataacttgtagagactcttggcctttagtcaggtaaatcttcctaataagcctcttaatatttttctgttctagttttgaattccattgtcccagctaataaagaaagtacaaagtactatacttacatatgttattcacaagaatataagtacctcttaaggtgtggtgtatacattctgggaagccagctatggagacacaggtgactatcatcagccagtaccagtgatgggcacctatcatagagatggggcagacagcatcttgaaattgtctagaccaggggtccccagcccctgggccatggaccagtaccagtctgtggcc

SEQ ID NO: 5201 - DNA, 1210 bp, Homo sapiens
ccattttctactttattttacttgctccaatttttctgcttccttcacacatgtgttctcaataagttgacttctgaacctgtgctctcaggtcccagtatacgtgagagcaagaggtcatcatattcatcttcagacttcaggttaggaagaatgtctaagctgccagtctagctcaatctcagaccacagggcagtggccagggcctctggtcctttagccagtcctgccaaagctgccctaagctgccattggaattcacagacctgttatgcttctcttctaggaggcaaggtgtgagaaggtaaagtttactgagcagaaatctgaacaaaggtataaattatgaacaagatgtggatcagcatgttagatgaagactaactactaattacagcctgtaggtacatttggagctttatttccactggcaatgcagaaacacccagcaaaaatgtgagaggagttggtggggcttcctaagaggacaagaagtggaacctggcaggagatccatgggagctcctgggactagagttctgggaagttgaaagaaattctcagaaagagatatgtaatttccagactgggagaggagccctccctgcaattttttttgtggggaggagaagggcatggctcacgtgttgtcctgagctttgttggcccccaactgcaggcagagaaccaggagcagggtggcagggctggccctgaacaggagctggagcaagcgcatgctggagaaaacagaaggcaatgtgtcccagagaagtggtgtcccaggtgcccagcacatttcttatatacagattgatcaaggaagtgcaagagctgccagggagatccatgaggtgaatcacccattcaccctccccactcgtgatctttccttgttgacccaaagtttgtttttctaagaaaaaatcaacactcagctagaatgtcagcgtttgagagaggagtcagattgttcttccttattttttcagcatcagagtttctcaaaatggctgggacctcaaaagatacaccagtttttcccgagtttacagattcagttttcttttccctcctaatttgcctgtctgaagtgctatgtgtagtcttagcttcagtcactgctcccctggtctctgaaagcagagaacacagctgtggtggcaggtttcagaccagagacatagaacatctttgcttgatcaaatt

SEQ ID NO: 5202 - DNA, 1201 bp, Homo sapiens
aatggttttaccttctatccagtctttataactgaagcttctttctcttttctacctactttatttatttattttttggttgggcgggggaggggagtggggaggctttctgataaaaaccagaaagcctgctagacaaattctaaaagagctgtaactgtcttttctacctactttagcttgtagtttcagtacagtttaaaaattagtagtgctggtagatagagataaatgttctgtctcttctggatgagttttagaaaattattctttacatccaggttttgagatttatttgtatgaagtttatgtgttctctaatgttcgttttatttttgttaatattcttgttctctatatatttcattgtcacttttttgttaagaagtggtttttgtattttaaattatgtatttttttcttcagagaaccagctacaatgttagtttaactcataaacagaaaaacagttgtattagggttccttaacaaacgtaatccagcaccagattagtattggtgttaggctgtctggagcctaattgctcacacgcttccaacagaatctgagccttgaatttttcttctttaaaaacacaactttgtccttttttttttttttccttccttttctcagtctttaaatatggctttttacaaatatttaaaagatgatttgttttgtggaaatgtcacttgtttttctccaaattaattttcatcttgtataattctgaatagtccatttccagcatttcccttttgtatatgaggaagtaagtttttgcaagaaattctgtgaagttagcactgctgtcaatgttcacactcttttcatgtagcagtgtacccgcatttgaatctttctgttacattattttggaattttaggtttcaaacagtgtatctttctaaaatccgtttttttgacattgtaattttctgtggcaagacactataagctctcaccaggttcttggattgggtatgattcacaggaattgaatgttagtaatctggggctgtcctctttatcattaaaaatgagtttttacaactggtgacaagctgattgctgacctttctttagaaatcaagaaattgtatgtcagaattaaaaataggaaatctgatttaattgtagagggtctatcaactgcttagacagagatagtaagattcaatttaagtaaatgtttat

SEQ ID NO: 5203 - DNA, 1267 bp, Homo sapiens
gctcctgatgatgaaacaaagccgacaggtggtacctgcaaatccccggagagggacaggccggccggcgccctctccctccccagagcccagcatctgagccctcggcgtccgcaaagtccagacgctgccactcagccctgaaactgacacgaaacggacaagacaagctgccgcgcttcagccacaggcacgcgagtgacgggatttcctggatcattgacccgcggcccagccctggtccggcaggtcgcgggctctcagctccggcgaagctgtccacccagactaaagcgcaattgcccggagcccgcgtggctgcgaaccacgcgccgggtttactttcatatttagctaggcgctacccacaatgcatttgtaaaagtgaaatgcagaaaaaccttggttgattaacataattcttacaaactctcttaagagagagcatttggttttgttttcattgtgtttaatcaaaaagttttacacattttatttttacgatcatggcataggctctgaaaagtctccttacctagaaaagaccctaagtaggcactataaataacaagagactcacaggataacacagttggtccgagtgttgtgggttattgttaagttgatttaacattgtctccccccacaaccgcgcttgactagcttgctgttttgcactaataacagtagtagacaacgtttacataaatcaataaaaacgcatataaaagtaacctttagttgacggtttgaacgaaagagtagcttttagttgatttgaaaaactttcaaggaagcctattggttataagcttcttttagtaagattaacttcccagcagcgttgaagtattaaccttcaaaatgcctgagaagaaaatttacacgaaaggaataattttgttttaattacctttgaatgtattaaatattgtattcggtttttaataaaccttataatcaaggttacttttctatatatgtgaaaatatatatatatatatacacgcatacatacacatatacacacacatacatatatgtatgtatactttcccccccaccaccccgagacagagtcttgctttgtcgccaggctggagtgcaatggcgcggtttcggctcactgaaacctccacctcctggtggctcacgcctgtaatcccagtactttgggagggcgaggtgggagtgggaggggatcgcttgagttcaggagtttgagaccagcttgggcagcatggcgaaacccctgtctcaaaaatga

SEQ ID NO: 5204 - DNA, 1279 bp, Homo sapiens
ctggtgtttcagatgcttccccttcacgttccttaggtggtggtttctgttctatcagttggggtttaaggaggaggcagggatcttgggcagtgggagaagcacctctgtagggagctgactgccaagatgggaaagtgtcagcctccaggtagtggcgcttgctgggatttaccgacgctggaagcacagactttatctgtagggctcacagtttcctccaggtcccacagagctgtccggagggtcacacagcaaacagataaaggaggccagcgcagattgggcggctctctggtaccttgcggtggctgagccactcaagacaaaccgggggaaagacgccctgatgacgaaatgctaattttgcatatctctttcccaggatgcttagcaacacgtctgattcttgttattcagtacgtttttccagctattgataaatagatgtgccagggaattcttagagtatatatatatcattaatattgtaaatatagtcatcagtaaactgaaaccagaatatcactgtaaggggaaaatgaacaaatttgggggctttaaatagttcaaacagtaggaggacttattggctggtccgaaggtagtgagttatctcaattgattgttcacagtcagttacagatcgaactccttgttctactctttccccccttctcactactgcacttgactagtcttttacgagagtttccactctcctggcatccctcgtttcttgttttcatctcaattttaaaatgttgaaagtcagcatcattaaataaagcatggaatacagggggaaaacgaagtactattcttttcttccagaaacaaacagtaaatttgggaaaacccatcacagacaagaaggaaaaagaaaacaaaaatcaaataaatagtaatagatactacggaccaattattggtaaagatggtatagtatgtcctaagagatcaaagacaggaaatgggatgagggtgaataggggtttttctttttcttgtactttttcttttcttttctttctttttttttttttttttttttttttttgagacaggctggagtctctgtcacccaggctggagtgcagtggtgtgatctcggctcactgcaacctccgcctcgtgggtccaagcgattatcttgccttagcctcctgagtagctgggactataggcgcgcgccaccacgcctggctaatttttctatttttgtaaagaccgaagtttcgccatgttggccaggctggtcttgaactcctaacctcaa

SEQ ID NO: 5205 - DNA, 1134 bp, Homo sapiens
gtgctgggattaccatacctggcttttatttttaaagcagttttgatctaaggttggtcgaatttatggatgtggaacctgtgaatacaaaggctgactgtagttgtgttttttgattgcagtggtggttacatgagtgagcatatgcgatgaaataacagaattatatgtacacattgcaccaatgtcagtttacttgttttgatattgtactataatatacaatatgaccttttgggtaaagtgggtgaagggtacatggaacctttttaaaaataatttttgggccaggcgtagtggctcgtgccttaatccaggcgtgccaccacacccagctaatttttgtatttttagtagagatgaggttttaccacgttggccaggttggtctctcgaaccaggcatggtggcacaccccgtaatcccagctacttgggaggctggggcaggagaatcacttgaacctgggagtcagactttgcagtgagccgagattgagccactgcactccagcctgggtgtcagagagagactccatctcaaaaaaaaaaaaaaaaaatctaggctggtttcaaactcctgaacttaagcagtcctcccgcctcagcctcccaagtagctgggactataggcacacttacatggaagccttctgtgctgtttttacaacatcttgtgaatgtataattatttcaaagtaaaacatttttcaaaaactgacacatccagcaatactagacccagtcttccacagcagtaactggttgctgctaagtaaagcatccctttttagatggtctttgtgctcaaaggcctgctattcattcattcattttagtttatttttattatttttgagacagaggctcactctgtagcccaggctggagtgcagtggcaggatctcaactcactgcaacctctgccttccgggttcaaacgattctcctgcctcagcttcctgagtaactgggactacaggaatgtgccatcacgcccagctaattttttaatttttagtagagatgaggttttgccatgttggccaggctggtctctcaaactcctgacctcaggtgatccacccactttggcctcccaaagtgctgggattacaggcgtgagcgactgggc

SEQ ID NO: 5206 - DNA, 1179 bp, Homo sapiens
ctttgggggccagcagggctgtacctgggagttgggttggggcggagcggaggggaggccgtgccaggcagggccggttcgtgcggaaccgccatggccgagccggcttcggtaagaagggccggtggaggatgcaggctctgtcgaaactcgggtccctgtcgcagctggattggggtccgcgtccagggagtggggcggccggggcctgggcctgggggttggcagtggcccacggactgagctccgggctgggctggagaaggtgcagtcttgctgcgtgtgctgttctggaattgacctggggaaaagctggtctggccgggcttggccgcgcgcgtctgtggccccggccactcggaaggctgaggcgggagcagcgcttgagcccgggagctctgcgctgtatatgcgctaggtccgtcgcgcggtgcctctgagttctgcatctgtgtggtgacctctcgggagcggggaccaccaggttccccagggagggggaaccggcccagctcggaaaccgagcagggcaaaaccccagtgctgatcgttagtgggatcgcgcctgtgaatagccactgccctccagcctgggcaacagccagaccccgtctgtttaatacataaataaaagttggtttgggagaaagaatccgggtgggaaagatctgtttctcggcctgttgtaggctcagatcaacaacgctgtccctgccttcagtgtcggggctctgaacctcggggtctctctggggcccgtgctctcctgctgaaggtagtttcagagaagcacatcagtgttaagcagatgagaaaaaggagaaggaaagctggaactgagagaaattggagaccgctccctctaggaaaggacagaaaacttaaaatgaattgggtggttagcgtaaatcgaatttaccgtaaatgctgtagtattgtaatgtagtattgaaaatttgagcaccggttttagagtttgaaaggcgtatcctgaggcttaatccaagaaaccctgttacattcagttaagtataacttgcttaagtgtgcaagtttttcttgtgcccccaatgaaattttataatcttaggaatgtaatgctccttatttgcatttgattcttcccttttgcttcccactccttttccccaccctcctttggcaggtacagattctttt

SEQ ID NO: 5207 - DNA, 1169 bp, Homo sapiens
atctgagcttcgagtgatctgttagagctgggtaggaatgcatgagagttgctagtgagacagttattgatgggtataactctggagtcttttctttcagatgaagagcttgtcatcaaagctgaaggccttgctagatcctcgttgtgccctgaggttccagtccctttctcttctccaccagcagcagcaaaggatgctttttcagatgtggctttcaaaagccagcagtctacatccatgacaccttttggacgtccagccactgacctgcctgaagcctctgagggacaagtgacttttactcagttgggtagctatcccctcccacctccagttggcgagcaggtgttctcatgccaccactgtggcaagaatctcagccaagacatgttgctgacccaccaatgtagccatgctactgagcaccccttaccctgtgcccagtgccctaagcactttactccacaggcggacctcagcagcacctcccaggaccatgccagcgagacaccccccacctgcccacactgtgccaggacttttactcacccatcaagacttacctaccatcttcgggtccataacagcactgagcgtcctttcccctgtcctgattgccccaagcgctttgctgaccaggctcgactcaccagccaccggagagctcatgcaagcgaaaggcccttccgctgtgcccagtgcggcaggagcttcagcttgaaaatcagcctcctgctccaccagcggggtcatgcacaagagcgccctttctcctgccctcagtgtggcattgacttcaacggccactcggccctgatccgccaccagatgatccacacaggcgagcgtccttacccctgcactgactgcagtaagagcttcatgcgcaaggagcacctgctgaaccaccggcggctgcacacaggcgagcggcccttcagttgtcctcactgtggcaagagcttcatccgcaagcaccacctaatgaaacaccagcgcatccacaccggggagcggccctacccctgctcctactgtggcaggagcttccgctacaaacagacactcaaggaccacctccgttcaggccacaatggaggctgtgggggtgatagtgacccatcaggtcagccacccaacccaccaggtcccctcataactgggct

SEQ ID NO: 5208 - DNA, 1158 bp, Homo sapiens
tcgggacattgacagtttagctctacagatgcatttttaagaatcttctaggcgtcaaggacagtgctgaacactagaggacagaaagatggctgagaacagatactattgggctggaaaagagggttacaacccgtgcgcgtccccagcttcctagcctgggtgggaggttctgggtgggtgggtttcgttgtatttacaccatgtgtggaggcttccctcacttccacagcatcattcaatgagagtaaagaggggctggaaatacgctggttgctggtaagaccctgtaacactctctagctgcaccgtatgatgttcagcagcatccgtggcctctacccaccagtagacaagatgagtagacacaaactccactgtccatcctgagcctgttggcagggatctgtgtggcgtttatccctgtcccctttgtctgagaagccaggactcccagctcatcccttgccacatttggcctgacccatccccttgtgagacctcacctccccttctcctcacctcctgcacatccctccactgagccttgtgggactcagggctcagcagacccgccaggtcctgagtgttccctgctcggactgagctccaggggactgcagccctctgagtgcttgtcatcctcttccctgcctctgtcttgagcccaggcccactgggacagggtcctcacccctcagattgtgcctctgccagcctcaatccctctctagagaccttgcctttgggtcccaggccttgtctttttgctacttctgcagaccttccctctcttctcaacactcttcctgccctcagtcttggccatggcagcctccttgttgattgtcctgtgcccccccaacccatcccacagccatccgtgactgtgacgacagtgactttaccatacccaccatctccatctccagcacaccactccctggccgcctcctgccgtcccttcaattccgtctggtgtcctgattccagcagttttccagtccttcaagacctgcaagccatcgaccctgctgccttttcactgccctgactcatcctcatttccctccatgcccaccattgtggtccccccttacacacaccctcagcactcttgcccctgttttgttcattgtatccacttagtgaaatcca

SEQ ID NO: 5209 - DNA, 1170 bp, Homo sapiens
ctgttcctgtgttagtggctaaggctaatgcccttacaggtccatccatgttgctccaaaggaaatgatctcattcttttttatggctgcgtagtattccacagtgaatatgtgccacatttttaaaagactaagtattattttttgagtatttttttttaacaaaagcaatttgcttttcccttgacaaattatcatgaacagtattctacgtcaaatacaagtctccagacacaggctctggtttcctttcagtgctggagaaggtggtgtcacctagttagagttccatccccagcctagcacacctcacatgatgctcaacaattgctactgtctaagagaattatctggatgacttgaagggtctctccatttataaagctcaacaaggctaccagggtgtccttaaccaggtacacacaaaagtgatggagaaagaagtatcagtgacaggagggaggccagaattcagagaaacaaccggcgtagacatccaagccggaagagctcggtcttgctcttgctgtgctgacacatgaaaagggtgttaattacactgtctacctatgactgggggtatagctcaggggtagagcatttgactgcagatcaagaggtctctggttcaaatccaggtgccccctacactgttctactttttaatcaccaaagtgggtcctgggtcataagctccacccaatccaccctgcaaaaaaaatgacacagcctatctaatctctgacccacagcatctctgaagtgcagactcaatagccctcaggtgatttcatgggttttaaagtttgtaaggcacatctgtctcctgcagccctctggataccactccaggacttttgcagagttctccagaatctccccaggcacatccatgtgattcccaagagagggctgggccatgtctctaagtcctgctgtattctccacagcacccagcttccactgtggcacaggagaacctgaaccagccacagtttcatgcccgcctccaacaggtatgagaaatctaatgagcttagatttctaagtgtgctgcaccctggactttggctctgggccctcaggttctggatttcccatctggggctgctgcagactcacaccctggcctacccagaccaaggactggggaaaagcaggattctggga

SEQ ID NO: 5210 - DNA, 1267 bp, Homo sapiens
agtgccccttgctagctgctactcctccatccgggatcatagaaggaacacacatggagcagatctaagcccagctcagacagaaaccaagcacagatggacccacagcttgaagcggatacacgaggtcgagcccagcctgcatcagctgattggcatccatgctgctgacctatgagcatgagaatacatgcttattgtttcaagcagccaattttgggatgatttattatgacacattgttgtgaaaatagccttgatacttagacctgcctctcccccaacccctactcccatcaggtactgagtaagggaacgggaggagacctcagttgaaggagttcaggttgtggctacaaggtagaaagatgccattagacaagtgacaggaggttatttggggagtgaaggagtgaactcatggcctgaagagcagtctctagtcatttgtggtagggctgccaatttccataagctggccaggaattaatacaatttacagtgcactatagaatccttgggtgtggtgacacaggtgaaatatgctaaggaggaatgtccaccaggcaagggggtatagctcacaggtagagcatttgactgcagatcaagaggtccccggttcaaatctgggtgccccctgatgccacttagctgtgggttctctttttctgatgttaggcttgcttgtcatcctcaccactgtccttcctatagcttgtgtcagttttctcagatgacttcatttttctggcacaagtcatggtcaagtcactaataatctgcatgtgtttcagaagttctaatgagctgctcttctttgaagtttatattatggcaggacagcctgaatcagaggtcacccagtctgactttgcatcagaattactgatagatcttataaaaaatacagattactccctagaagttccaatttagtaggactgaggaggaatcagagaacttctacttttgggggtcatttggggcataatcccctgttaatacctgttctaacatccaataattctaagtggctggaaaattgttttggaacttacaacaacttgtcattctaaacaacatcccagtgggaagcatcagtgatgttcaagctagtgcctgccttcagtccatcactgagggcatgtggggtgctgagctgcaggcataggcagtggccaggtgtgtagaggtgggagagtgtgggaaggtgggggatgtctgaatgaagctgtgggcatggtaggagggtgaccaattgcaa

SEQ ID NO: 5211 - DNA, 1207 bp, Homo sapiens
aaataaaaacaaaacaaaaaaattcttagtaattgtgaccatcctggattgaatctgagaatattaatttttttaaactatgtataacagtgcatgtattagatttgaggtcgtggaatttgagttatggttagagtttttttctaaaactttttttcctactaaaatacggtagtgttgtatcattttattttactctattttattttgtttatgtgaagattttacttaactatacaactttttaaaataagaatattttcctaataaaaagaaagcaatttttaaaaaagtataaacccacaggacaaaaagcagatgggcgagcgataactgatttcacacagaagaaagaaaaggcggcgactgcaagagcctgcggaggaatcatcctaccggggggaaacagcccctaggggaaatgagggcagaaggcgtgggtgtgagggatgcagccagcagatcctcgcgggctcagtgggaatgaacaaggatctctgtacactgtaggacacccgagcattgcaacaccatgaaataatgccagctggaaaactttgtggcccatggggatatagctcaggggtagagcatttgactgcagatcaagaggtccccggttcaaatccgggtgcccccccgctggttttctttctgcttcagaatactctatgaactcgactattctgaggccactcaagtcaccatcagaccgcgtattaggtgagtttttcaggtggctaatttcacccaagtggcttgtggactggtaggggaagaggaaggaaaaggagcgaaggaggctccaaggtaatctggctcaggaagtggctgtgggaggctttcatcatgacccagggtggccatttgtgctttgggagctctcgtttactgtttatctttccaagggagaagcataggcaggaagtcgggggagcaggctgaatgactgcaccagactgcactgacggcaccagaaccacctgggcgctgctcctgcacagtgtacctggacctcagcgcgaggctccgatgtgtaggtctgaggagagcactggatattttgttttaaaaacaacgcgtacctccagtcttcctcctgcctcctcccacccagcacacactagatgattctgacagggacatttcggggaaaactatgctggatggttctaaaggacatttcacgcaaactggcctgattatc

SEQ ID NO: 5212 - DNA, 1363 bp, Homo sapiens
ggcgccttctgggaagtgtagtccgcgtctgcgccggccggccgggccgccgaagccgggggctccgggcggaaacggcaccacccaccaagggatgcgaggcgctcggggcgggctcaacgaggccgggggcgggcccgggcgcgcccacccccgcccctccccctcggcccaggcccccggccccgccttctcctgcgcggacctgggccgccgccgacgagggtcgcgtgcgcccgcgccagggcccgcgccggaaaccgaggagtggcggggaggctgagcccggggatggcgcgccaggtaaggcaggcggacgcgcggacccctcggcgcagtgcggccccgaaggcggtagggcgagaaagagctgggacccccccgcaacttcgggatcggctgggtgaggctgggcaggcctgatgctcaggggttcgtgccgggaagttcaggtcctcggacaacctctctccagctctccgccgccggtacccacggcccagtctccacctggggaaacccccttggcgtggcttgtttcgttacaagttatcctggtagagtgggcatgaaggcctcggaggcagtgagtaaatctcatacttctgttcttggtggaatcctggatcccgggggctggggacgtggaaatggggagaaacaaagatagaacaaaccccaagttttgtcttgggaagcctgcaggtaaggcgtttagatctgagaactggagggagagccccaggccgtgacagcctgggcaccgtttgggctaggttgtgtgtgggctgtgacgatgctgggaaactctggtgctgatatcagtgaggtatcaggtatctggtgctgataccagcaactgctccacgttcttctggatgggcacctggagccagttctgcaaccgtggtggctcctgagctttggccagtccgaggcagccatggatggggggcagcgtgtgactaggcagagcaaacactgtgccaggcccttggcgtcattagtgcccccaagcatttggggagaagggagaggctaggcaaattggatgttgttgggcagggacagtcaagtgtccttttcaggtctggctgcacagttaagtagcctagggacaccctggttcagacatgcccatggccccatcctaaggcctcctcataccacagtttcctgttctgtaaagtgaggagtttgggccattgacctttcagatctgatgaggggaatatcctcacactacgtagcttcatggagaaggtggccaggagtgaccttggggagtggtaggtcactgtaaggtggagaggagcagggagggttcccagaagcccagggcaatgtgagcacagcctccagg

SEQ ID NO: 5213 - DNA, 1793 bp, Homo sapiens
gtgggcgaggggtgtgggtggggaagaggggaaagacaaggctttcccacacccagggcaggcctcggtcatattattttggatgcggccaacccagcagatggcagggcctgtgttcccagggtgacgaagggcccagggagccatccacactccggcaggcacatggggttggtatggcacttctgggtttggttttgatttcatttggttagagttcttgttgggattcaggcatctatttatttcatgaaaagaaaaggtggggaggggactgaacatcaactcccttcctgcctggcctgtgttggccgccagggatgaaatgggaaccatgctcccagcacccccctcccccatcctcacagcgcttcaccccaaggcaagaccctaacctgggccctaacctggacggagggagggaaagggtaagctgaggactatctgggcaggggtgagggggctttccagggagggttgggggcagtggagtctccactgcaaggccgggacccttccatgtgatgtgcttttcaggtgcccagctctcggaatgactgtggctccactgtccctgacaaccccttcgtccggaccctcccccacacaactatgtctggtcaccagctccctcctgctggcacccagagacccggacccgcagggcctgcctggttcctggaagtcttcccagtcttcccagccagcccgggccctggggagccctgggcacagcagcggccgaggggatgtcctgctccaatacccgcactgctctggagtttgccctctttcccaaggagatgctgctggggagctggtatgggtggggtctttccctttacagacggggcagatgccaggactcagcccatcctgaggaggacacgtgtcctcatggagagggtgctccggcccaggcgggggagtcagtgcccagtcagcagctctgccaccatcctgctgggaactgggggggcctctattgggttataggcaaggccttttctctggcatggaattgttaattttctgacacgtctagatgtgaaatttctgaaaatgttgaagcagagaaacattcacacacaaaaagcaacatagtcatgtgggtccagatggcctcagtcctagatgttggcaccctttgctgtgtctcctcagagtatcctgttccgcctcctgccacctggacctccctcagtggatgtcttccctcccccgaccccagcctgtcagtccgagcacagtgcaggtttggctctgacttgggcttttggctgcagtgggggtggatttcagagcctctcatggcagcatctaagtgaccagagctgggatgagagaggggaaggggcaatgtgagtggcgctatgggacgggccagccctgctcctgagccagccccgccctctgccccctggccctgggctctgtgctagggatggtgaagaatgggggcgtgccagcctggcaggagtgggaagcaacacgcaggggtcccggacctctccagccttgccctcacgcttacccgagctcccagtgtggttagcacagagctcacccaccttgcctggctcccagctggggcctgtcctcactggtgctccaggggaagaaacgacagcctcacttctgtatggactgctgatgtggcctgccatcctgttcagcgggcattgtctttggagcagcaggagaataggatgcctctcactcacatgccagttcctggctggccagctgctcagggctcaggctggggcctcccattgacatcctccccctac

SEQ ID NO: 5214 - DNA, 1173 bp, Homo sapiens
ctgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaactggtggctggggagtgttactttttctgggggagctgcgacatgtcaggaggagcagcatgctctcctccctagaaggacggggggctgtgggtggggctctggccacaggccacatgcccagcttgctgagctctggccccctgcctcagttcttccctgagcatacccaggcagttgggctaattctctgggtggtgggccgaagctccagagaactgtggtgggtggaatgctctcagcttggtcccaagatttatgttcttggtcacttgccctcctagatgggcccagcaacacctaatctttctcaccacctgggccttt

SEQ ID NO: 5215 - DNA, 1099 bp, Homo sapiens
gctctccaccattccacagcctgcattccctaccccgatgccctctgctgaaagtcctgggccatccacaggtggcatggtcaaggcagcagccactgcactttacctctgccaatgaccgtcatctctccaaggcctgccctggctgcagctggtattccagtgacagcctggttgcatttcagagacccttcccttcagggctgtgagaaggcggcagcgttcccatgtgggaaaaaggaggaggagggctgtgtccttcttactgtctctgagcagccccgcccgacaccgacggagtggggcttgcgcagctcacttctgcagtggtccctgtcccgaggggcaggttgtggaggggcagtggtccaagcacctcttgtacaggttagggttcaagggaggcagccgggtaggccacacgctctagtgagggcagttgcggtgcagaccacctggttgtgccgtgcatgcttcccgagtcctggaggagctgccctactgtttcttctccattctgtgatctctgtctttttctctttctttcccttctctgttccacatccacaccttactctgattgggagtcatagctctgttctctctgccccagctgtcccggaatccctttccctgccatgggcatgctagaaacatgctgcagtgccctgggccacctccggctcccgcctcctggcctcctgcactctaaacatacatacctgaatgtgagagtttgtccggggtgaccctctacctccttccagaccacctgcaggtcaggactccagtctgttcactgccaggccctgcagctgattcccacctaccagcctgtgcctctgacttagctccctggttggccagaagcactcctgccggggccccaggacgagggtttgctgccctagtggggcagccctggcaaggtgacagtagatcctgctggcctccaggccaggtgaatgttccccccatatcatctgtaggggctagtggcccctctgctgcccatgagccccggccaggcccccattagcacagggattcccggcacccgcctggtgcccgtcccgcccctgacccggagctgccctca

SEQ ID NO: 5216 - DNA, 1376 bp, Homo sapiens
aagaaggctgagagtgaagcctctgaatagatctaggccctgccagggagctgacaataggagtgacacagcagttcctggcttggaaggctccaaacctgatgatggtacccttgggttagaacatcccaaataacttagaagtagtgagacagtgagttggatatgggtttggggggcggagttttcttcctagacgcccctcaggacagtctgctgggcagaggcagggacagtgactagcccaggattaagtccaggttttgctttctaggttgcacaggaaatttgggtctgtgagaagcagacaatcaccaagtggcctggagacatcctggcttacaaggagcacctcaagtccaagctggtggatgaggagccccagctcaccaagaggacccacaacgtgtgagccctctacctgggttcgggtcaggagctccatctgggaactaacagctgctaacctgaccagccgctcaggacaggaccctggggctacactcctgcattgctgcaatactgctcccccagcctctcccctgcccctcaacctgccttagctgcactctcttacctacagctggacagtacctgtctgtttcctgtcctccttccagttacatctgtccatgtctggactcggctggccgttccctccagccccttgctggttatcttactctgagtgtgatgcagtcagaggcacctgcgggttagcccaggggcccaagccctggatttggcctgcggaggagcttaggatcctcgttttctgggttttggtgatgttggaggagtaccccccagcccaccgccccgattcctttttgcttctggtttggagctccggaccaggaccttcgtcctggtcagtttttaaataattatttagcagtgtaacttttagacctgcgtgacatctacaaagcgcccaataaagaaagaggaagccacggtccctaccttccttctcgggtctctggggccttctcctccctgcagtgccaacatgcactgcccacagcaggagctggatccagcgtcagtgtgtcgatgggaactgaagactagtccataggagctggaagaactttgtccctttacttctgatttgaaattgtaccttttctcaggcctgtgattcacagactttaacatgaatcagaatcacctggagggctcatgcaatcagattgccagatctcgcctcagcgtttctggttcaataggttttgggggagaccaagaacgttaacatttctagcaagtttccaggtgatgctgttgttgctggtctagagactattttgagaaccactgtccaggagcgtggttttctgattgtgatctgaggttctgccccaactgcacag

SEQ ID NO: 5217 - DNA, 1169 bp, Homo sapiens
cagtggtgtgatcatggctcactgcagcctccaactcctgggctcaggcgatcctgctttagcctcctgagtaactgggactacaagcgtaagccacaatgccccctagcttttgtttgttttgtttttattttagtagagatgaggtctcactatatttcctaggctggtctcaaattcctgggctcaagcaatcctcccacttcagcctcccaaagtgttgggaggcatgagccatcgagcctggccaggaaatactctctatattgatatttacaacaatgtttctgataaatatcaggcagcaggaaggtttatttaaaattggaaattaagtacagagtcacattctccaggtaggggtaatatccttataggaaataaagagctccttaagcacacaggccccacaggtgagtttgggtatgaggagggaccagtcctggtctttccccacaggtcctgaacccatggaaaaacaggcacaggcatcagttaacttaagtgcaaggaaattcaagctgaagagaggcttgaacctgaggcccaagtgtagaaggcaggtcctactccctaacctgggtttgcttacctgggcatgggaacagaaggagatgatctgtgtcctaaaacagactcgtctagaagaggaatgctggccacagggtaagcagccttgccttcagcaccttcaccccacccgcctgggaaagggattgtgcggctggtgcaggccctcaccacctcatcagacaaagcctcctcccacagggaggaagggtggggagagggccagggtcattccagtatctcctctcctgggaatacagtacatgtttccttgtgaacacatgaagacaagggagtagggcccctctgcagtggggtggatgggccacattgctaaacagtgatattgaggctcaggtccagacctgaagtgaccaagtccaccccctttcttacctctccattggaacaactgccacatccttttatttgattttatttcctagataagtgtcaattccatctgcttctgatttcccacgtcactgccctggtccacacactgtgatcttctgcccccatctgagtgccgcatactcagccttgtccctgcatcagaccccggcccagcacagtaacgagaatgggcttcctaaaca

SEQ ID NO: 5218 - DNA, 1218 bp, Homo sapiens
gcggccgggcggagggcgtgggaggcgcggggcgggggccgtcggccgccgaggagtccgggtctcgtctggggaagtgaggcggcgccggggagccgcgctagaggctgccgcgagggagtcacacctgcctccccgccttcgccgcgggcgcgcgtgaccggggctggcggtctcccccaccccgcccccgatgtaaggaaaagaaagtccgtgggattttaacaaaggaagcagcgcctcggcttcattccatctgtggtgaagtttacccttgtaaagaaaactagggatttagaggacgtttgggcactgaacgcaagttttctgcataggaaacctaggcgatcccccaaaagaggtccctctggaggccctcgagatgctgctggcggcctgggtaggaagacagagaaaaaggaatgtctgatctctcggtgccctatttttgttcgggaaggaataaggtcaggtacttgcaaccaggctgttgaagtaattccaaagtctttttgttttctttttcttcccccaaaaggttgacatacatttgaaacagttcctagcagtcgccttattgctgaataaggtggcttagggtcgggttggggggcggacggggtgttacagaacgagcggttttctggcctgtgtgaaaccagagcgattgaacttagacacgcttcagggtgaggctgtattgtctcccgacatccggaagcctggagaaattagttcatcttttcgggctgttttgaagtaactgtctatagaaggcgtgcaccgggccacagttgaggggatggggaggtgaaagcgagggttccgaggctcccgtgattgcggaacggggtgactatctgtcatgggaagcttgtacctgcctgccgctcactggatgcactccccaactgcgctttccaccgcctgtgccagggtctgtgctctttgaccaagatcagccactgcatgcttactcatccttttaccacctctccgtcgagagccggggggaaattaagggctgaaagaagcttggctagagatgcggggtgcctagagtcgtaggggaactcttgtgcgatgcggtgctgaatccgaggggatgcataggtggcagctttaacagctgcagccaggaagtaaccatgaatcaaatggaggggttcaaagtcactaattgttcaaatatcaacatggaacctgggatccagcctt

SEQ ID NO: 5219 - DNA, 1173 bp, Homo sapiens
cttatacccttgagagaggggagaataaacagaggagtgaatgtgaacttcagaattcctagcttcatagtctaaatagaaatcctctaagatcataaaatgtccctaagaactcatgccttacattaatttttttggtattttttctattgattctaagcatggaaatgtagatggagattttgttgatgtattttcaaattatgtatcaataatagggaagcttacttgatttctttaaaatctggtcactatatctataaatatagtggacattaaatgtacagcataaggtaattatgtggactttaaaaaggcgttaaaatatgtgccattttctattattctgctcagtaggcttctaaaagcgtgtatgaacatgcccaacccagtattgggcctccgtaggtgctcaataaatgttagttgattgcctcttttctgcttctaggtacataagcaccatattaatttatatagtatatttgattatgttaggttaatgcataaatcacatggattggttgtttcttttacagatcactaaagtggttcttagcaaaggttggaggtgtcttgagtgcactgtgtgtgaggcctgtgggaaggcaactgacccaggaagactcctgctgtgtgatgactgtgacataagttatcacacctactgcctagaccctccattgcagacagttcccaaaggaggctggaagtgcaaatggtactctagggtttgtttgccttgttagtctttcaagttcagagctttctcataccactttggtttttaaaaattagccacacctatttaattgaataatacacatattctatgatagataccagtaatcagaaaaattttcacatacacattaaatcatttcccccattatgttcgtatgtagcttcctgaattacagtaactgagtaactaagaaaataaaattgagacttttcggggggatttggatttcaggtgtgtttggtgcagacactgtggagcaacatctgcaggtctaagatgtgaatggcagaacaattacacacagtgcgctccttgtgcaagcttatcttcctgtccagtctgctatcgaaactatagagaagaagatcttattctgcaatgtagacaatgtgataggtattgtgctattttttcatctttttaaagct

SEQ ID NO: 5220 - DNA, 1205 bp, Homo sapiens
ggcaaatttttgtatttttagtagagacggggcttctccatgttggccaggctggtctttaactcctgacctcaactgatccacttgcctcggcctctcaaagtgctgggattacaggtgtgagccactgcacctggccggtatgactttaatacttgaaagttaatgggctggacgtggtggctcacacctgtaatcccagcacttcgggaggctgaggcgggctgatcacctgagggcgggaggccgagaccagtctggccaacatggtgaaaccccgtctctactaaaaatacaaaaattcgtggtggcgtatgcctgttatcccggctacttgggaggctgaggcagggagaattgcttgaaccccggaggcggaggttgcagtgagccgagatggtgccattgcactccagcctgggtgacagagtgaaaaaaaaaaaaaaaaagttaatgaatagtttctacattattatgatcatgtaatatttttcacagcagaggcaagtagtatgtaattacatttctttgtattgtttcttggtttttgaatctgtaactgcatttttcttgtcatattttcacgattcattttatcaatctttttctgtggtttgtcattattacttattttatgcatatcaagtccctcccaccctcccctgctttcccttagtcctatttccttcagtttgggctagaagtatttagacctgttgccttgtttttgtgctgaacttttccttactctttttgcacagtgctactactgttattagagctttatcatttcttgagttactaacttgttttaatgcagtacacccacataaatagctaagaaagaatatgtgagaaataaagttttgaatccttgcttatctgtaaaagtcctcattagcccttacagttgactggtattattttattcaagtgcaattaagctgaaaattgttttccctcagagttttgaagggattgctccagtgtcttctatgtccattgttgttggtgaggaaaagtcggatactgtgtgattcttcttcctttgtgggtgatgtgtttcatattttcatccatccctttagagccttcttttatcctcattaaactgaaatttctcaaagatgtccagatgtgttttcttctccattacaataagcaaaatactttatgtgcttcacttcttgaaagttttcatgtta

SEQ ID NO: 5221 - DNA, 1132 bp, Homo sapiens
ttctctttccttttttttttcctttctacacatagggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctctta

SEQ ID NO: 5222 - DNA, 1104 bp, Homo sapiens
aaataagaacaaaaatccagagtgaaagtgtctcaggttgcgccgagtggcctggaaatttccgagcccgcgcggaggccgaggcggcgagggcggcggacggccggggagcgcgggcggcccagcccggcccggccgggccctggcctcgcgtctctcacccatgcgactcgggccgcggagctctgcggggctcggcgggggcgcggccgcacgccggtggggcgccccggcccgcagcggggcggcggccgcgaggagggggcctccatgtgcgtgcgggcggtggcgggcgcgctgaccgcgggcgcccggcaccctcgagggccggctagggcgtgcgggcggggacggccgggcggcggcggcggccggagccggcccgggcgggcgtgagcgccggggaacgcgctgcctgcatgcgcgcagctctcgccccgggcggcccaggcggcggcgccggagcccgaggcggccggacgcggagaggagcggggagcccgggaggcggcccgcgtccccgccggaccactgcgactgtctagaccccggctgcgcggcgaagtcgaggacttggctctgttgaatctctcatcgtctgggcgagcggggcggctcgtggtgtttctaacccagttcgtggattcaaaggtggctccgcgccgagcgcggccggcgacttgtaggacctcagccctggccgcggccgccgcgcacgccctcggaagactcggcggggtgggggcgcgggggtctccgtgtgcgccgcgggagggccgaaggctgatttggaagggcgtccccggagaaccagtgtgggatttactgtgaacagcatggaggagaatgaccccaagcctggcgaagcagcggcggcggtggagggacagcggcagccggaatccagccccggcggcggctcgggcggcggcggcggtagcagcccgggcgaagcggacaccgggcgccggcgggctctgatgctgcccgcggtcctgcaggcgcccggcaaccaccagcacccgcaccgcatcaccaacttcttcatcgacaacatcctgcggcccgagttcggccggcgaaaggacgcggggacctgctgtg

SEQ ID NO: 5223 - DNA, 1233 bp, Homo sapiens
ctgaggtgcataagcccgtggtttgtgtactggaactaaagcggaactcactgattcatattggatccccaggtataccttctgctggtagcatatggctggaaaaggccgtttgcctcacacattgtaacctgccttggctagaaaatgcttttaatgtctcaactctctcttttctgtgtcatgttttggtaggaaatctttaagattggcggacggaacaggtattttagtgagacacttctgagtacttgctttttcctttgacttctaaccaactaaaagagaaggaggtcttcatgttgatattttgcttggttttattttactgattttaaaaggtatatagaaaaatgtaggcctttaaaaagaaacagcatgtagttttttattttaatatgttccatagagtggataggcagacaggtactattgtaatgtattctgtatttaataatttaatatactctagaaagtagacctcatgcattcttttagcatgattttcttttaaactgcttttcattttaagggcacccgtggcggaagctggttttgcaaggactgtgtaagctgtatgcgttctagctgtatgcgttctgtagtcttttcttaggtgggtaacattttcaataacgcgcgcacagcacacaggggtgccctgagccgaaggagcaaaaaaagccaccgctcgtttctataatccagctttgcttttcacaggcgtgggatccaggatggtgtcctctgtgaggacttgaactctggggctttaattccactgtttaattttcaggtaccacagcagcaaagcacagagtgtgacctttttcatgtctgagctgattctgtttgctccacgtgcctgcttcttgctactgttcatttagtaatgggatcacctcaccatgccatgctctgggctctccctctctgtccatttctgttttgctttcctggctaaacccatctaccattcttaacactggtagctcctgtcccattccaagactcactctctcagaccttcccatctccctggctttccatgctcctctccctccacctcctggcttcaactgggtgagggccgtattcctgccactctgctccgcctcagccttgagaactccacgtgggctgggtgggaaggtgctgacgattttcacactgtgtttaccactccatcacctctcaacctttgcttcgacaggtcttcactcacgatttatt

SEQ ID NO: 5224 - DNA, 1104 bp, Homo sapiens
attttaaagggcattaggcactatggttccagagtttcttggggaaaacttgcagattcttattaattggttctgcaatacttaaataaattattttacaattataagttttcagattataacatttgtattaatttttactgattttccaagatacttcttagatttactatttacgtagctttatgtacattctctgtaaaaatagacctctaaatatgaggctttacatgaaatttgtacacacatacacactaatgttagctccttaaattgctgcactaaggtgctggttagtagagatggacggagcctctcgcgttttgctctcagatgtgttaaaggcgcacgtgtacctgctctcagcggcagtgcggcctccccatctgctgggtgcccatggccctccctgcagcctcagtgatgacctcgtctgccagggacacaggttttcatcatttacaggctcttatgtgctagttttgttggtagcacgttatttaatgcataaaggcagaattcttacaagtttttttttttaatgtgaacatagatgcagcaccgactttttaaacttgaaaaaactggtataatgttaacttttaaaaataacatttggacacactagtaattgatttttgtttacagattgttttgtttacaaattgttagtctttgtttctatgagatacttttagtgtgactttttaaatgtcttagaaattaaaagttgtacaaaaagtgatttcatatttggtttataagcatttatatgtggggtttatttgttcttttgttttttccatcttaaatattatcatggctaaaacttaagggtatttatagtttaattccatttcagttttatagagggcagtaattattctgatgaatgttgaattaagaaatggatattttctttctctgttgtgcagttattggtagatcaatttcttataacccacaatgtagcatcaataattgatagcatgtattttatttaattacttgaattatttagacttgatttctctaattttttccataaaaggactgaacagcacctacttgtggtctggacagcttaacccagagttcctggaa

SEQ ID NO: 5225 - DNA, 1197 bp, Homo sapiens
cctcagcctcctgagtagctggggttacgggtgctcgccaccatgtccgactaatttttgtatttttagtagagacgggggtttcaccgtgttggtcaggctggtctcgaacttatgacctaaagtgatcgcctgcctcggcctcccaaagtgttgggattagaggcgcgagccaccgcgcctcgccgactccagacttgtttccactcctgagggccttaagctcccttggagtttgtgctttcacatttctttctgccttccgtgataaagggatgaatagtttttatgcacgcttcagcgagctgcgggtttttgtggattacgcaggctgtgaaatttgggaagtaagttgccttaagttggtagatgtggagatttgacaggaagtgggagaacaaaggggttgggaagcttttggaaagtgtccaggcttcatctgtgctgtggaaggtgagaaagttgggaattccagagggcagagctcttaaagaatttgagatgagttcagcactctcttcaaaacagtgttttaaaatttattttcttctggatatgaaagtgttaggtttgggaagtaattctggctgtaggacagtttttccggaacactaggtggggagtgttgaatgttgtgaagactaaaatatgcatatggtattacagtgtgatacctgttactgagtggcgtacattagctttcatttttaagcaagcccgtaattcccttctattaactctgttttggacagtggtacccgtcaccctcatcagtcttcaacctagataacctaaatccaggtctgaggtgggggtggaatggtctgtttgcaccttttttttttttttttttttttttttttttgagacggagtcttgctctgtcgcccaggccgtaattaatgcggtggcgcgatctcggctcactgcaagctccacctcccggggtcacaccattctcctgcctcagcctcccgagtagctgggacttcaagcttccgccaccacagccggctaatttttttgtatttttttagtagagacggggtttcaccgtgttagccaggatggtcttgatctcctgacctcgtgatccgcctcctcggcctcccaaagtgctgggattacaggcatgagccaccgcgcccggccttttgtgtgtgtgtgtgtgtgtgtgtgtgtgtgtgtgtgtgtgtg

SEQ ID NO: 5226 - DNA, 1119 bp, Homo sapiens
atctcgtgctgctcctgtagggcggttaggacgcgctcctctggcgaggaaggtggcagcctccactgtgcacgggtcacaggcgagtgtggtgtggtgtggttgtgggtggggtgtggactggatctgcaggcttgtccctctctcgtggagagctgtcggggtccaggcagtgctcagtggtgagagccacagcacatttgaaagtccacatgtgtttgccccactgtggtccaggacatgtgtgagccacactcagtggacttgcacctgtgacatgttggtcagcgtggcggccgtcagctgggtgtggaatgcatctgattggagcctggcacccggcctaccatgattgtgattctctggggcgagtcctgagtgtgggcagggcctcaggcccccaagagggctgtgagcaggcaccttcctgtgaggcacgatgccaccatgtgaagttgtgtgggtctttggagagttctggcaggttgagggcctgtgcgtgtgggacccaggcctgccctgcctgctgccggccatgttccctctgcccagtcatgttgacaattgtggccaaattcaacatcgggcctgtttcctgcacccacgttggcacacactgagttcaagacagtttctgcagaaatgaatccagaggtgtttatttctggcacgttggatcagacgttcagagggtgggcgtctttctccatgcacttcagctggatcagtcagtgtcagccattgactttagcaacagggaaatgaaagactttcctcaataagaaatgggactttctcacgctggatggcacagagctggcaaacatgaggccagtccacaccaaggctttgcctgcagaaaggctgcactgtggccagcgggggaagcggaggagacacctgtggacaccctccccacaggtgggcacacctttgcgcaggcccagtgtgcgttctgaaggagagcccagggtggggttccgggactgaggtgcagccgtgtccagggtgggcttctagctctgccgctgggcggaactggggtaggtcccagggtggggttccaggactgaggtgcagccgtgcccagggtgggcttctagctctgccgctgggcag

SEQ ID NO: 5227 - DNA, 1129 bp, Homo sapiens
tgtgttacctggtgggagaaaggcctgcctgccaaggaagacacaggaaagacagcctttgtcatgttactaaggaggagtctggagactaagacagtatgctcactttttatttttttaaagacagggtctctctctattgcccagatggagtgcagtggcatgatcatagctcactgcagcctcaaactcctgggctcgagcaatcctcctgcctcagcctctcaagtagctgagacttcaggagtgcaccacctagctaggactttatttttaaacgtcttcctaacattctaaacctgcgctattcaacgtagtagccacttgccacagaaagctgtttaaatttaaagttaaaaataatgaaaaattcagttcctcagttgcattagtcacattttagtagctctacagtgaaatgtggctaatgtctactgcactagacagttcagatgtataaaatcttcatcatcgaggaagttcttaaacttgctggatttttaattattttccttatgttttaaaaaaatgttctgtagagctatagggggcatttgcaaattttaaaatctgtttttatttgtcgttattttttaatctttgatgaatcaactagaattaccattatttatgatataaaatatacttgatttgaaatatgactttactgttcattgaaaaaggtatcacattttttgtgtcattcctagggtgcagacgtatgtcggctttggcgtatccatcaagctttatattgctttgattatgatttggaggaaagtggagaaattaaagatatgttacttgagtgcttcataaatattaattatatcaagaaagaagaggtaaataggtatttgttttttgatctgtttgtgagctgcttcttaatagatgtttctcctgtgttcacatggttcctgtctgcaccatgctcggtgttgcttagctaccaggagctatttactgcacatgatttttactgcatggcagtactagagaagacattttacaagtccttgcttatttcatcattaaattggatggtaacaggtggctgtgtgttacctaggggaaccgtaattacattttaaattaagaatgattaaaaataaggttgagaaagcac

SEQ ID NO: 5228 - DNA, 1073 bp, Homo sapiens
gtagcatgccagtaatttttaccaacatcccatacatctgagttctgcagtccagtgtgtaatccgctccatgtgtattttgcttaatggaatgctttatttaagcacttaggcagagtagacacaattaaaggtacaaagcccagaggaagtggtagagcagcaccgtgcctgccctgaggcagtggagtcagtagcgctgtccccagggccttgagtgcctggaggtgcttggcctccagtagctgcctccattctcttttaaaaaaagggggtgattctgaggcactgaagtgcctcccagatgtggaggagtgaagccaccatcgaggccacactcagcactccaggatcccagcgatgtcagacactcttgagttgtcaaaacgttaattttcagttttaaataatcagtttatctaagaaaagggaattttaacttttctaccttgagccaagccaatgaagggaaaattaattaacttagtaaatttgaagtgcagctctgttagctcgtacatgtgggttcttatcctgatcctgtgccttaaagtaggaaggtgtttccaagttcagattaaaatagaagcagctggccgggtgcggtggctcacgcctgtaatcccagcactttgggaggccgaggcgggcggatgacctgaggtcaggagttcaagaccagcctggccaacatggagaaaccccatctttactaaaaatacaaaaattagccgggcgtggtggtggagcgcacgcctgtagtcccagctactcgggaggctgaggcaggagaattgcttgaacccaggaggcggaggttgcagtgagccaagatcgcaccactgcactccagcctgggcaacagagtgagactccgtctcaaaaaataaataaaatagaagcagccttgtaactgtatttaccatgataatatattctgcacggtaagaattccttttacagacattctttatcaagaggtcggcccttctttttcaggcacataagccaaatgcaggcctgtgtgtagctgtgtgttttttctgtggttgccgcatttattccacctccag

SEQ ID NO: 5229 - DNA, 1139 bp, Homo sapiens
gcccccagcccagcctactttaactgcttttttaacaacccacaggtattggttgctctggcatctgaagaacttgccaaaggctggacccagtggtgagtgtccctgctgcagacagagaaccccagtgtgtagctaaaaacgctttccccgcccagtgggtagtgtcccccacagacagtggtggaacccgacacgtatctgataggcttttcctacttggtcctgtatccgtcaccaccttcctgtcactgtctttctcaggtatgacctcacggaagatgggacgaggcctcaggcgatgacatagccgcagcaggcaggaggcgtcctcttcagcgtagctctccacctctacccggaacacaccctctcacagacgtaccaatgttatttttataatttcatggatttagttatacataccttaatagttttataaaattgttgacatttcaggcaaatttggccaatattatcattgaattttctgtgttggatttcctctaggatttcgccagttcctacaacgtgcagtagggcggcggtagctcttgtgtctgtggactctgctcagctgtgtccgtaggagtcggatgtgtctgtgctttattatggccttgtttatatatcactgaggtatactatgccatgtaaatagactattttttataatctttacatgctggtttaaattcagaaggaaatagatcaaggaaatatatatattttcttctaaaacttattaaattcgtgtgacaaataatcattttcatcttggcagcaaaaagttctcagtgacctattttgtggtgtttctttttgaaaagaaaagctgaaatattattaaatgctagtatgtttctgcccattatgaaagatgaaataaagtattcaaaatattaacattttcataaatataaggatgtattattgagaagtaagttgaagggcttataaggaaaaatgttttataactgagtaatatattaagagaattgtcatggttcataaatcacattatgctaatctgaaatttcttacataaaaatgaagtgtcttatgtttattttaattgctgttgtaacttactcatgaaacagtatacagacaccttgtacttttcctcaactgtaaga

SEQ ID NO: 5230 - DNA, 1180 bp, Homo sapiens
ctgttacaaataggctgcaccgtttatattccacatacagtatttaatggttgtgatttctctctgaccttgccaacacttgctgttttgtattttttggattatagcttttctagtgtgagtgaaggagtatgtggttgtggttgcagtttcgatggccatagtgataatgatattgatcatcttttcatgtgcttgttttccatttacatgtctttttggcaaagcgagcgttcaactctttctccatttgtaatttggttgtctttgttgagttatacaagttccttatatattgtggttaacagactgttgttagatatataacgtgtaaatattttcttcctttctgtgggttgccttttgattttttttttttagactgagtcttgctctgttgcccaggctggatttcagtggtgtgacatcggcttaccgcaatgtctgcctcctgggttcaagtgattctcctcctagcctcccgagtagctgggattacaggcatgggtcaccacacccagcaacttttttgtatttttattagagactggatgtctccatgttgatcagactgtcttggactgctattcacaggtgatatgcccgcctgtgcctcccaaaatgcttggattacagggggagccaccacgactggccagttttttttttgttttttttttgaggcagggtcttgcactgttgccgaggctggagtgcagtggtgccatctctgcttactgcacccttcacattctgtgctgaagcagtcctccttcctcattctccctagtagctgtgactacaggtgtgtgtcaccatgcacgactaatttttgtatgtttagtagagacggggttttgctatgtccttctggctggtgttgaactcctggactcaattgatccacgtgccttggcctcccaaagtgctgggattacagacgtgagccaccatgcctactctttttttttttttttttaaagacatggtcttgtgctgttcctcaggctggagtgcagtggtgccatcttggcttactgcaacctcgatattcggggctcaagcggtcctcccacctcagcctcactagtagctgggactagaggtgtgtggcagcatgcctggctgatttttgtatttttagtagagacggggttttgctatgtctctctggatggtc

SEQ ID NO: 5231 - DNA, 1207 bp, Homo sapiens
atcatagacagtgtttgctcttgcagttgttgtctggtgtgaggtggtggtccgactctgttgctcacctgacgctgcagtttcctcagccctctgtcctgggccattccctgtggcagcggctctgtcctgggcctgcgtctgtggctcagcctcccagctgctctggggtacagcatgctcccatcctacggcgtgttcccatccagcagggcacacccgtgggtaaggcgtgctcccgtccggcggggcagacccgtaggtatggcgtgctcccgtccagcagggtagacccgtgggtacggcgtgctcccgtccagcagggcagacccgtaggtatggcgtgctcccgtccggcggggcagacccgtgggtacggcgtgctcccgtccagcagggtagacccgtgggtacggcgtgctcccgtccagcagggtagacccgtgggtacggtgtgctcccgtctggcggggcagacccgtccacctggttcttctccagcccttgctctgttcttcttggcccttggccatgtgtgtttaaaatcaggtcaagttgcagcaaaaaaaatcttgaaaatgtgtttgcatttgtgtcactggtggatgatttggggacaattcacattgtccgtgatgctgcacgcagcgtggttggcacctgcacttcctctcggctgcttttcctctgtcatttttgggccagattgcccttgtcttgagagctgggctgtgcattgaaggtaggtttgctgtgttttatctggcattgttaagtatttttcaggagagtttttcctcttatctgccatctggaagcctctgataaaggaatattttcccaagactctgaatagctgattaagagtctgtgaaagacagcaaaccacatttgcatggaggaggccatccgatggggcaggacctcccaccgctgagcaccttttccgagcagccacaaggcagtgggacattttactgcacataaaacagctgtgataagttgtagcttggaagctggatagtgaggactgactggagctgtcaggcgtgtgcatgtgtgcgggtctgtgcgcctgtgcgggcctgtgcgcgtgtgcgggcctgtgcgcctgtgcgggcctgtgcgcctgtgcgggcctgtgcgcgtgtgcgggcctgtgcgcctgtgcgggtctgtgcgcctgtgcgggtctgtggcctgtgag

SEQ ID NO: 5232 - DNA, 1198 bp, Homo sapiens
acttaatatgagaaaattcaagataaaacaaagattgaagggatactgaaagaaaggttgaatttatcatagctttagggagcagaagccaaagagcaagaggagcaggaaaacagcatgagcgggcaagggtcagccctgctggcccaggtgcgcccacagagctggtggcctcctttcagaatgaagtcccaatgagagcagagccctggggaggaaattcttttgctttgaaatgaatttgttttgtttggtaagtaaggtagcaaatacctttttgtgatgtgaagaatgaattttggcagtttcgcattgacttgtgcatttgtcttctctccatgcaggcgggctggtccgagtctctgttttggaagctcaaccagtggctgatgattcacatgtttcactgccgcatggttctaacctaccacatgtggtgggtgtgtttctggcactgggacggcctggtcagcagcctgtatctgcctcatttgacactgttccttgtcggactggctctgcttacgctaatcattaatccatattggacccataagaagactcagcagcttctcaatccggtggactggaacttcgcacagccagaagccaagagcaggccagaaggcaacgggcagctgctgcggaagaagaggccatagctgctccagccggggctccggggcggcagcagagctggcacaccgattctgggaagccccgcgaatgatggcttttgaattaatgaggcagtgaatgttttgtgtttacttctaagggaaatactaactttctttcgcattagtattaattttgaagtagctacaaagtatttttaagaaattataattttatgactgtctggcaggctctgtcagtttagccgcgccggaccgtgtcaagcatctaggagaggagtccatggtgtccaggcatcggggcgtcacacctgttgaggagtggggtggctttgaatgctggaaatggcttcatagtgaagtgcctcccacagggcgggtgggtcagcgttgactctttccagctgcacactcatatgccgtgtgtcttattcagaagtcacattcttttcagttggagagaattgggctaagatagaaaataacatgatttgttccttattaaagcttcccagcgtatgaaattctaagctgggtggggtggctcacacccgacgtaa

SEQ ID NO: 5233 - DNA, 1271 bp, Homo sapiens
caggacctcccaaggggttaagagcaactcctttagcttacttttcctttcaaaataacggtatttaatttcagatagtaatagttaaagctgaaaatatttacaggctaggcacagtggctcacacctgtaagcccagcactttgggaggctgaggtgggaagatcgctggaacccaggagttcaagaccagcctgggcatgatagtgagaacccatatctaaaaaaagaaaaaaaaaatagctgggcacagtggcatgcacctatatagtctgagctacgtgggaggctgaggccagaggattgctcgagcctgggaggtccaggctgtggtgagctgttattgaggtgctgcactctagcctgggtgatggagcaaaaccctgtttcaaaaaaaaaaaaaattcacaaacattttttgtcttcacctatgcatgggctaagctgcattgagcgtgaaaagagatgcaggacccagaaggcggcagttcatttgccaggctacatttcagcttgatgcttacataactacttgtctgcagcagtactctgaatttatgtgggctttcccgtattcactgaaggccctggctcacagggagatggtaatttgtatgaactgtgttaagttattgcatctaatattcattattgctaaaaatcattattgctacaaatcattgttttgtcattaggagtagtttcttacgttacaatgacattcagtaatgtaactgtgcgaactttatggtaatacactttaagccacatattttccccatttctccaagtggtttatgtaggaacgtttataagcagcaaattgtattcagttatattcttgacatggttcatgttatttaaaatcatgctccctgtggcacttgaacctccgaatacacatggggcacggagcaagcccagaggcccaggaagaggggatgatgcttcgcactgaatgtcacccacatgcctcatcgttcccgtgcacttggcagggacattcagggaggcgggtgtctcgctggttgctcagagctgggcagcagcgtaggtttagaatcaaaagacagcacagaccaccggggctgaggactctgtttttcttgtgggctgagttgttataagtattggccgggtgcagtggctcacgcctgtaatcccagctctttgggaggccgaggtgggtggatcacgtgaggtcaggagttccggaccagcctaaccaacatgacaaaaccccgtctctactaaaaatacaaaaagaaaca

SEQ ID NO: 5234 - DNA, 1235 bp, Homo sapiens
gcctccctcgggaccccagccctgcgtgcccagcctgaggacacagtcctctcctcagctctcaggccctgcagcgcccctgtgtaggctggagtcctctggcccctgtccctgatggaatctcaactgaaataagaggcgatgccatgggagaagggatctcccatccactgaagtcgcatccctgaattcctgcccgccgggttcactgggctctgggcgcggcgtagtgccgcaggatggggtttggtgccacggggcatgtgtgtggagtcagcagtctccaccatgggggctgtcgtcttttcccttattctcagattgtgggacaactcgtagggccaagatgtcagtctggttatttcctgtgggtttttatgagtttcatcactttactttagataactgtgcaggatcgtgagtttctttaatttcaagagctgtgaggctgctggttcctggggcacgcagtgtctctaagcttcatcccagccctcaccctctgtcaccccctccaatccctgatgggcaaggcgggggcagtcctcctgggactgatcccagagagcctgaactccaggcagcccctgaggccatgttggggggtcgctgtgttagcagctcctgctggctgtggggtgacgagggcccaggcccaggcacccgtgggacccctcagagcaggccgctgggatgcactttcggagctgcggggctgcagctgagcctggaagctccagaaggaccaagttgcttggagaagcagaaggtgcctttccaggacagcagagctaagaggaggcacagactcagaaccagggtcaggctgcaggcaggcagtggggccccatgccatagcttggagacatcgaggaaggttccagcaggttctgatgggcctggggggatggatcctgtgcctcccctcgccagcctgcccatgtctcctttaggacacaagctcagtggcccctcggcaggcgcaccatgcctgtgtctttggaatggccattttctgggctcacaaaggagccaggatgattggaaaatggcaggcagttgggttgctggtgtttggttgctggagacgcctgtgatttggagcaaagcctgctactgtgttgcagccactgaatggcgctccagctggacgccacgtggacccaacaggccccactcagactcactccacggggctagcagacttgacctctcgatttcacagggtcagctgg

SEQ ID NO: 5235 - DNA, 1156 bp, Homo sapiens
caatcgatgaacctacattgacacaacattgtcacacgaagtccagtagttcacactaggtagggttcactcttagtgttctatgagtttggacaaatgtgtaattagatgtatccaccgttatagtatcatacggaagagttttactgccctaaaattcctctgagctctgcctgttcatcacctccaccccctaacagcagacattttttctttttagcatagaaactaaataattttttagtttaagaaatttttttaacttaatctaaatttaaaactttgggtcttcaaaagatctgttaagatgaagagacaatctatagtctaggagaaaatatttgaaaaatatatatctgattaaaaaaaaaaaacctcttatagctgagacaacccagttaaacatgagtaacatattttgaatagagattttccaaaatatgatacatgaatagcaggtaagtataagatgtcaacatcattaatcattagagaaatgtaaattaaaccactaggagatactagtgcatgttccctagagtggctaagatgaaaaagactgaccataccaaatgttgacgaggagctgtgacaactggagctttcctacgctgctcttgggagtggaaaatgatacagcatttggggaaacagtttgctagtttcatataaagttaaacacatgtttactagctaactcagcaatttcattctgagttaattcacccaagggaaatgaaaatacattttaaaaagatacacaaatgttcataacagctttttccacaattgccacatactggaaacaacttgtctggtgcacagataaacacattgtggtatgcgacatagcaaggaaaagagatgaactactgataaagcgacatggatgactctcaaaagcattatgctgagtgaaagaagccagtcgagtacatattgtatgactccatttatatgaagttctagaaaaggcaaaactgatacactgtcagaaagcaggtctggggccggtggtatggggaagggatttactgcagaggggtacaagagaacctttttgtggtgacgggaatattctacctcatgactgtagtggaggttacgagactatatctgtcaaaatgcatcaagttctacgtttaaaattggtgaa

SEQ ID NO: 5236 - DNA, 1216 bp, Homo sapiens
tgttgacgtaagtttccatttgctgttttgaaatttgttacattggtttccttgagcttcctgtcaaactagcttcaaaatatttttactggggctagtctggagtcagtttttagtctttcttcacttacatatttgaacagttgactgtttttgaggggagaagggctctaatagcaggacattgcctttatcctgattaaatgttcttgtcaatcatgtgatgctcttcagcagttgccagggagtcatcattctgaaaaccagatttactttttctgttttttattcgtatttccacttcttttaagttagcaggaagaaatgctgaattcaccaatgcctttggtcccttgtccaggacttcagagtcactagaaatggtctgtatttcttatggtaaagttgtgcatctctacaagattccataaaagggattagtagtgtgtttgacctgttgtcttaagcatactctcagtcatctcttggcatatacatgtgaatgaggtagcctcataataaccttgtgctgccttttcaggagtcactgttaacctctactggtctctttctctggatactggagcatggtgcaaggattcttcaactctcatgaattcactctcgtgaattcccattattattgcatgcacctttacaagccctagagtaactactaagaaaggcctcatgttgccttatgagtctctaagcctcctcagagtctacgcacctcaagaatatttttattggatccttttcccctccctaacctcattcctacctctctttttactactcttctctcttcttcctcccctcctctttttttctctctgtcctccaaataaatgtgcaaagtcatgctctgaaactgaagttccttgtacctaggagaatcctcatcttactcagcgcaaatttgctcctactgtagtaacagcttttgctgctgactgattacaaccgttttactgttgtaagcttccagctcatgatggttttagatgtgcactgtccagcacaaagccactcgtcacagctggctgctgaacacgctgccacacgttgaaatggtaatattgtggatatagtagggtaaataaaacgtgctattaaaactcatgtcttttttaaacattgctactggaagtttacaattacataggaagcttatatttctactggacagcacttttcaaacattctaaactaa

SEQ ID NO: 5237 - DNA, 1163 bp, Homo sapiens
aagaaaggaagtagttaaaatggtcagtgttatgttatgtatattacaacaattgaaaaattaaatttaaatctaagaatgctagtggacatattgtagtgctgtatatttcatatatcttccattcactcctaaaaaatggctgtgttgtactctccttggagttggaggatctggactgagacctgattttgctactgaatagcagtaggcaagccacatgcatgctctaaacctcagtttcttcatctgttaaatggtgtcaaatacctatttcataggttggttgtgataaccaaatgagttgatggataatgtaaatgctttaaaactgtaaaataacacactaatgtagtcatagtattatttcctgagagcttagcactgggcagcaaccacatgtccagagctttctgggaagattttccattatctgccctgtcgttctcataagcacccacatgcttttcagtacaagaatctagacttgggtctacagccacaccaccttgaacatgcctatcttgtctagtcttagaagctaagcagagtcggacatggttagtacttggatgggagaccgccctggaatacctggtggtattaaaaaattaattaattcaataaagtaatagtaataaaaagagaatttggatttgggaagtctggcccatctagcaggttcttgccatggaggcacccacaatagtggggagaaagaggataaagcacaagggcctgttgagttatgcagtaagtggtgtcctattcccctacccataactggggacccagcccactcccagctgtcctgtccccttcactgtttgagtgaccaggaaagaaagagcctccactactctttgggtggggccccgtgcccgcccatcccaccataggtgagtagaatcaccaggcaaccgccaagaagggattagattgaagaaatccagtctccagggttatagtcctagagccatgcttcattctctgccaaaccaggttcagtccaggagcccacacagcccaccagctgtgtaggaatgccagcagaggcctgatgatggcaatgacggtgacaatggcattacttattgagtgtttactgtgtaccaggcactgtggaaagcaccacatatgcatgctgtcgcctaatctcacga

SEQ ID NO: 5238 - DNA, 1205 bp, Homo sapiens
cccaaagtgctgggattacaagagtgaaccaccacacctggccagtattgtgtcttttgatgcctgttttaaagagttactttcgctgtgctttatcttgtttctacttctaactctttaggaaggagatgagaatgtagaaaaggaattcccataagagtggagtaggaggcagtggggcgtgatggctcacacctgtaatcccaccactttgggaggctgaggcctgtgtatcacttgaggtgaggagttcgagaccagcttggccaacatggcaaaaccccgtctctactagaaatacaaatattagctgagtgtagtggcaggtgcctgtaatcccagctacttgggaggctgaggcaggagaattgcttgaacccaggaggtggaggttgcagtgagctgagatcgagctacactgcacttcagcctgggaaacagagcaagactccatctcaaaaaaaaaaaaaaaaaaaaaagaaaagaaaagaaaagaaaagaaaaaaaaagagtggagcaggcagtgattgattgatacccaggccactgctgtgctggtggctcatgttgcagagttgggaaaatattatttaccccatgcaaaggattggctctgagggcagcaccaagggcagtgctccttgtgggggtgacccatctccccacttctctcctcctctccccttcactcctcctgctcacgactctttcaggtgctcagcacagtggtcagaggcagggctctcccatcatctgcttgggtcttgacagaggaggtggttcatgaagggtcgtgactgaattacatgcctaccctggtgagcaaatgagcagacaccaggcagagagataggcaagtcaagggcagcagaagagcatggcccaggcgtggagacctgggttctcgcagacaccgtcctggaaatgtactgtggacttggccaagcctcttctgctctgtgactcagtgtccccctctgaagaatgagggcttgggccaggcgcccaccagatcatgtgctttggagaattccacagttccttctgccgacaatgaaagtaacatgctgtaggcaaggagccgggcttttccccgaagtaggggacctgacttgtccacagactccttccttttctcttccttcatgtgagccctccatggggccctatgcggtttccccacccccagctagagtgctccatgc

SEQ ID NO: 5239 - DNA, 1157 bp, Homo sapiens
caaaggagggcctgatgtgaagctgacgccgtatttttgtagatctgtcaacctgtgattctagctggttacaaacagagcaatgatcatgttttgataccttacttctgatgactgaaagcgataagctttttataaatgtgcgtttaggtttcaattcctcgtacccacaccctctcccttgtatgcttgtatttaaagccaactatattcatatatttgctttgcagtacaacttgaaactcactgtctcctcactataacattagatgtcaaatgaattactttttgccatttttcttacaagatttttgatctcaaaaatgtgtaaatttatttttaactcttcttttttacttgtatctttttagtctaaattgaaaagcaacttttgtctttagagcatttatttctggcatctccattggaagatttttttttttttcacacatcatacaaagcattacaggtgaaaagaaatgtaagtaataaaaaaagtcttccaagaaaaaaaatgtgcgtgtgtgtgtgtgtgtgtgcgtgcgtgtgtgtgtatgaatgaagggacagagccagtatgaagaaagtaaaagttgaagattaggccattgccaggtatgacatagaactttaagtaacaaagttgaccagacgcggtggctcgtacgtgtcatcccagcactttgggagatcgaggtgggtggatcacttgaggccaggagttcaaaaccagcctggccaacatagtgaaaccccgtctctactaaaaatacaaaaattagcctggcgtggtggtgggcgcctgtaatcccagctactcgggaggctgagcaggagaattggttgagcctgggaggcggaggttgcagtgagcgatccgagattgcaccaccacactccagcctgggtgacagagcaagattccgtctgggggaaaaaaaaagaaaaagaaaaagaaagaaagtaagttatttaggtttggttaagaggaaactagtacagactgtagaatagtgttgtttagacagtagctctgtaagtaccacctgtgactgtgatgcattcactttgatcttgaggataacttgtctcaaagacaactgattacttgattttatgagatcaggcttttcaaagtatgggcctggcatacctgg

SEQ ID NO: 5240 - DNA, 1374 bp, Homo sapiens
attggaggtgacatcactgttagtggtaatggcttaaattgaaacacttcggcttcttacaaagttctttttctggctcccaagtgtcagcctgacagaccgtcttaaaacctggaggttcagtgccttactgggttaaccagtaggccttttgtaagaatgtttaaaaatttttagaaagtcagaagttggactgttttaaataatcaaaacaactagtgaagtttctcctttgtaatttatggagaaggaaatatgttttgtaatttttacctgccaaattattaaaattttcactttgcaatttagctgcttttaaatgaaatttgaaacaaaactacctggtacttgattataattaaaaaagagagttttttgtttgtttttttgttttgttttgtttttccttccacaattgatcacgattactctactctaggttgtgaccttggtgaatctgatatcaccatttggaaaattaaggccctaaagctggagtgagtttgggaggctggagtgtagctcttcagggccaagggggagaaggcggcttttcctgggtttactctgtggtgagcagatcagtccttgtttcatttaaacagcccacgggcagcaaccacttctcctcaactttcccagctttctctacctttaactcttggattatagtttctttgctaattcttttgaaaacatttggcttccttttacaattaggtgggtccctgtgtaagcaaataaaaagctttctatcttggtcatatcactttatttctctgggtcagtttttttacatataaaatatgatgaagttggattgctttctagatgtagaactctgtgaagtgggacgagatgagaaaaggtcctctggtgggccttcctcttttctttttctttctcattttgctcagttccttgtattcactacaacctgggtaagtaagtaaaatttatctttagaaaggcaagctaacccttctttcatttccgtctttttcagtgaagccaaccagaattttgagttgcaggtacctgatgatatacttcagtaaatattttataattttacaaatatattaaatattaaaataccaataataagaaagtttctgtgatagcttccaaagtgattgactgactaatcagtaagatttactaaggacttaaaatgctcccaacatagtaaagaactataggagccactgaaagtgtttacagtatatgagaaagatgaaaacatctgaaagaaagaactgccaggcactaaatcatgctctgctgagtgagtgtgccccagcatggggatgatgtgtgcattgtggtcattgttagcacctactgagtttagttgtagttcagttgtagttt

SEQ ID NO: 5241 - DNA, 1200 bp, Homo sapiens
gcttcacacatttaagggatcttacatgtctgagcaatattctataattataaaaataagtgatttatattgtgaaattggaaagtttatgacattgcaaattatcatcttgttttcctgaatatatcataaaatggtatttggatctatttgataattttgtgggatatttctgaagaatcaatgagcatgtacatacaagtagtgacttctcaaatattgtattcaattgcatccttttcagtacctcaagattcctgtatattttagagtataataaaatacagatgtgagttgtggcaacaaaagaaaaaagaatgtataatacataaattacatcttatccacaaatgtaattttaatccattgtatatacctttcttgcttctgttttccattcctggattcaataggtattttcctacgttggaatagatcctctaagtatttggatgaagcatatgaagaaatggttaacatcattgaatataataaagaattacaagcaaaagtcaatatccttcgaaggcagttggcagaactggaaacagaggacgggatgcaggagagtccctgaaaggtctcctcgcacccttcgcaaggaccttcttgggcctgtgtccgccgttctctccttgtgcccttcagttcacttttacacggtagccttgaagtgaaggctttagatgtgggacccccctaatgtaatggatttctcaatactgtatgaataatgaaacttactatcataaaccatgtttcatgtggcctgttagggcctgtcactttgggagccggaaggaggtgctagtcattttatttttacgtgaaatagatgacctatttaatgccatttgtgtttcatgccattttatccaaagctttttctctgtgtccactctccaaacagcattctagagcagtcaaggagacagctaatctctctagggactatttggtggtttaaaaaaagggtcagacttttaaacactctgaccatagaaatgtttttcaaaatggcaacaatggataaaccaaggattttgtgtttaacaatccatttccagtgtcttcgccacataaaatagccattttctttaaaatagttttggactaacgaagctgaaatctattctcattcttgtttgtcaagaaaggaaaatctgttattcaaggtaaattatttctacaagggcaaca

SEQ ID NO: 5242 - DNA, 1211 bp, Homo sapiens
aaggaaatgtaaccaaatgatcccactgtgctttaaaagaacgcatatgatcttatgagaaacaaacacgtttttctcacatgtgctgaataaaatgtacattttgtttaatagggagaaatctggatgatatgccctatttttaacaactctacattaaaagaatcattgagcctagtaatcctctgacaacatgctttaaagaatgctggattcataacaaaaagggtagttatgtaaaataattgtggatgggagacaaatgaacagagcatgtttattggtccaactcaattcagaaaaaaaaaatctagacttaactgcaagacatggtgtgtgtgtgtcttttaaatacactttaaattatgcataattggacctgtgtttgccattggtcaattgaggtgagatctcaaaacattagtgactgtggctggacctgtttgtttctgaaataacatgacctcatgatgaaattgatattgatgaaattccttaaaaaaggctgaagaccttccctaagactcttaactgggccagtgcccctctgcccacctccaacattcaagacagacacactctctctctctgtctctgtctctctctctctctgtgtctctctctctctctctctgtctctctctctctttccccctctctctccccactacacacacacacacacacacacacacacacacacacttgcccaaagaatcaaagcaaggaaagtactaggaagcaaagtcagagtcaggacaccttttagaaaaaagatttcccagtccatacacataggctgattaaaacctcagcattttaattcatgcaatatactccaacataatttgagtctggatatattttttaaagtaatttctattcatttaccacgttgaaataaaatctcagtaatgtatgcaatttgtacaaccacgtatgtttaagggaaactatattcctttactttttaaccagtagatactctttcgtgtttcacaaatttaagttattccaaaattgcaccatatcaaacacaaaacatgtttactagaaaggcactttgattattaagagatgtttgagtaaccacccccccaccaccaccaaaaaaaaaagaaggaaagaagacaagaatatatgttcaattaaaattattaaaacatgtaggaatatatagattttcactaataatattgtggggacaatca

SEQ ID NO: 5243 - DNA, 1176 bp, Homo sapiens
cccaaataaatgacagaatctacatgcttttgagttaggttaaactaaaggaggcaattgaggaaatgtaagttatatgtggaagcttaaagaagaagaattattctaagaaagtctgtgcagaatcctctcagttctgactctccatcaaagaatgattcatttgtcttgtagagggagggcatctttcacatgggagtttatctcctgttttcagggagaaaagggggagactcaaatgcccttcttacatctactgtttctcaagtgtctttaggtcaaggtgattcttgtaacaatgtaatataggttggggccacttattctgccatcctgcaaatttactccccacttaaaagactggtctctgcaaagtagctagaaatttgcctccccaaagatttccagcagggcccaggtcattgacttaaattttttaaacccccaattaatatcaattgatttaaataagatcgtagcagttgaaatctccctcgtgaacagacttgtaacaaaaatatgaatgtattcaatttatttatttttgtttaatttgagcttatttactgactcattaaacaaattagggtgctcaaagctgtcatactcacttgtaaaagaataagaaggtcatagataactctgcttcacattagcctgctgtttttttttctccttctgaatagtttctctattgtgctacttaaagagaaatgagacatgtatacaaaccactgctcttttagaaagcacctttatcagctcaggtaccaaatttagctctggcttcagttctgggtacccagaggactggagcctggcatctccttccctctcccttggtcccctccagcttttagaatgatgtgtcaaaaatgttgattttcaaagtgttgaatatcatgacagcatttttatcatgtgtctgaacctcatatagtgttgataaattgaggataaaatttacctctatcttcagttaaatttttcatgcagtacttttcatcatgccagaaggtctaatttaattaagactttttttcaagaaattatattacttgcctaacatcttcctttcaagaatctcaaagtgacttatagacatctggtgacagatagattacttggaaacttttgtttggttctgttccaaggtaattttccacagagaaacta

SEQ ID NO: 5244 - DNA, 1215 bp, Homo sapiens
tatcaaagaagcttgggacaccaggtgtgctaaacagtgtgacctgctgtgtagagaaatggcaggcaggcctctggctgctataacagctcttcacagtgctccatcatctcctgtgctattgtgtgggtttacgagattgacttaggcaagctaaatagagtttgggttgctctgttaggcaactttagattcaactagccaaaaggcaatcagggtattttaggtaatgggaggtttattggagagagatatggagaagcaaggaagacaattaaaaaaaaacctaattgccacatagctaggtgtctcagatgttggaaaaagttcagaaagtaggtcattcaacaacagaaatccattgcttcagaggtaactcaaatggctaatctcttgctccaatccttccactattattactgagtaatgtctttatactgttctcttcagctgattagagccttctatgtccctttggctcccacctatatatactaccggttctcactctctcaacatgattttgtgaattttctaggaggaagtgattggctaagtttttcatcccccagtataggggcgtctgatttaagtagaactttgaagccagtctaccctttggactccttggaggtgttcaaagagctcactgaatgtaaattaattgtctgtttcttaggcacatccaaaagaagccaaatacaatgacaagtacctataaaagttaacaccaccaaatatgtgaccagagtagtatttaattcagttcatgtatttgggaaaaaggtgtgcaggatagatctttgatcctaagagatcgttctcaaaactctgtggcttcttattcctacaccatgcacagctgagtcagaatctccaagtgtgggttttaagaatcaggtgaatagttacccaggtaaatctgatataaccattttatgagcctgtcttagggaactaagtgataaaggatttcacaattgcctctcagttttaaatttgagttgttaaatgctttatagacatgccgtggtgcttactgtgaaatcttctgtttggagaaaatacatacatccatgaaccggggaataacaatataaagtgtcacaagctaagtggctggcagatctgttgtatggaaataatttacaggtgagaaagatcactgtgggtctgagaaaggaagactccagaagaaggcttgaattaggctaa

SEQ ID NO: 5245 - DNA, 1182 bp, Homo sapiens
ttgttttatttttgttagcagataagctacttcttttcaccttatttctaacagttaagacaagttccattcaagtcctgatggtttattccagtagtgattctgagtgtgaggatggtagagtgaagaaatggccacaccccttttgtctgcccctctctgactgtctgtccctcttggccattaagaaacattgctttaattatctccatcaaaatacatggcccatttgttattttataattttatatttctaaacacaaagtgtttaatctacacaaaagaatgattgtatgttctgaatttgacctctttccaaaaatgagaaccatgtgttgaaaaatctgaaagttcagatgttgaacattatagtctgtcatttttaaatttatttcttaatctcatgtctgccccccaatatattgatatttttgttttccctttatttaaaaatattccatcctcgtgtgttttactcctactaacagtagcctgtcactcagacactgctgttatggcagcaggtcgcagcataaactggtgcagaaccacagcagtgactagtttttttggcaacaagctctccacatcacgacaaaccctttctggtgcagtcctcctaactgattcaaacagccttctacagaaaacatgatgggtgggatagggtcacaaagcaggatccaagattggaatggtcataaatgatcaatgtaaggaaaggaaagtaaacaatgtgaggagaaaagacagtaaggattctcccattgcaagtaaaagatgagttgtaattgaagtaacatataccaaaagctgagtgtttgggtaataaatcatttgatctaatcagtagctggcttatatgaaactagatccctgtggggctttccctggccttccaacacggccttgttagtgtcccttcctctcacccttgtattaagtaagaatttgttaggcctcaactcggccttctgctcttctctctgttctctttcttaattatgttaatttgctgaggagaacccattaactaaatgcagctcctcttgtccaaatgtgtattctctaagatacattgtacttatttcaaagactttccctattcaactgaagtaacagcagtggcaataattgcagtttatacacatgacattccagaagaggccaccctgaccacca

SEQ ID NO: 5246 - DNA, 1123 bp, Homo sapiens
ctcaaagacaaaatcacatccttttcctaaccactgcctttctctcccttctccctgctccacactaaacacagaagtgatcactcatctccagattctcatagcactttattggtagtttttgtgtggcccctgtaatgattatttgggcaggggtctcatttcccatctgaaccgtaagtttcttgaaaacctattcatcttactaacttctaaagtatctgtcactgatagtaggtgctcattaaacattcatcgaatgtgaatgcattattaacctaagatacagctgttgcttggctcttttcatttaaaccacaaaaatgttcattacctaaaagacagcaggattaatggaaggccatgttgcataagatcatgattcacatttagaaaacaacttcttttacaacctttctagtaattaacacatattataaaaataataacagtctattctttttctatgtaacatttatctagatgaatttaaacgtgccgtctatgtagctactggactcaaattttcaccacatttagtgaacactgtcttcaagatttttgatgttgacaaagatgatcaattaagttataaagaatttattggaattatgaaagacagactccatagaggattccgggtaaacctacacattttaaacctattgatatcctttttaaagtctgagggaaatcaatccatctaagttgagaaataatttatcttaatttcttaaggatataaacatgaatgctttatttgaaaagaaaaaacataggccttacttcccttaaaaaacaatttgaggtgataaaagagaatgctttttaaaaaatgtgaaatcagtttgaccttataataatttattttcatagtcagtctaatgtcttcatcctagtttgtggaagaaaaatgttgccaaatattttcaaaaaatttagtctgcatattagcttttcggacttgttactatacaaataaatatcactatttgtcactttattttattttaatttaattttatttattcttttagagacagggtctcactctgccacccaagctagagtgcagtggcatgatcacagctcactgcagccttgaactcctgggctcaagtga

SEQ ID NO: 5247 - DNA, 1176 bp, Homo sapiens
tgctgcctggcagccggtcaccacagaacactggaaccaccactgctcccccagcctggtaacagcgggtccagtgttccagcctgggcagtgtccagctggcagggctgaggtggttgcgcccacatctcaggctgcatggtccagcgagctcaggtgtttgatcttttttcgttaccatggtgagaagtgtgctagcggggaaaaaagacaaatgtatcccatagatgagtatatatgggggcgaggggttctccatgaaatggtcctcattgatttttttgtttcatttgtttttatgttttatcttgatggagaatttgtgattttccttctcagaaaaatagagctatacttacatttcataatttatactgctgatttatgccactgcgttttgacagttgtatcatatcacccagccttctcttctccaggaagtggtgtattcatgggtcccctgagattccagcactgcttatgatgagtgtagaaattctgtcttgtctgtcttgcagaatgacagattagaatatggcatagattcttaatgctgtctgttgggaaaacaatattctaaagatgattagaaagacagttttaatattatgtggaattctgttattacatattaccatttagaaatactacagagaatttataatgaaagcataaaataattgaatgaggtttttaatagtccattagaaaattgttgaaaattttttcctaattcctttaagggaattttattataattgtcttgattgttgtttcaatcaaatggcagtagtgaaaagggcgaaattatcaaggcagggggtaggaggaggaggcgctgggtaggatgctctgatttcttaagaagaataggatagctgtaaagaaaccagacatgattgcttgagaattttcctttcaaaatgataatatcacactttatatcatttatgtagcatttttcctaatttgactttttatctggccatgacttttaaattcagttataaatattaattgcctgaagtgttataaaatccatttttatttgagagatactcacaagcaaaattatatgctgcatttctcgtcttagcacttcactctgaagtgcatacttaatggtagttcattttaggtatgttattgattggattacatttttaaaatgcaaat

SEQ ID NO: 5248 - DNA, 1176 bp, Homo sapiens
cagtaaagtggttaggctgatgttgtcacactgtccggggccacatttgtggtaactgagtgacttaggacaagtcactttgtatctcttctgtcccaatttcatcctcggtaaaaatggcgatgctaattgtctgccccaagggtgggtgtgaggattacatgaggtaatgcattgtaaagcatctagcaccaagtgttaactgctattaaataataggtattaggatgtatgcagcttgacagctgtgtagtaattaaccacactggctgttttgtgagggcatcatctatgctacagaaaggaataatcattagactaaatattcctagaaatcccaaacgacaggctcttcaaactcaagtggaaatgagacctcatcagagtattctcctgatccagtagagtgtggtgtgtggagtcaaagcctaggtttttgtccatccactcctagttggatgttacctaacttctttgagtatggttttttcgctggtgatatgaaatcagtatgtattttgctgcgttattgtggagcttgaataaaatagtaatgcatataaagcagtggtgtagtgcctggcccatcacagcaactcaagaaaagagagctgccactatcgccgtcatcaaagcacccacttcttccctccaaaataatgggggtggggcgatgggagttggtgtcactctcccattgggtaatttttcttcaccttctcaatgaaagttgagacaaggtacccaaactactaagaactgcaaagaaaaaggacagttcataaactcaggagcactgaaacccaggtagagtctgtgctttccaccttccgcatctaacagcctccagctgtcccagcatccactgactttcccgttgttccctcagtctcactgtggcagtgtccaaagcagcctgtgtgtttccactgtctgagccacactcccttcatggaagcactggttctttgcttctgcagaaactcttaaaagtgtccctttggtccagtgattttttgatactctacgttgatgtctttactgtctcgtgttttcttgttaccttcaggtataaagtccataattgtagggattcttttctgtttcctatggaaaaataatataatatgctttctgttttcttgggtactcgataaatatttttgggtattttaa

SEQ ID NO: 5249 - DNA, 1164 bp, Homo sapiens
ttctttgggaccaaagatctgggaagggaagaagattctctacagaatgtaaatttgcccctacaagagacagctttgcagggccatttcaaaatgtgttaaagaaaaatattttggggtaaaatacttcaatttccttcagggcttgctgtctgtcatgtgatgctaaactagagtcaggttggaatttagtgtctttttgctataaagagtctgttttgtctgacttaaggtttctgttttaatgttaattctggtcagttgtgcctgaattctaaagggaggagagtataatgaggcatgtctgacctctttgccatcatggcctgaacttgttttttaggtttctttggaattgccttggcctagaggaggggcccattcagtcagttggggggcttagaattttagttttggtttacagtcttaactgttattttcacagggctctgcttcaaaaacaacgaccacctcaggtaggaatatatccaagcctgactcctgcggtttgaggcaaatagctgctccaaaagccaaagtggggccccctgtttcctgtttgaggcggaacagtgacaatagaaatcccagtgctgatcgagccgtatctcctcagaggatcaggcgtgtgtccagttctggtaagaataaaatagttcaatagtttatgagttaattgaatgtaaaattggacagtcatgattataggtctaatgccttctgtcactaaagcagttagccttttgtggatcagcatcctgagcacaggaggtagaaaaagaagatgacaacatatatcccttatctttgagcaaggcaaaggctagttgaggagagaggtataggtgtataaaccatcttataagctattcagaaggatgtgtacataaatatacaattgggtggctgatgtaaatttgaatcatttcattaagttttttcaaatggttaagtgcttaacaatgctgaagtgttgtacggtaggtccctagtgtgccctcaatacatgtgaagagattaattttttttttaattttactgaaagatgtatgatagatttaggagggatatgagggtgactaaaaagttaaatttttctaatgtgaacttttatttatgttggcttgtatcttacaatttgtaattttaaagtcatgttaggcc

SEQ ID NO: 5250 - DNA, 1181 bp, Homo sapiens
acttggttggtcatagggaaagggggataccagtattaactgagtgtctgttatatgccaggcaccatgctaagccttttatagtgttatgccatttaattgggaaactcgtttggtctctgagcctggattaagtgatctgtgaagtcccttgtacttcaagcattctggatgggatttccagttgtcatccttgtattctctccccaatatagcaccgtgttctcaattcatatgtacatgtttgtaaaattccttaaaatatttatgctcaaaccaacatttccattttatctatcttaaatatatcttcctcttctttacgcctaatttcttaaactcccagagtttttttctgtaagatctagtcatctgtagcacttctcacaaattgagctctcttatgccccaaacagtaacgaaagaggtctcttagttggacaataagcagtgaaagatatttcttatgggacaagaaattaacattattagtcaaatgttgatgccggtaggctgagaaatgattctcacttaaaagcccctgggttttaaacctctcttagaaaaacattagttagatgaaaaaaaaaatcaaaatattttcctctggaaaacaatgttcctctgaaaacaagcagattattaaaatatcccttgtactacttcaggaaattgtaatcttataactgtagtggccttttagcttttaaatatatgaacttgagttggacacatgctgatctcattggtactttgcatgataagaaattatgatatttacaatgtgcagtctcagaaagaactgagagttttgctagacatttgccctaaagtttgagtcaatttatggtttaaaggggtgtatttaaggctagaaaagggaaatgaagggttttcttaggattttttccaattctatttaaaattgtttgcaaagttttgaaagcatatgtcatgagtttggcaaaaattatttcaaagcttgttttttttttaacctcattcacctctgctaactcctgaacttcagtgctttacttctgtcttccaaaaagacgttgtctaaaattagtcatgaaatttaacttaactgtaagaacttgaaacataaagtttgctctgaaaaagatctgggaaacctgatgtatatttcacatatcaatacatctgttgatgtattg

SEQ ID NO: 5251 - DNA, 1223 bp, Homo sapiens
attacaggtgtgagccaccgtgcccgaccatggctttatataatagcttttgctatgtttctgggcacgtgacctgcttgtgtcatcttcgatggtaaggctgaggtcttccagtgtgtgaagcacttccttggagcaggtgctcaatcaggtttgtggttttggtgaatgtcatgctgatccctccctgtcacccttccagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggtcagtgggccaccagctgcttggtggagcctctaagaggttgactcaggcttaccttgagggcacatggtccagcctttgacgctgtgggccctgggggtgtgctttctcctaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttcccacatgagctaggtaagcgtgcgtcccccgttccactggtgctcccttgggtggtggtgtaggcccccttcctgtggccggttccttgctcccatctccctgtcttcacagtgcttattgtaactgatttaacacactcctaaagcttcatggaccctaatcaccttttttttggagacggagtctcgcactgttgcccaggccggagtgcagtgatgtgatctcggctcactgcaacctccacctcctgggttcaagcgattctcctgcctcagtctcccaagtagctgggattacagacgcctgccaccacactcggctaaattttttttttttttttggatttttagtagagacagggtttcactacgttggccaggctggtcttgaactccttacctcgtgatccgcccgcctcagcctcccaaagtgctgggattacaggcttgagccaccgaacgtggcctaaccaccatttcttaacgattaaatagataatttaaaatgatggggtttttaca

SEQ ID NO: 5252 - DNA, 1176 bp, Homo sapiens
cccttgcctccgagctctggcttcaaggggagctcttctccaggttcactaggtgaattgatttattattatcatattgataatgtgagattctttagccactttggggagcctgtctctccagaagcctttcttagtggtgcccacagttggagcccaggggccatgtttgcaaactgattcatgtgcatggctgacaggagtactggttcactaccaatgcctgagcttttctcttacatagaaaaactgtccgctctcagtaatcacaagcagcatccgttttgttttctcttcttgggagacatctgtcaaaccaggaatattcttgaaaagaacgtgagcaggaaaaactgctggtgatactttttttaagttttgtttttatcttgcctgttggcttcaatacatttgagaatacgctgaagagggaaaatttcagtgatggagattctagattaaatatcaggactgatttcctggtgggattatggtccagttttaccaaagaaccaattccttgaatgttggaatctaactttttatattgtcattattattgttgtttttaaacggttctttgtcttttctgttttatttttctcaagctgctttcaggagctagcagaaaataactcaaagttgaagactctggaagattttgctttaacctaactcgcattgatgtattaaatttataattttagcattcccaatagatcctatcattccttaaacataataccctttgtcttggagtagaatactaagttagagttagtggatttctagtttaggagaggagctcaaaactataatctttaacaaattgaaaaatgaaatagggtgttttccctttttgtgcacacctatattaccttaagaaatttccttccatagacagctgcctcaaagggaaatcctctttaaaccgtagttggcgcagaggtcagtcctagtcggagcttaggaggggcggagacgctcacatcgtctgacttgagtcgccactgattgtggcaacagctttgcctcatgagtcaaaaattggcaatttcttttgatttttagttgttgaatttgctgtttcaagcatttgtacatattagaagtctaaggagtagcaagtcagtgggaggactttttcacccctggcattagcagcttcgacctcat

SEQ ID NO: 5253 - DNA, 1409 bp, Homo sapiens
agacgtagccctatgctaagtcatgagcatatggacttacgagggttcgacttagagttttgagctttaagataggattattggggcttacccccaccttaattagagaaacatttatattgcttactactgtaggctgtacatctcttttccgatttttgtataatgatgtaaacatggaaaaactttaggaaatgcacttattaggctgtttacatgggttgcctggatacaaatcagcagtcaaaaatgactaaaaatataactagtgacggagggagaaatcctccctctgtgggaggcacttactgcattccagttctccctcctgcgccctgagactggaccagggtttgatggctggcagcttctcaaggggcagcttgtcttacttgttaattttagaggtatatagccatatttatttataaataaatatttatttatttatttataagtagatgtttacatatgcccaggattttgaagagcctggtatctttgggaagccatgtgtctggtttgtcgtgctgggacagtcatgggactgcatcttccgacttgtccacagcagatgaggacagtgagaattaagttagatccgagactgcgaagagcttctctttcaagcgccattacagttgaacgttagtgaatcttgagcctcatttgggctcagggcagagcaggtgtttatctgccccggcatctgccatggcatcaagagggaagagtggacggtgcttgggaatggtgtgaaatggttgccgactcaggcatggatgggcccctctcgcttctggtggtctgtgaactgagtccctgggatgccttttagggcagagattcctgagctgcgttttagggtacagattccctgtttgaggagcttggcccctctgtaagcatctgactcatctcagagatatcaattcttaaacactgtgacaacaggatctaaaatggctgacacatttgtccttgtgtcacgttccattattttatttaaaaacctcagtaatcgttttagcttctttccagcaaactcttctccacagtagcccagtcgtggtaggataaattacggatatagtcattctaggggtttcagtcttttccatctcaaggcattgtgtgttttgttccgggactggtttggctgggacaaagttagaactgcctgaagttcgcacattcagattgttgtgtccatggagttttaggaggggatggcctttccggtcttcgcacttccatcctctcccacttccatctggcgtcccacaccttgtcccctgcacttctggatgacacagggtgctgctgcctcctagtctttgcctttgctgggccttctgtgcaggagacttggtctcaaagctcagagagagccagtccggtcccagctc

SEQ ID NO: 5254 - DNA, 1207 bp, Homo sapiens
ggcctgggggatctgggctgactgtgggggacacacggccattttgagcagcacacagaccagcaggccgtgctgcagccctgtccttcctgcagcctcggtgacaccatcactccacagctggccccatggggatggggtgaccacctgacccacctcagcatggggtcctggatgtgctgagcctcagctgcctggggtgacctcattggaaggggttggggatggcaggtccagctgtgtactggggaccctgaagctgagcccggggtgtggacttgagtgggctctttgtcttcccaaggtccttttccggcggcgttcatgtccttcacgagttcctggggcggaggacaatgcccgcaacgagaccctgagtaacagatacttgcagcccacccaggtctctgagcaggaaatccaaggtcaggagctggcagagctaacaggtgtgactgtagagttgccagaggagccacagcgtctgctggtgagttgaggagggactgtgccctgcctggcgtgcagcctgcacaggactttgtagacagtgggacatggcagtgcctcctctttcctggcccaaggggacatggagcctttgggagacaggggactgcaggggacggagcagctgcactgaggtggtgaccgtgccagtctgcaggacatctgcttcttactccctgtcctgtccttgctgtgtccccagagcctggatctccacaggcatagagtgggtgtcacagggttcactgaggactgaataaggctgcacagtctccatcgtgtgctcctaacagaagtcagggagcccttgcttgaaacagcggaagttttaaatgttcttcaaaattcttactacattgaacatatttcacagtaaatctttgtccagatttctgatcaagtatgtaaggaggcttctgggaagaagtaggatttctgagtcagtgtgtagaagtgcttttgtattacagaaacacacacatccagttattcacatcgattcactagttttgatatgacattgagtaggtgtgaaatctggacacacatttgtttttttttaagttctttccttcaggataaaataagatgatcctacctaattttttgtggacttttaaagaatgatttggtttgtagcatacaccagtggaacgtaggtgccatttcttttgtgatgctgtgtgaagtgaggaat

SEQ ID NO: 5255 - DNA, 1444 bp, Homo sapiens
ttcgttccagcccatgaaggggaaagatttgcagctttgccaaatctgaatcagttcccactcccccctgcggttttttagaggggtttatcctgtcgctaatgtcagttaaatagcttattcctgtcccacttgatttcactggtaagaatgagaatgaaatacttaaaggttttatttgaggggacttagctgccattttatggaaaaacatgtagtataaaaggtttttctccagggtcatttgacagaattctccaggtgttcagagaaagaggtcgccccaagtggcccagagtcgtgacagtccggaggggctggtgtggccggtgggcgctgcctcttcatctgatggagccaggaggtccgccggtgggggaaaggcttcttccgaggcttctgcactcgcctgggaagaggcccagtcactacaggaccctgagatgtccagaccccttatgcaaagaggcaaaattgttgccttggccccatcatggagtaacttaaaaatacatatctatcttccagaacaagccacacaacaacacacctcccctccttgagcctggcacacagcaccgggctctctgaatttggaaagtgtttcattttgtggcctactgctcggggcaggggggctgagccaggatgtgcaatagaagcaggggttgtcccctctgccagatctgtggggagctgcccaggccacccgtgcacctgtcctgcttcctgcagtccccactccctgcctcctttgagggactgggggacttggggtagggggacagacgggaaagggtctgaatgctctggcaatggcgagaagaagcgatcgccacactgccactctgctgcccagccaccaggatttctgcctggagccctttgccctgtccctgctgcctgaggtggcgtagagcagaggagaagaatttgctccaggccaggagcacaaatcgttgttcaatgaatttctctccaactcgaccttggtaaacggaaatgttgggggtgaagagaaacaatcactatttttttcttttttatctggtaaataattaaaagaaaaaccgaacacttgtcccgtctcctctttaggttttatcaagcgtcttgttccttggtgcgtccccacgcttccagcttctgcacactttggttctttctcttaaggccacaggagaatatggagagcctgaccgtgtgagctttaagctgcggcagctgctgctccatccaagtggccgctctcactgagctcccctggggaggactcattctttgaatggcctccctggttttagcagtgtgccattgctactgttttccattgcctgggctctgtaagtggcctaatttcttctgcccatgtgattgtatcatattttagtctggcactggtatttctcagcccctcctccagggatggtgtttgccacaccct

SEQ ID NO: 5256 - DNA, 1258 bp, Homo sapiens
cttagagggaacaatgttgaaaaattcagaaactttaacaaatttttaccatagtgaaaaactgctaaatttcaagtatttatatggatgtaactaattatttttataagtaaaatacacaaaagagaaatcagaaaaacctgtttttaaatgttaaaattcatggatagaaagcaaatatggataatcatcgagactttataagtaatagatgaacagtagttaaaaagcactttttaaagcagaggtggtatgctcctagtcatgatggaataacagactaaatttatacataattgaaataatagggaaaaagcacacaaaatataggaaagaacagttttccaacattgaaaaacaagtaaataacggcagtgatccccaagaatcagacatcaaagtaaaagagccctaacattgctctagcttactgcctggggagagtatgcagcataaaacagatcaaaccagtaggacctgggcgttttccctgagttgaagaggcagaggtcagggtttaagaaggctaagaattcatacttactggcaggggagataccatgatcatgaaggtgattttcccagcacgaggctcatccattgcactccggatgtgctgacccctgcaatttccccaaatgtgggaaattcaactgcataatttgtggtagtggggactgtgttagcactttcccctggtcttcatggttgaagaacaggtccaggccgggctcggcaggtcacgcctgtaatcccagcactttgggaggctgaagcaggtggatcacctgaggtcaggagttcaagaccagcctggccagtatagtgaaaccctgtctctactaaaaatacaaaaattagctgggcatggtggcacacgtctgtggtcccagctacttgggaggctgagccaggagaattgcttgaacctgggaggcggaggttgcagtgagctgagatcatgccactgcactccagcctgggtgacagagcaagactccatctcaaaaaaaaaaaaaggagaagaaagaagaaagaagaaggaggaaggaggaaggaggaaggaggaaggaggaaggaggaaggaggaggaggaggaggaggagaagaagaagaagaagaagaagaagaagaagaagaagaagaagaagaagaagaagaagaagaagaagaaggagaagaagaagaagaagaagtagtagtagtagtagtagtagtagtagtcgtcgtctaagaattctcaattcatgaggcaggt

SEQ ID NO: 5257 - DNA, 1441 bp, Homo sapiens
gcaaccttggaataaacagaatagagacccgactcctcactcattgtgtttctgagtttagtttcaatccaacagcggatctgtttttttactccatgtaatgggactgttgctgcagcttttgtacaagggtggagtgggtgtccatttgctgacgagcaccctgtgtacacgctagtttttatttgaacgaggtgctcttgtctttattatgtattgtctgcccataaatgatgtcttgaaatagaggggtgagcatcacctcatttatttcaacccatatttgtacagaaggatttttgtaatcaaatcatggggtttgtgtgtagaactcagtaagaagtaatcatgaccctgtccgttcatttgctctttgttctttcctgttattaacaatggctttggggcttttggggcgcatttagttctgcacgttgtgtatgtaagtagatgttcttctgtgggggctgcaagtccttaagttatagttggattcccttcccagcaaggaaccaacaggaaggaaaacgaagtcaaacccagtctttgcacgtggaagcttgtggcgtgactgttatttttttgtgatgttctgtacagccctgtaatctcttatttttggcaagccaactctgaatctgtggtcccgtagccccaggcaaccaaaagctgagacaaacagaggaagtgtcgttattcacatgtttctctggccacctcatcgggctggacgctgccggctgccacccgtcgctgagctggagctccccagagtgcagcctggccaggcagggactgttgaccctggcccctgtaggaagcacctctggcttgtcccccagcccccagggtccctgccactcattacttctctgcactctttctgtaatttgttcatcgcctggaatttatttctggcagactttgtggtcaaaactgggaagtgtctgtttccttaaaacagcctttcctcaaacccaggaagtgaagtagggagctatccttcctcacctcctccctgtcacatgcacatgggcatacacacacgtacacactcacccatgtgcacacacacaggcacacacatgagaaagggacggggaaagctagggtgtccaccccagcctgggctcctggtatccctaagggttttggaagaagagtttcagtttttcaaagcctgctggagatgtaactgtcgtgatgtttcgtgggatctgcaagagcctgtagcgtcaggtttctttccttttgattgggatgacatgaagtctgttaatgcgggatcgtttgtgttatctgctctgataggtggttttacttgcatttgatttttgatagaatgagagatgaattgatttgttcctgatacattctgttgggatacagtccatttgataggaaggttgtttacatcacagtgtcctgtatttgggggctg

SEQ ID NO: 5258 - DNA, 1202 bp, Homo sapiens
ctgtcctggcccctcacccgctcctctcttctcctctccctccaggtgctcagattgatgacaacattccccgccgcaccacccagcgtatcgtggcgccccccggtggccgtgccaacatcaccagcctgggctagagctcctgggctgtgccgtccactggggactggggatgggacacctgaggacattctgagacttctttcttccttcctttttttttttttgtttttttttttaagagcctgtgatagttactgtggagcagccagttcatggggtcccccttggggccccacaccccgtctctcaccaagagttactgattttgctcatccacttccctacacatctatgggtatcacacccaagactacccaccaagctcatacagggaaccacacccaacacttagacatgcgaacaagcagcccccagcgagggtctccttcgccttcaacctcctagtgtctgttagcatcttccttttcatggggggagggaagataaagtgaattgcccagagctgcctttttcttttctttttaaaaattttaagaagttttctttgtggggctggggaggggccggggtcagggagagtcttttttttttttttttttaaatactaaattggaacatttaattccatattaatacaaggggtttgaactggacatcctaatgatgcaattacgtcatcacccagctgattccgggtggttggcaaactcatcgtgtctgtcctgagaggctccacaatgcccacccgcatcgccattctgtagtcttcagggtcagctgttgataaaggggcaggcttgcgttattggcctagattttgctgcagattaaatcctttgaggattctcttctcttttaccatttttctgcgtgctctcactctctctttctctctctagctttttaattcatgaatattttcgtgtctgtctctctctctctctgtgtttcctccagcccttgtctcggagacggtgttttcctcccttgccccattatcttttcacctcccaggtctaccatttcatggtggtcgttgggtccgcctaaaggatttgagcgtttgccattgcaagcatagtgctgtgtcatcctggtccatgtaggactggtgctaaccacctgccatcatgaggatgtgtgctagagtgtgggaccctggccaagtgcaggaatgg

SEQ ID NO: 5259 - DNA, 1196 bp, Homo sapiens
tgaactcctgagctcaagtgatctacccaccttaacctcccaaagtgctggaattacaaaaggtgagtttttgttttgttttgttttttgtttttttgagatggagtctccctctgtcactcgggctagagtacggtggtgtgatctcagttcactgcaacctctacctcctgggttcaagcaattctactgcctcagtctcccaagtagctgggattacaggcacacgccaccatgcgtggctaatttttgtattttgttagtagaaacggggtttcaccatattggccaggctagtctcgaactccttacctcaagtgatccacccgcctcggccttccaaagtgctaggattaaaggcgtgaatcaccacgctcagccaaaaggtaagatttaagtgaaactagttccacattgtttgtgtgggtttgaataaggcaatactttctctttagaagtaagattgaggctcagggaagttgtaactcacagaccctactcttccaccttcatcacactgacatctccttatttttctcagtagtttagccttccacagtgtgtgccatgagctatttctctgtctctgtacatgtggtttgttttacccatattattaaaattactagaaacaaaattcaaaaccagcctgaaaaatcatatacccttataggcctctaagcattttcgtccttggcaactcaggcatctctttataacttctccagttgtgaatcttcaacaacatagatatccatataaacccaacaatggaaaaacaaatatacaggcagggtgtataggtactgaatgtattttgtgctgttctattccccttaaagttactctgaattctttaagtgttagtcacacatacacatctgcccttaatagagcaaaatgcttcactagatttgtgggtcctgtttttttttcattgacttccattataatgtcagaactgtttcctgttagaaaaatatttggcctctaagcctaataaaagtgcacttgtgcagctgatcttttaaaactgcaaagttaatggaaaaatcataactttctcagtaaaatagtaatgagactttacatattggcagtatagaaacaacaaatatatagaatcttcaggaaatgaatttgtatggcttgccaagtttttaactaactgatggtttttactgcataaaaacttt

SEQ ID NO: 5260 - DNA, 1185 bp, Homo sapiens
agaagttcgagatcaagcagccacatctggtgggtgccttcttgctgcatgatcccatggcggaaggcagaacaagagagtgtgcatgagagaacaagagagcttggcttgcagcctcacatccttcaataatcaacattaatccattcatgaaggtggagccatcatgagctaaacacctcttattaggccccacctcccaaaactgttgcactagagattaagttttcacacatgaactttgggggacgtgttcaaaccatagcagaagcctaccacaattaactgataaaagtgtatactaatttagtctagcataaagagacaggccaggcgcagtggctcatgcctgtaatcccagcactttgggaggccgaggtgggtggatcacctgaggtctggagtttgagactagcctggccaacatggggaaaccgtctttccaaaaaatacagaaattagttgggcatgatggggcatgcctgtaatcccagctactcaggaagctgagacaggagactagcttgaacccaagaggcagaggttgcagtgagccaagatggtgccactgcactccagcctgggcaacagagcaagattccatctcaaaaaaaaaaaaaaagacagtgggatactatttgttaaataatatgatattgctctttttgtagactccaaaacgtcagttatcagcaatttgagatttaatctattacttcagatgattacagattctcaaagtgcttagtcgcacatttgttttttggtttttaaaattcaatgaacatttagagagtatcacatgctattgaactatactgagttctagagatgtgaagataattaatgtggtcttgctatcaaggaggttatggttagaggagggtagacatttaaacaaatatagtgttagagttgctaaaatggaagcaaagagatggctgtcacgcatgcagagtcagggagagcctagcaaaggctgcataaggtgaaaagggtcagtgacttgaacaagtgttttttcatactgtaggaagtagcccattagtagttcatcagaccagtttagggtgtcatatcttgtgacagttactatgggactgaacgaaggtggacgaacgcagaaatgaagacaaagacaaaaggatctttttaaagaaggggtcgggagctcctgctagtgag

SEQ ID NO: 5261 - DNA, 1159 bp, Homo sapiens
agcactctgaatgtttaattatgaaactttgtagctataactggaaaattacctgactctttgtaagagtattaaatacaaagtgatttttctctagaaatgtgacctggtcttttataaagcccactcttagaccaggattatctaatgccacatcagaagcaaacaggcaaatttaaacttgggcaagtaatttctgtgcccaatttgtaaagggaattcctgaatttttttttttttttaatagaggcatgggtctcactgtgttgcccaggctggtctgaaacttttgggctcaagcgatcctcccaaaacgctgggattacagtcatgagccaccgtgcccagcctaattcctgacttctctatacagagtcttcacttgataggcactcgtctgtagtaactcagtttgaatatctttagaaaatgtttagaatttatttgtaacaagatggtaaggaataagattatcccatatgcatttctgtagagcagaatttgatagcttagtgttcaatctttttgaaaataaatgtttacctgtcatcagatttaattaaaattatacttagtaattgcactattacttagttaatttttgttgtatggaaatattggtagtactactttgggaacctgttactgacaattgatgtcattaacaaaatgcctagttggattagatgttttcattttctaattttttgcttgtttaaaatgcaccttacttgttctgagatacctggcaaaagtctttacaaaatgtatggtaatagaaccaaggttagtaaatatacataggctggtggatgagagaccatggaactgtgtaaatacacttaaatgttcacacatttttctagtgtaattcttggatactttaaaaagcaaaacattgttcaaattgttttgattctgaaaaatcattcaactgctaactggcaataagactctaggcaagtcgttttccagattgtaattatatgtagaaactattcatctgcattcattttatttgcctgtaagttaacatgtttccaaaatttaaaagcctgggtccccaaaagaatgtggaagtattaaaatgtatgtaattatgcaaacattttaatgctattttctgcacttatttcttttaaatattttatttaaaatt

SEQ ID NO: 5262 - DNA, 1102 bp, Homo sapiens
ccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgaccctgaaaggaacactggcttgaaggactgcagacaggctctgaggggcacgccctcctcagcgagaggcagcaaggtggccacagtgtcactggtcaggtgcttctcaccacgggaaagccgccgacctgtgactcgcttgagatgggaaagcggcgccacagaccccgggtctccttggctgtctgtgggccgcccctggccaccttgtcctggctcgcagggtgcaggagcgcctcgttctctgggtggccggcttgctgctccggtttgggctgtcttaccataacaccgtcccagggctctgcaggccactgtgagcgctggctccctgggcagtgctcctccgtgtggactgtgcctcaggccagggctcaccagctggggtcctgtccggaaggatgggatctttctgggagctgcgccggacagagtggggagctcctagtttgtggggggaagctttgatatccatgccacgtccatccaccccaccccttttcgtcacgagcacaatggtcttacattggatttttgtaaaaaaataaaaataaatggagactttaactcaagcagcttggaggtcttttgtggttttcctcagcaagtatggaagagtgacctgagagaaggcacctgcttgattgcttgattccaggtcgccacctgtgtatgccagctgggcctgctcgcagaagacgatgggaggcagcctgaccaggccctgg

SEQ ID NO: 5263 - DNA, 1275 bp, Homo sapiens
tggagctggtttctagttctcacatttagtcaacatctagaaagcgctgcggaaggctctggttctctagggacttgaaggcgccaacagagtagtctccatggtgggcctgtcccagccctggctgcgaggacaggttgtctttctctccccagttggcgagggacacgaaggctgcggccgggctggcagagggcccggcccctggggggaggcactcctccagggctctccctgtccttagccgattttgagggaaccctgtggcacctgtccctggatgaagagctgtcacctctgccttgccctttaactcaacccgcttcccagcacagcggctttctttttaaaacctgtttcactgagaagtttgtttttgggtccgctggtgtcactatggcctgggtgagaggccagcactgctgctgccctgaggggaaacgcctgggccgtgtagtggggacgctctgggaatggtggcggacgggcagcgtgggtgggacctggcacttcgtggtggctgagccatccacccagcagcggcctcctgtagcaccatcttgggaaagtcctgggggacgtgtgtgtcgtgctttttaccatcggtttgacttacagtggagtagaacgagccagagttcctgacttgagcaggtggatttgggcccaggccctgttcactcttgcttctcggtgcggactaatgtcagcttgtggctgggaaagagggatgtgcagtgacgtggtcaccaaggcagtgagccccgctgaccccgggccagcacttggcaggcaggaggtgcggtctccagagtggtgggccagggcgggctggcctccgtcttctatcttcttttcttgcctccctgaccagcagactcacctcccaagaacgcctgcccgcccacccgccttaggactcccgatgcgctcctggaaggccccaggagtggcaccttagtgtgggtcggcccgcagatggcacccaaggccgggaagggcagtaactgcacacgcggcgctgtcagagatgggggtgggggatgcttctgggggccctgcctccccattgtgtgcccagaacatccctggccccaccccgccacttccctcgggcccttatgaaggactgaggctccagggtgagaaggctcacttctgccccgggcactgcgtccagcagcagaggggacagggggcaggtgtgtgactgggttcctgggtacccaggcctgaccagagggagcgggagggcagaggtgaggagggggaaga

SEQ ID NO: 5264 - DNA, 1299 bp, Homo sapiens
acattattacttaatagtgtccctaagaagcgaaacttgagtcttgacagtgaggagtcagtccgacacacccagcggctatgcattctgtagaatagtgggccggcacccttccagttcagcagggtcaagcgtgacaaggaagggccaaggagctattgcagattagagtagactagagaaacgtgacaactaaaggcagtgtgtggttccgggatggggaaattgaaaaatttgaataagggattttatattaaataatagtgtattcctgttaaatttcctagatattactttcaacttacttgaaagtggtttagcaaaagtaataatgtgtgtgtgtgagttgtgagaaagagaagcaaaagtggccaaatggtagcagttggtgcgtcgggatgaaaggggtacaaatcactcgactgaatttttgcaacttttcttgacatttgagcattttttaatacaaattttaaaagtaagccagccaggatcatcatgctctatacttttcaggctaaggtgattgtggccacactgtcacactccattgtcttttcagggcagctgtcatagtagaactttgctggtgactggcatgtgccctttcagcctgagccaaggtggtttccttgaaagagttttcatgtttctggagaagagagaaacctgtttcctctctgtcttctctccaggtgaaagcagaagcctcctgggactccgcggtgcatggctgccctcagctcagcaggggcacgcccgtggacgagcggttgttcctgatcgtgcgcgtgacggtccagctcagccaccctgctgacatgcaactggtgttacgcaagagaatctgtgtcaatgttcacggccgccaggttagtcttcagtggaagaaacgactctaaccacagttgcgacctgagggtagggccgtgcagtgcttgctgttaaccttctgtccaaacaggctcccggaagcactgagcttttcttttccaggtgactgctgctgtcctgtacccatgcttgcttcaagcctcagatgtgtcacttgctcctggacagtatttttacactgaatctttcttagggcagattcacaaattatggttattcttttgggtaccacacaaccctgtcaagggcaaggtctgtggtttggttgttgccttttcatctgggccctgtcaaatgaggagtttccctcttactctgctctttccagacttttttttttaagatagagtcttgctctgttgctcaggctggagtacagtgatgcgatcatagctcactgcagcc

SEQ ID NO: 5265 - DNA, 1177 bp, Homo sapiens
caggtcttctcgaagtgtggaagggcaagagagcatcagtgagctgatggtggattgcttacatcggattccattggtatgaatttcccaaactggaaatcaaagcgccagggtggggttggggctgactgctggtgagggggctggccgctggctcccgtgacgtgcgtcatgggcacgcaggcgccattttgaatctatcgtcggcacgtgggtgccattttgaatccttagttgggcctttctaaatggagaatggctttggagggagacacgttttctgtggggagggtttgggggggagggaggagggaacaagctacatgctattttgtttgtagtattgtggaacagtcttgttatggagtgccagcttagaggttgttgcaaacttgtctagaagtgagagcatggttttttttagccctttgagagtctacatctaatgaacattcttgctcacccataaataacgtcaagcctcaatgtcaccgtcacgttgggatactctttctcatctggcatcctagacaggacaaggttggttacctttccttccatgaaccatgaacctgtgacggcatcattcatcctgacttcaccaagctccgcctgtgggtgaggccagagctcccactggcaatttttagaagagccagaggctccctgcttcctctagaaataacagttcagggtgaagcatggagggtttcagttcccagacaatggaaccatttagagacaacacagttggacatttccactttttccttgattcctggaagtccagtgggttctgcagctgaaaaagccctgggtcccagcagcagagagacaggacagaggggatgcttgggcggggagggacggtaacctgcagaacagattccatttttatagaacgagtacacgtttgctaaaacagtcctgctttcccagactggattcccaccacagggacagtcggaactcaggactagctccagcgacatctttcctccgaattcaagccttctatcacaatgtcaaaacagctatttataaagccattttcattgtacttgataacagcacgagtcccaaaacttttagaaataaaataggacattggcttgattgaaaagagggactttttaaaaattgttctttcgtcagaagccttttggatgacttacaa

SEQ ID NO: 5266 - DNA, 1117 bp, Homo sapiens
gacggatatatagcccaagtaacatttttttttttcttgagacggagtcttgctctgttgctcaggctagagtgcaatcacgatctcagctcactgcaacctccacctcccaggttcaagtgattctcctgcctcagcctccttagtagctgggattataggcgcctgccactgcgcctggctaatttttgtatttttaataaagatggggtttcaccatcttggccaggcgggtcttgaactcctgaccgcgtgatccacccgccttggcctccgaaagtgctgagattacaggtgtgagccactgcgcccggcccccaagtaacatatattaaatgaaaaaaatgtttgtttctaatagtctgtttctatttttcttcacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccattgtggtactccttgggatcgcgtttgtagtctataagctgttcctgagtgacgggcagtattctcctccaccgtactctgagtatcctccattttcccaccgttaccagagattcaccaactcagcaggacctcctcccccaggctttaagtctgagttcacaggtatgtttccctcgcagtggccataaatagagcgggtgtgaggttagtgcatcctgtgcttggttctgaaatagaaaatcgttgcattgggaaaccaaaggaggtttgtcttctcattttgttttttactttcaacttcttttacctcttctgtttggctctctcccaaggtatattgtggttgctatgttaatgcctgattggccgggcgcggtggctcacgcctgtaatcccagcactttgggaggccggggtgggcagatcacttgaggttgggagtttgagaccagcctggccaagatggtaaaacgccgt

SEQ ID NO: 5267 - DNA, 1292 bp, Homo sapiens
atgaatagaacttgctactttttttttttttttttttgagacagagttttgctctcattgcccaggctggagtgcggtggtgctatttcagctcaccacaacctctgcctcctgggttcaagtgattctcctgccttagcctcccgaatagctggaattacaggcacgcaccaccatgcctgactaattttgtatttttagtagacatggggtttctccatgttggtcaggctggtctcaaactcccaccttcaggtgatccgcccacctcggcctcctgaggtgctgagattacaggcgtgagccactgtgccagcttgctaattttcacagaagttgatggcaattcttcacatgtaaacagtgccagtgcacagaacctttatatattttttgaagccagtactgtgctctgcatataacaaagctgcttcaaggatgagacctttttctaaaagcatgtaatgtgagaagccggcctgccttattttcttttttcttttttaatgattaaaaatagtttgtggcaaggcacggtggctcaggcctgtaattctagcactttgggaggccgaggcaggaggattacttgagcctacaagtttgaggccagcatgcacagcatagcaagactgcatctctacagagagtaaaaaaaattacccgagtgtggtgatgtgcatctgtaatctcagctacttgggaggctgaggtgagaggatcacttgagcttgggtgaggtgaggctgcagtgagtcctgatcatgctgctgcactcaatcttggacaacagagcaagaccctgtctcaaaaaaaaaaaaaaaaaatatatatatatatatatattatttttatgaggtgaagtgcatcaaacttgggaaagatttgaggaggctgggaacctcctggaaaaccactccttgaagaaagatatgagagacatttagaagtgattcctgctttcagaaggaggtggattcaaatacatcaaaagtcccttcctctgctaagtgtttatagttcaatgaataatttcaatatttgtatgtgttcttgtcattttatttttttctgaaaaacttccaaaaatttgaaaataaaattacagccttttcttcttataaaatttgttactgtgagctttaattggtacacaggaaattggtttattttctaaggatatttcacattggagaatcagttgcctgtgcttacgggggtgaaaagagagttctcgtataaaaataaagatcgaaggtataaaagaaacatttagcagattaatgattgag

SEQ ID NO: 5268 - DNA, 1200 bp, Homo sapiens
gatgtgcccttgtgtaatgtggttggtgtttatttggcttggagttcgttgaatttttttgatctgtgtgggcttatacctttaatcaaatttgaaaaatgtcttcagatcctttttcctcccatcctgttattcttttctctttctgggactcttagtacacacaagtttgattgcttgatactgtgtcacaggccactgaggctctttcctttcagtcttttcttctttcttcctttttttctttctgtgcttcattttgaatagcttgaatagttttgtttcctgtcttcaagttcacttatatttttttcttctgtagtgtctggtctgtttataccatcctgtgaatttcttttttagatactacatattttgtttatctctagaagtcccatttggttcttaatttttttttccattttggctctcattattcatgtttctttcaaaattcttgaacatatttagcatatttttaatagctgttttaatgtacttgtctgttaattccattattctagggtttttttctttctattggatgatttttctcctgattatgggttatattttcctgtttattcctacagctgttaatttttttttttttaattaggcattgtgatcttactttgtggaatgttagattttattgttttcctttaaagaaaggaactttgtcagacatctaagttacctgaagatcaactttatgttttgaagcttgttttcaagcttgatcagggaaagtctacgtttgcctttagtctaaaggtaatttagccctataataagatgtgacccttctggagtctttgtagactgcctctggtgatcaacgatctcttctctgacttttcagaacgttaatgcctcttacctttgtgtaagtccgtcctaagaatcattcagcttatggttgtttgcccagccccatagagttttagtctatgcatgcttgtcttcgtattctgcaaagaccaaaggagtcccttagggagatttctggagctcttttcctgcctagcttcctcctctccagaactctgccccgtgagttccaggtccttcagcttccagggctctgaactctgtctccccaactcagtgctctccttgggattcttctccctgttctgttgtctgcaatgggtcccaggaagaatgtggggcaactgtaaggttcacccttcattt

SEQ ID NO: 5269 - DNA, 1198 bp, Homo sapiens
cttcacctcctgggctcaagtgatcctcctgcataagcctcccgagtagctgggattatgggcgtgcaccaccatgcccggctaatttttatagttttagtagagacagggtctcaccatgttgtccttgctggtctcgaactctttacctcaagtaatccacccgccttggcctcccaaagtgctgggattacaggtgtgagccaccacacctggccttggatttcatgatttgactgacatcttttacacaaattattgccatttttttattgggtaccaattattagtattgttttctttattcgttaaataagaagtaaaataacttttttttaaaaaaagaacttttttcctagtaaaaagcttattttcaatttttttattgcttaaattttgcaggttaattaaggctgtgcttccttttcctactttctgtttaaatgtttggcattttttgagggttttctttctatggatttttgtgggggatcccatcttgttggacacttggttcctggagattgccaaattattgaaaagtttcctcatacccaaacattggcagtagactgaataaataacatctctgacactatttttcaattatatagagaatgctatttgtaaaatactgatttatttaaagatattacagtcagtagttttttgcaatctttttaaaatcagtggatgtcaaaaacagctattgttctttgtacagcatttttcaacattgtgaagagttcttatactcaaaaagtttgggagacacagtttgatattgtttaacctgagttgaacttgtcattttgtattcttgtttagagcagggattttattttgtctctttatctaactttgtattcctatttctttctttctctttggttctttgtttctttgttcattcttctctctctcccttttttatctatcatataaatatgtaaatatatattatatatccattagggaagaggaagctgtctaaagatatctagtatataggagctttgttctgcagaaaagaggatatgaagtcaattatattggaaattaatgcttaatacttttttttaaagcatttatctcccaatgataatgaaaacgatacgtcctatgtaattgagagtgatgaagatttagaaatggagatgcttaaggtatgtttacaattataaaaacattacttcaa

SEQ ID NO: 5270 - DNA, 1214 bp, Homo sapiens
gtccaacaatcatctactgtccttctagaaaaatgacacaacaagttacaggtgaacttaggaaactgaatctatcctgtggaacataccatgcgggcatgagttttagcacaaggaaagacattcatcataggtttgtaagagatgaaattcaggtatgaggatcaatcatcattgctctccgttgctcatagtggaagtggatatttctcaaatgtttatttaccagatctttattgaatactttctttgtgttgaacataaagcagtccctctgataaatgtgggagaacaaacttgcagattagtataaatagcaatctgtacctagtgcttaggtgcacagaggagggaggaatagctctgtcaaggtagttgtgtaatgggggtggtccatccaggaaaattcaattagagtccaaacatgtaagtagaagtttttcaagtatgccaggccagtaggtgatgaggggaaaggaattggttatagaattccaggaagaaggactagcaggtgcaaagacactttgatatgagaacacatactgggttcaggaaatgtgactggtatggaatggttggagggaaagacaatgtggggtaggaatggcacaaagtatggacaaagaggcagggtggaaccgttagagacttgagagaacagttgaatgggtcggttggccaggttatagatggctttaaaacttgcaaagaagcagtctgggcttggtatcatatacctgttagttttcactgactactttagccttagaatttttagtttagatacaattttctgtaataggtaaaacggattaaagtagaataactctggctgaagttaatgtgagggaaaaggaggtacaagagtctcgtctctagaccttgaagacactccctgttggggtcttataatccttggagtgccgcagaatcatttgaaaaccatcttgatgtactactctgtgtttttaaataagataataggattatagaaacattagactggcagcaataagttggattgatttgaagaagagaaactgaagaagggaaagggtatcgatgcagctattgtgaaattctacagttgagattcctgacctgattggactggctcagtgggtgtcatagaggatttatttgggaggatttaagttcaaggcacatgagtaggtttaagtcaacaacttgacactgtcaacatgaaatcc

SEQ ID NO: 5271 - DNA, 1175 bp, Homo sapiens
atatacacgtatacacacatatatacacatatacacatgcacacacacatacacatatgtacacacatacatatatacacatacatacacatttatgcatacatatgcatatgcatatacatatgtacacacatatacatctacatatatgcatatatgcatatacacacacatatacatacacatatacacatgcacatatatacacacgtatatacacacatgtatacatgtacacatgtatatacatacatacacttacatacatacacatactgtaatttatatatacatatacagattgagcatcctaaatctgaaaaatttgaaatctgaaatgcccccgaatccaaaactttctgagcaccaacgtgatgttcaaaggaagtgcttattggaacattttggatttcagaatttcatatttgggattctcaatggtataattcaggtgttccaaattaaaaaaaaatccaaaatctaaaaaactcctggtcccaagcatttctgttaagagatactcaatctgtatgtatgtacatgtatgtgtacacacacacacacacacacacacatacacctcctttgtgtgtactgtactttttttttttgctcctctctcccttctctggaagcatatagaatcttctctgtttcaccagtttggaaatttagtaataactgctttggtgtgggtctgtctccttttactgaagtgggaacgtaaatgtctggttgccaggaagcctacaaaacagtctttaacttggtgacttttttgggactcacagatctacagagtcatgcacttaattttgtcagtacacttaagagttggtttttctgtctgggatggacttaatctccaaccaaattccaaggagacttctggtttgaccttctatacctcagatcctgttactctccagtgcccaaaactatcagtgactctcatggagaaccgaatctatgctgtttattaccttggcattcaaggctctgtgtaatctgactccaacctaccttccaagctcaacgcctctgattctaccaactaaaccttacattcaaaagtcaaactggaatagtccccatttgaggcataagtcagaaatattcctaacttagcaccattgttcatatagttctatgtcctagattgtccttttcgtatt

SEQ ID NO: 5272 - DNA, 1261 bp, Homo sapiens
aagaaagggaaaggggactctcagggagtaaaagagtcttacacttttaacagtgacgttaaaagactactgttgcctttctgaagactaaaaagaaaaaaaacttaaaaatttaaagaaataaacttctgagccatgtcaccaacttaaccacccccaggtacctgcaacggctcgcgcccgccggtgtctaacaggatccggacctagctcatattgctgccgcaaaacgcaaggctagcttccgccagtactgccgcaacaccttcttatttcacgacgtatggtcgtaaagcaataaagatccaggctcgggaaaatgacggagaggtggaactatagagaataaatttgcatatataataatccgctcgctaattgtgtttctgttttcctttgctaaggtagaaacaaaagaataatcacagaatctcagtgggactttgaaaatatccaggattttatacgtgaagaatggatgtatcgcattacggtagtcaccctatgtgtaaattagtggcacatacttggcactccttaatgtcaactataagatgatccttttgtagttcatgagcgtgatgattgggtgttcatacgcttgtgtgagatgtgccacccttgaaccttgttacgacgtgggcacattacccgtctgacctgaacttcaaggatcgatttaacacttgtatttgtgggcttgttacttatgataacaggtggcctagtttcatggctttgtgtttaccgttttcgggtgcccttttttctggctgtatgctacacgcacgggtgcttttccgttgtccaactgtgtaatgtgtttttgtgtttgttcttttgtgagtcggagtctcgcgttgtcgccaggctggagttgcagtgttgcgatctcggctcactgcaacccccacctccggttttcgagagattgtcctacctcagcctcccgagtagctgggactataggcgcgcgccaccacgcccagctaatttttgtataaatattggcaaggatggtctcgatctcttgacctcgtgatgcgcccgcctcggcctcccaaagggctgggattacaggcgtgagccaccgcgcctggccaatgcagagctttttaatggctttaattttttaggtttgggagatacctgcgcaggtttgttacctggatatgttgtgggatgctgggatttggagtgcagcttagcccgttttcattgccccctctagtagaccacagtgtctgttgttgccactttt

SEQ ID NO: 5273 - DNA, 1101 bp, Homo sapiens
tcccaaagtgctgggattacagttgtgagccaccacgggatattcttgttttgagagacaactggagcagcgtggtctgtctggttagagattaccattcctcatttgttctcaggtgtctggtgaaatggctggaagttcgctgtgtctgccccatgtgtaacaagcccattgctagtccctcagaggccacgcagaacattgggattctattggatgagctggtgtgagtgctgccgctacaccgagacctggagaagacctcttgcctcatggatgtctggtccctctgcacagctccaaccaacaggactgtagggtgatgacgatcactttcccagtgatgagaagggtggtctaggactgggcttctaccctcagtgcaagaccagtgccagatgtgcccccacttcctgcctcctgaagccttcttccctgctactccatgctggtggcctcacccatcaagaccactgtctcctggtactggactatctacctgccttgtccctgttctgggggaaggtgtccaccccgatcaagaacatggagaaagtcctctttcaaggctcccattaggaggatgagctgccttgacccagaagggatgagacgggctcttacctctctacaaccttccctccccttcccactccttccggagtaaggttagaagggaaggaaggaaagatcaaggaaccaagcgcctccacgggaggcgagggaggctctgtatgaaacagaagagcagggacataaaggaaaatgtcagtgtttacatgggacctatggaaacaaaggctggcgggcgccagctgactccagagtaagagagggcccttcccctgccaggacccacggtgctatccattcagtctcttcctcagttaatctcggagcttcctattccatgttgaggtttgtgggcccctctagaggagggctagttctatacttaaattgattcccaggggccttttttttttttttttttttttttttgatcaaaaggggtgtggggatgggggtgtctacggttaagcaacagatacctccttccctttgtaaatagtatttttatacttcatcctcgcctctcag

SEQ ID NO: 5274 - DNA, 1209 bp, Homo sapiens
gaagcaccattagcataaatgtctgtagcagaccaagaaagaggcttacttctcccaggcccttcctggtcagggagagcctccgggttgaagagcgtgggtgccttggctgccagctgtcacgggtggtgctcctgctggcctggccgccccctggaaatcaggtccccaggagtgctgccccctcagcccagatgctgcagtctctagaagaaagcaggagggatgcactaaggtctactttaggatgcgtctttcctgctcactcccctatacacactcacacacactcacacgcacacacagtttcacacacacactgacactatcacactcactcacactacacacactcggacacactcacacacacaagctcacactcacataccctaacacacgcacacacacagtttcacacacacggacactatcacactcacacactacacacactctgacacactcacacacacaagctcacactcacataccctaacacactcacacacacacatattcacatgcccacccacacactcacacacctacagtctcacacacacacacacaactgcacacacacgcagtcacacacttttggacacactcacactctgacacatacgctcacactctctgacacacacattcacacacccacacactgacacacacatacactcacagtcacacacacactctgacacacacattcatacaccaacccccacacacgctcatactcacactcttgtgtgcacatgcccgacctccggaatcacagtacggcagggccccgaggcacttgggttcacccgtcacagctttctcatgggcacctggactgaagaagggaggggacttgctgagggacccatttctagttagagatagggttggctgcaccccaaatcttaatcttgggcttagaatggtgtctgggattctgaaggtgctgttttacttctttcttcctcagccaatacatttcggcccacagatgtgactaaaccccgtacttagagatttattcattctgactcaagcttagctcacaattatacagcaaagtctcctgggagggtttatatgttaagctctgtcagtaatttctcccctagcaagaatgaggaagatgaagagctcgggtatctgagggctggtgtgtctgcatgcgtgtgtgttttgggggccgactgaaggaag

SEQ ID NO: 5275 - DNA, 1202 bp, Homo sapiens
tttgagacggagtcttgctgtcttgcccaggctggagtgcagtggcatgatctcggctcactgcaacctctgcctctcgggttcaagcgattctcctgcctcagcctcccgagtagctgggattacaggcgtgtgctatgatgcctagctaatttttgtatttttagtagagatggggtttctccatgttggccaggctggtcttgaactcctgacctcaagtgatctgccggcctcagcctccgaaagtgctggaattacaggcatgagccaccgtgcccagcccgcaatgtgtcttaaaaaaaaaaaaaaatagcccatccctccctagaagccatcaagaaaatcctttaagaaactgtgaatatgtatagattattttttcactacttcaatttacataaaattcaccacccaggaaaaaatgctcgagtcaggttaagacctagagggggtagatttgttgtgtggggttaatgtgtagttttcagtccttgccgaggcagaattgcctgaatgatcgcctctctctcctctctctgcataacactcaaaccctaatggcaacaacatgaaataatatctcactgggtaactatttacattttttttttttttacaagctgtaagaactctgaaaagtctgcctcatagagaacttggttttcctccctggcgcttaatatctttcagcggctggcaattactgctttggccgggagccctgatttagcacactgcactcagggcacttgaaggcgcttcctctgtctgccccatcccccggcttcagacacagcctggggcacgagaggggcaccagggaacagtgggagcaagcaggctaagaccaggacagccagccctgcaggaagcccgccccaccgatgactcaagaggctccctcttctacattctcacagttggtattatgttctattattacacctatcacatggcatctgccactatttgcttccttgtctgatctcccactggactgtgaatgcttcttgttttcctcatcctctttgtgtacttattgcctaacagagcggttcaccatcaccacagtagccaacgttgagtgccaaacgctgttctaagcactttgcgtgcattctctcatttaatccttgcagaaaccttaggagatgggtcctatggttacttccatttcacaggcacagaaaggttaagta

SEQ ID NO: 5276 - DNA, 1175 bp, Homo sapiens
ctacccgctggtgtaccccgggcacccgctgcagcccgccgcgctctcgtccagcgccgcccaggccgcgctccccggccacccgctctacacctacggcttcatgctgcagaacgaaccgctgccgcacagctgcaactgggtggcagccagtgggccgtgcgacaagcgcttcgccacctcggaggagctgctcagccacctacggacccacacggccctgccgggagccgagaaacttctggccgcctaccccggggcctcgggcctgggcagcgccgccgccgccgccgccgccgccgcctcctgccatctgcacctccccccgcccgccgcccccggcagccccgggtcgctgtccttgcggaatccacacactttgggcctaagccggtaccacccctatggcaagagccacttatccacagcggggggcctggccgtgccgtccctccccacagccggaccctactattcgccatacgcgctgtatggacagagactagcttcagcctcggcgctgggataccagtaactacagctcttcctccaccccagccccctcaccctcctccctctccctcctcctccctccccacctgccgtcgccgctgcaacctccactactgcttgaccctgccgggattccccacccagcccttccccaccggactgtgtatttatttactataatgttagcttacaagctgggaatataagtgcattaacggcccacatgagtcaatggtatgcaaaaagtctgtgttctcccaaataataatattaatcccacaaataacgacatgatccccgcccctgttcctttctgttattttttcttagatataagttttacattttttattccttttcctctttttttggttttgattggtttggtttgagggagagttggggtctttgggttcttctagacgttttgttttcccttcctggggagtttcttgcatgagtcttaacttaaaactacgtttccgccttctctttttccctcttcccccttcattccctcttgtttccttccatttgcggttctgtttttgttttttgttttgttttgttttgttttttcctttgttgtacaagtaacagagaggaggttttttttgtaactcattttgggggtggagggggccacctgggtggcaggggcc

SEQ ID NO: 5277 - DNA, 1141 bp, Homo sapiens
aggcagatgctgagtgctacactgctatgaaaatagccgaagccaataaggtaaagaccccgcacagcctgataaaaaggagtctttgggtctgggtctgtattgcaggagagtttccagtgttgagcgcctgccaccacccaaagcccttcatgggcagaactgaggatgcctttgctgtgtggtgcaggtactttccttctccttggacatgccttgatagaagtttagtttaattttgtgttaaacatggaaacttttaacttttgcacctatgctccaagatctgagatgactgtctcttacagaaatgtaacaatgagaccacaaaaagtaggtaggggcataaatataggaaaattgaaggggcaccactcccctccttctctaatatggttcaacataagtcttccatactttttttttttttaacagctgaagctaacccctgaatatctgcagctgatgaagtacaaggccattgcttccaacagcaagatttactttggcaaagacattcctaacatgttcatggactctgcgggcagtgtgagcaagcagtttgaggggctagctgacaagctaagctttggcttagaagatgaacccttggagacggccactaaggagaattgaaaaaaacttgatatgactgcaaatgatacttaagcagatctttattttttaagatgaatcagaatgttcctccctccccgactaccttctctgactgtcttccagttactgtggtgaaaaagaagaaatgaacttaaatccactccctttctagggaaaggagggtggggactgatgatggggggttttatttcaggtaagcagtttatatgacttccaataagatttgtaaatcatgggcttgacctttgacctctagacactaattttatcctttgaggctggcttaattagggatgctgtcattaaggagagggagaaatgtagagtgttacctccaactcatttgatttcccttacttgggaaaatgcagtccagtgttctcacctctgcctccaaggtaggagatgtctgtgggtgaggctcagcaactgagcaaatatgtgcctgtgagtttgccagtagagctgtgaagaaacagctgcagagaacatttgaccttcc

SEQ ID NO: 5278 - DNA, 1164 bp, Homo sapiens
agccgggtgcagtggctcacgcctgtaatcccaacattttgggaggctgaggcgggcggatcatctgaggtcaggagttcgagtccagcctggctaccatggtgaaaccccatctctactaaaaatacaaaaattagctggacatggtcacgcgctcctgtaatctcagctactcaggaggctgaggcaggagaatcacttgaacccaggaggcagaggctgcagtgagccgagatggtggcattgcactccagcctgggtgacagagcaagactctgtgtcaaaaaaaaaaaaaaaaaaaaaaaaaaaaattctgctctcatctaccacttcccgaagagaaagcatgagaatgcatgcattgaagaggctgctggtagcagagaggagaggccagttcatggggattgtgaacattgttgcagttgcttccattcaaaggtaactcctcagcctttctcctttcaggtggtataagttgaaatccaaaccaggaaagaaggacaaggagcgaggagaaattgaggttgacatccagtttatgagaaacaacatgactgccagcatgtttgacctttctatgaaagacaagtctcggaatccatttggaaagctgaaggacaagatcaaggggaagaataaggacagtgggtcagacaccgcctccgccatcatccctagcacgacaccttcggtcgacagtgatgatgagtctgtggttaaagacaagaaaaagaaatcaaagatcaagaccttactttccaagtcaaatttgcagaagacgcctctttcccagtccatgtctgtcctgccgacttcaaagccagaaaaagtgctgcttcgtcccggagactttcagtcccagtgggatgaagatgacaatgaggatgagtcctcctcggcctcggatggtgagtttctgcctcttcctgcttgacctctcttcttcctcttaccatgcttcgttctgagagagaagaaacagacaaatctcaagagaaagagtttaattcaattcctcaattacaaaatcatggtggtggggatgatgatagcggtggttaagatgccctctctaaggctaggcgtggtggctcacgcctgtaatcccagcactttgggaggctgaggcaggcagattgcttgagcccaggagtttgagac

SEQ ID NO: 5279 - DNA, 1198 bp, Homo sapiens
aagccagaagattggacagcccactatagagtctatagtgtgctgtgttgccaggtggttttgtccaactgtaggctaatgtaagtgttctgagcacatttaaggtagggaaggctaagctataatgttcagtaggttaggtgtactaaatactttttttttttttttttttttgagttggagtgttgctctatcgcccaggctggagtgcagtggtgcaatctctgctcactacagcctctgcctcccaggttcaagccattctcctgcctcagcctcttgagtagctgggattataggcgtgtgccaccacacccagctaatttgtatttttagtagagatggggtttcaccatgttggccaggctggtctcaaactcctgacctcaagtgatctgcccgcctcagcctcccaaagtgctggaattacaggcgtgagccactgcacctggccctaaatgcatttttgacttaagatattttctatgtatggtggatttattgggacatacttcattttaagtcaaggaacatttgtattaaacagtattgctggtatttcttgtcccaatattaccgaacagggagtggatgtgactttttttcttttttttaaaaagcaaaaacaaaaaacttttaacagatagggcctcacctctgtggcccaggctggagtgtctatgggctgaagtacagtggcgcgatcaccactcactgtaactttgagctcctgggctcaagcaatcttcctgcctcagcttcccgagtagctgggaccacaggcacatgctaccacacctggctaatttttattttttgtagagatgaggtctatgttgcccaggctggtcttgaactcctggcctcaggcaatcctcctgcctcaacctcccaaagcattgggattacagatgtgagccactgcatctggcaactttttcttacactgaacaagccagtattggggccggggtctcagacactgtgactgatgctgtttatttacctgtttgcatccagcattgctgacaaggcaagagtaagtaactgctgctcactgacatttgggtatgcacagcaaagggctccatgtaatctgatggttatgcccatgaaagctcattaagagagctcagatactaggcccagaggatcagggcttcttaggtgtgcagggacacttggtgaaaatggttgt

SEQ ID NO: 5280 - DNA, 1207 bp, Homo sapiens
tctgaacatgctcaacagttactttgtgggcaaaataaatgcaaagtatttcctatgtctcctaacccctattcagcaagtaggatgttgaatcaggagttgttttaattcccttagcatgttatctgcttactgagggcacagctctggtagatacaatggtgggtattgcccctccttttgagttgacaacctggtttggagacaaaaaaaaatgcaattacaaagtgttatataaacaaatttagaacaatataaaccttgtgttggtgttttggatttttcagaaaggatatatgtggataaagcctgttgtccaaaatttgagatgacccatgctctttatgcctgaaccatcctttttttcctttctcattgctgctgactcactcctttaggtatattgtctactctcctcagcaaacctatttccaatcatgtacctcttctagtgaattaaaatcatattgtgattgagaatgaaagacttttttccttatactgactgtctgttggaataattgtactgctcgctctctgtaatgttctttatggtttgtattatgctaatacatttataaaagactatctaaacataaggctgcattatcgtgaaattaatccaccttgggtgagattgtgaagaaatacatatatgtgtgtgtgtgtgtgtgtgtgtgtgtgtgtgtgtgtatatgtatatatatatacatatatatatgttttcttgtttttttcttgcgactgggtctcgctctgctgcccaggctggagtgcaatggcaggatcacagctttctgcagcctcgaacttctgagctcaagggatcctcctgcctcacccttccaaagtgttgggattactggcatgagccaccacacccagctttcctttataatctgttgtatactttctagttaaaaggttaaagtgggttttagaaatgctgatgtcttaattaacatgtgacttgtgatttaggaaagagtgtttttaaaaagaaagaaaaatactgaaggatcaggaagaaataattgatcttggtagcaacatctgctgggaaaacacactagctaagcaagcctggtctcttagagaggcctaagatagggccacttttgccagaaaaatttgtttggatagacagtttaggaaaggaagtttactagagagataactgggaggaattcaaggaagaatcaaatca

SEQ ID NO: 5281 - DNA, 1733 bp, Homo sapiens
ccgcagcagagcaggaagaggcgcgcggggccggcgcctgccggggaggtcgaggcgctccctcggcgagccggcgccgccggccgggtctcctactgcttgcaaccgggggagggggaccatccgacagctcagccggggctgagagggagacgacgccaaggcggtcttgcatcgcccccggctttccaaatgcagaccctaccggaaccggagcccttccctgacagccgtaggacgggagacggccgaggggtcgcctggactgccccgccctcgcgcggtgacccaccggggaccgtgcgagggtcgcttctaacccttaagagctagagagccgagtcaccctgaggagcgccgtatggcgctggttgcgcgttgttctttaatcagcctcactgaacgcgccgatcccagttttacctcccgggccccacctttccacgcctcctccggcttcccggggtgttttgtgtgtcactctcccacgtacagtccctccccgtccctcgttcctcggccctctcgcccggtctccctagtcgtccagacgctagctgccgcgggcgttcctggttcgcgctcccgccccctccgccccgccgactcgccgcttcctccggagccccagcgtcccgaaccagggactgcatttcccggcaggcgccgcggcccgcggccaatgaggggctgaggatttggcggcggcggcgccccgagagtcggggtgggggggctttgtgcgcggcggcggcgggagaggcggcggcggcggccagcacggaggcggaggccgagggggctgtgcacaggtcgccgcggagaggcgtgcgaattccgagccgagcgccgaggaccgtgctacccaggccgggctgccagccgcaggctcctctctggcagcagcggcggcgcggcgacccccgtccctcggcctccccttcccatcccacctcccgagccttcctcttcccgcagcacgcccggcccggcccggccgtggccctcctcagtgccggccgccatggcagaggcgtccggcgcggggaaaatctagcccggggatttcatgcggcctagctcggttccgcctcctcctcgcgcggccccagcggctgcccgcaccccagccccactccgggcctccgtgtctctcctgtgatcgcactgacacggccggggggttagaatggaacaaactgaaggtaaagtgcgtgtgcgtgtgtgtatgtgtgtgtgtgtgtgtgtgtgtgtgtgcgcgcgcgcgcgtgtgtagtgctaggaagggctgaggagggaacgacggggagggggcgacctagggatggagcgccagaccccaggaggaatggaaggggaagcgggtggcctgaaagggctcgaggggagtcctgacggaggagcagatggcaaggtggggggtgtggagggaattggggggtgggccaggggaggtggggagtgggatgggagtcggagtggcgctgagctgggaattgggaaagtgggatgggggcggggataaggatggatcggggaggggcagggaaaggggagaagagttgcatggagattacagacctgggtggactgataaatagggagatttggggatggagtgtaggaaccagaagagtctgggagaaggggataaatttgctggagaaatggggcattttatgggaatgaagggagaaatgaggaatggaagtgaaggaaaaggtggattagga

SEQ ID NO: 5282 - DNA, 1101 bp, Homo sapiens
gtccaatacaggactggctcagctggctccatctcatcccttagctgggactcctcaagcacaagccaccatgacgccacccccaaacttggcatccactaccatgaacctcacatctcctctgcttcagtgcaacatgtctgccaccaacattggcattcctcacacgcagagattgcaagggcaaatgccagtgaaggggcacatttccatccgctccaagtctgcgccactgccctctgcggctgctcaccagcagcagctgtatggccgtagcccatcggcagttgccatgcaggctggccctcgcgcactggctgttcagcgtggcatgaacatgggggttaatctgatgcctactcccgcctataatgtcaattccatgaatatgaacaccttgaatgccatgaacagctatcgaatgacacagcccatgatgaacagcagttaccatagtaaccctgcctacatgaaccagacagcacagtatcctatgcagatgcagatgggaatgatggggagccaggcctatacccagcagcctatgcagcctaaccctcatgggaacatgatgtacacaggcccctcccatcacagctacatgaacgctgctggcgtgcccaagcagtcactcaacggaccttacatgagaagatgagcaagatgaacttgcaatcaaaaacttaaatatatataaataaaggaaccttttatactgacaaaccagagaaaaatggacctttttccagttaaaatattgctgtagatttagaggaatttttctttggtttattttattttttagaaaacctgatcttctctttttttgggttcattttgttctgggttttggttttcttcacaatcttgaacattttacagtagaactcatctaaaaatggatttggggatggggaaacatgcacaaaatcttttcataattaaaaagagccttactttctttacataccacatggacagaatttgtgtaaaagtgaattatctttattttaaaatgtatgtttcccctcactgtttgcagctcccaatgttgtcatttttaaatgttatatacatctcaagggttaaccagaccctttc

SEQ ID NO: 5283 - DNA, 1193 bp, Homo sapiens
aaaaaataataataatataaacactacatagatgtatggatagagattagaagataaaactaggtgttggagtactgtcattattggtcaattgtttttcagttcctttagtgatgcttctaaatgactttcataaaagtagatgtactggctccacactgggtgtgcccagcccaacactctctctctggcactggaaggacctggttgttcatggaagcgtgtcagaagaataggaattttccttaataacttatgatggagtatccatgagtttattcaagttatttttgaacacatctaattttcaatcaattcctttgtggagtgagttgagtttctcaggttggtttgctgattctccgacacagaactttctttctctgctcctaaatctacctcttttgagcctcctaacacatcgccagctatcaatcttcaaatacacccccgtggtgaatgtgcaggctactggaatgagcctggggttggaagtcagaaagtttcctttctctcctctgaggtcagttgcacgactctggtccagtccatttacctttgataagctataggttccttgcgtttcagataagagaagtaaagatggaaagaactttgcaagggaaagcctcgtactgttttctcaaagatgaagaaaggaactttaaagagcccctgactcaaattttttccaactgcctcctaagctatgttagtgttacacacatgaacaagaaccaaggctaccaagttaaaaattgaagtactctcttagagcagtactttttttgaatatttagttgatatggtttggctctgtgtccccacccaaatcttacctttaattttaatccccataatccctacaggtcaagggcagaaacaggtggaggtaattgcatcacgaaggcggttttccccaagctgtgagtctcatgagatctgatggttttattatcgtctagcatttcccctccttgtgctcattctgtcttctgccgccatgtgaagaggtgccttcctccatgattgtaagtttcctgaggctctgccagccatggggaactgtgagtccattaaatctcttttctttataaattacccagtcttgggcatttctttacagcaccatgagaacggactaatacattagcccagtgaaatacattttttaaattcccatacaagataat

SEQ ID NO: 5284 - DNA, 1175 bp, Homo sapiens
cggagccgggcccgtcctccgcgaacgcggcaacaaaggcgaggagcggcggcgggtcctggacgcggggcagtcaggctcggccacccccagagcgcagcgcagccccagctgcgagcagccgcacggatcccagagtcgcccgccgcgttcccagcccagccccggccggggtccgcccggaacagcgacgcctcaggcccggcaagtctctctcggaccctgggccgagcctcctcgccccgcccgccccaggccccggatgtgacggcaccgtcgcccgcagcgctcgccccacgggccgcgcgtggagggtcccggtaggtggcggggggagggggtcttcccgccggcccgcggcccccacgtacccaagtgaggaggctctcgcacagctccgcccgctccagcgactctacgctgaacatcttccccgccgcggccaggcagcgcctaccgcctggccagacaccgccgccgctctgtcgggggatccgggggcccgcgcagctgactcggcctcaggcccgcctgctcctcggatccggccgccgactctcgcccagcgctggcagcggctccgcaccgtcacccccagcgcccctccttctcctttcactcgggaccgcgcgccagccgcgcgcgacttcggacacgcccgccgccccgcgtccccgcccccggccgcccacaccgctcctccccagcgccgccgccctggctggagccgaggccgaggagccactgcgcacgctcgcgccccggccgacccgcgccgccgcgccgccgccgccgccgccgccgccgccgctgccgccgggcgcgcccccgccaccagttcgctgcgtgtcgaggcgagcacgcgctccgccctggaggctgcggcgacgggtcctcctccgccgtccggtcgcgccctcgcggaagctcggcagtgcgcgtgcgcccgcacccgcactccaaattagaaaggggacgtctagtgggttgcccgggaggggtggcgggagcggtcctggaaataatctgtcctctgtcgccgggaactggcgaggtagttccttcgcggtggagaggtacgtccggcgcgcggcggccacgcccaccctatcggggcccgcggagccgcggacggcggggtctggccttcttggggtagctctggccgccgaggc

SEQ ID NO: 5285 - DNA, 1276 bp, Homo sapiens
cagtaattatcaattattagaagaaaatatgggctgggcacagtgactcacacctggaatcccaacactttgggaggccaaggcaggtggatcacctgaggtcaggagttcaagaccagcctagccaacctggtgaaaccccatctctactaaaaatacaaaaaaattagctgagtttggtggtgcacacctgtagtctcagctattcgggaggctgaggtgggagaattgcttgaactcgggaggctgaggtgggagaattgcttgaacccgggaggctgaggctgcagtgagccgagattgcgccactgcactccagcttgggcgacagaatgagactccatctcagaaaaataaatatgtttatactatacttacctaatccacatgcatacacatacttctatctgatctttactgaaagtcccccaggcacattctggaaaccccagtcaaatcagttaaacacatgcacttgctgtctctcctgatcaaatgaaggtctacaaagtctcaagaagaaactacagcaaagttaattaaggaagaagatttctgtaagcaacgtcgtcttaactgtcattttctttttttttttttttaatctttgtctaacatccccatgtacaccagagattaactttcattttctaatgactaagattgtgaaagagaaaattctgggctgggtgggtggttgccaaccatttgttactttatgggtacctggatgagggttgtggtgaatgtaaccagaggcaaatccgaggagaccctgtgaatgcccagagttgcgtgagtgactggagagtgataagggatcagagcagagatttctgaagggggaaagctgacgttaaagaagacttaccgctcccttggaatacctgtcccactggtttctaattcagattccacacagtagctaaggattttttttaaaaaaagtaaatcaaagcacttcccctgcttgaaaatctttcagttaatgtatacacctggagctgatgagaggcatccaagtgcagagatttttaattaaactttttattttgaggtaattgtagattcgcatgcagttgtgaaaagtaatacagaaagatcctatgtatcctttacccagtttccactaagggtaatatcttgcagaactgtcatacaatgtaaaaaccagatcttgttatgaatgtagtcaagatataatagtttcaacaccaaaggatccttcctgccactcttcataggcatactattttcttccaccctgtcaccctcc

SEQ ID NO: 5286 - DNA, 1107 bp, Homo sapiens
tacatgctaatgtataagtaagtttggttttgatttttctttgtattagttagttcattcttctgcaaattgcatgttttcttttgattcttagctttgcctcagagagatcatcaagattattcgatatttgagtctcaatataaacaaaaagttttaaaatttaaattttaagtcagagaaattttttctaattagatgtttctattattaaatcataggggcgctaatcgtactgaaacagtcacgtcttttagaaaacgagaaagtaaagtgcctgctgatctcttaaagtaagtacccttctgccctcacccttagtgggatcacagcagccgcacagctgtgtctcttttgtaggcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacaggtgcacttgctgtgctctcgtgatcctgggcaaggcgagagtcatcataggactttcaacaacctccagaaatagacagtttttaaggaaaaacaacatattagttagattcgttttgtcatggtcattgaatgcagaaagggataatcacttagttcagcctcattcagtcaggtcacagaagtcatggtgatcagtgatatcatcagagccggtaattaaatgtgttcgcagatcaaaggaagactctaagaaagttttaggaagccccgtaataaaaatgtctggtcaaaaatgtgatacagatcttttctctggttaacctctgaatgttttggatcatccttctcaatctctgcggccctgtgtcctgtgcacgtgggttttgcattgagggataactcaagccgagggggttactctcgagcataggaactcacatctgtgtagctgatttcaagggaagcagagtctgtatttttactaaatgtgaacagtaactatgtgaggatgctgccatttgtgctcggtactttgagagttct

SEQ ID NO: 5287 - DNA, 1186 bp, Homo sapiens
aaaaaagaaaattttcagtgattttaaactgtttactgttatgtatttatcaccttaagttgggacatataaggagcaaaatggctcaacacagggtatgttacccattcatcaaaagataaaatttaggccagacatgatagctcactcctgtaatcccagcactttgggagcccaaggcaggtgacccaaggatcacctgagggtcaggagttcaagaccagcctggccaacatggtgaaaccccgtctctactaaaaatacaaaaattatctgggtgtggtagtgcacgcctgtagtcccagctactcaggaggctgaggcaggagaatcgcttgaacccagaaggtggaggttgcagtaagtcgagatcgtgccactgcactccatcctgggcgacagaatgagactccatctcaaaaaaaaaataagtaggccgggtgcggtggctcacgcctgtaatcctagcactttgggaggccaaggtggccagataacgagatcaggagatcgagaccatcctggctaacacagtgaaaccccgtctctactaaaaatacaaaaaattagccgggtgtagtggcaggcgcctgtagtcccagctactcaggaggctgaggcaggagaatgacgtgaacccgggaggcagagcatgccgtgagcctagatggtgccactgcactccagcctgggcaacagagtgagactccatctcaaaaaaaaaagaacaaacatttactaaggtttagaatttctgcctgtaattgctatccagcagcttcctattcctgagtctgtgacattgtctcatttttctttgtgtagatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcaggtgggtactcgtgtctgtcctccctgctgtgtcacaggattttgctaaattagcttttctctaattttagcttttctttagagtctgaaccttaaaataattggtaggtgttattttttttctctctttataagtaaacttggccgggtgcagtggctcacacctgtaatc

SEQ ID NO: 5288 - DNA, 1214 bp, Homo sapiens
tttagagtattttgtttaatttaatgtcaaaatagacttggattctactttcttttatagttcataaagtgcattttatattcaagttatttatctgatataggtatctatgaatactagaaataaagttaaaataaaaaagaaaaaacatcaaaagaaatacttagatgaaattgtgcaagaatcttggagaaaagaatatgaagaagacgacattttggcttcagatgatccatcttcaattgaacagtatgagaacaccagaacatatgaacttcaaagcaaaaaagatactgagacagaaaatcctccagttgaaaacacattatctccaaagctagaaattacagagaaatgggaaaagtattggaatgaatatggaggaggactattgtggcaaagttggcaagaaaaacatccgggtcaagcactatcttctgaaccttggaactttcctgatacaaaggaagaatgggagcaacattatagtcaactttattggtattatttggaacaatttcagtattgggaagctcagggttggacttttgatgcctcgcaaagctgtgatacagatacttacacatctaaaacagaagctgatgacaagaacgatgaaaaatgcatgaaagttgacttagtatcttttccatcttcacctattatggttgataatgatagctctggtacaagtgataaggatcatagtgaaatacttgatggaattagtaacataaaactgaattcagaggaagtaacacagagccaattagattcctgtacaagtcatgatggtcatcaacagctaagtgaagttagtagcaaaagagagtgccctgcttccggccaaagtgaaccacgtaatggaggaaccaatgaggaaagcaactcatcggggaatacaaacacagacccaccagctgagggtaagattaaccaagatttattctgccatgtaatggttagcaaaatgaattcatttagcaaaataactactaatcctttattgtagagttaaataataccaagtacatttcatataataatgaaatgatttaatccatcctgttttcatatcacaagttatccttttctattaataagaatatttgcatgcagttctcaaaagtatcattccttctcttgtactttggtggctaatgaaggaaaatgtggaatctcttgagaaatctaatataaagtgagcttggaac

SEQ ID NO: 5289 - DNA, 1243 bp, Homo sapiens
gccaagcaaactgaagaggaggtaagttacatgagacccctctcaccagagcgtgttagagtaagcatttgtatgcataagccagtggttattaaatgattgttatgttcacaacaccagtaatcatgtaagaagaggcaggatctactggtaagattctgagcctttggacctggacctgtggttaaggccgaactctgccactcacaaactctaagtacatttctttttttttttttttaagacatggtctcgctttattgctcaggctggagtacatggtatgatcatagctcactatgatcttgaactcctcagctcaattgaacttgaactcctcagctcaattgatccttctgccttgagtagctgggactacaggcatgtgccaccactcctggttaattttttaaaattttttatagagacagggtctcgctatgttgcccaggctgatctcaaacttctggcctcaagcgatccacttgccttggccttccaaagcactgggattacaggtgtgagccaccacacccggcctaagtacatttcttaatttctcatctataagattggactgatgccttttttgtgattattgggtagacaggagctagcatgtaatatatctgacacttagtagctatcaatggatcataacttttaactaataattaaattcatatcttctctctctctctctctctctcaccagttctaatgtttttcaaaagtctggatatattttatcccagatttgtattgctgaaaaagacctcaaggtcatgctctcattgtatagataggaacactgaggcaaacaggaatgagtaccttgctcagttttcttcacagcaatggcagctctaaagccagagcccagatcaactctactcgaagcagtgcaatttctgtttaccactgtgaaagttgtaagagtcaaaacagagtcacttgtgtcagacactggtaaaatgtagccagggaaggccatgaaagactctcatgcactatttgcttgataacaggaactgtcacaagaaatttttccaagccaaagcatcacacaaagacagatagctgcttatacaggaacatgtgcctgacacagtctcacaagcccaattcgaaactgcagaggcctaaccataactctcagtttacaagtttatctctgcccagaagtggcagtggttgtgccactcctgaagcagtcctttgttgtaatttgtaagttattcct

SEQ ID NO: 5290 - DNA, 1147 bp, Homo sapiens
gttcccggccagcagcctccccatacgcaggtcctgctgggccgccccgtcgcgccccccactctgaactcaagtcaccgtggagctccgccgccccgaaactttcaccgcgagcgggtgagtcctctgcgcgagcccaggggtgggcgcgggcacgcgggcagtgggtgcaggggccgcggctgtgccaccagccggagtcccgggcgcagggtagactcggggccgggggcatcggcgcggcccgcggcggcttcctggccgcaccgcctctgggctccggcggcgaaggctcttagatgtcttcagccgacgggtgaccgggcccgggggagccagggcgcggggactgaggctccgcaggtgtccgccgcggagccgcgcaggggagcggtgggaggtgcgggcgcgggggcgggctcaccgcgtgtccttcccggtgagggcccgagggccggctgctgtccctgctccggccgcttctcgcacacagtggggaagccgctgcccttgcggagcgggcgcgcggcggggatactggagaggactcctcggattgtgcaatctgatctcccctctggaccctgggtctcctggcagtgggagatggggctcggccggcgccctctcgaggcccgcggacagttgccctccctggtggccccgggcaggagcgtgacgtcgaggggctgcagcggaggctggaactcaccctcccgctgcggcgcctctcggcctgccgaggagcagtccggtgcttttgccggctgagaggaagcgagagttattttaagaattcaggggttgcctttccttcgccttgggggaagggcgtaagagtcagttcccactttcctgcattctctgggcccatggtggcatcttttgcttgcggtgcattcgtaactttccaacagcctgcctgtcatgtggattagcggttgtgtttttgtatatccgagtgtgttaattatcccaaattcgcccttcttcgccagctcagaatctaggccttgcacttttctggctgtatatttaggggaccgattattgaaattccctgtttgagtttcttcatctttgagagagcatatatacctcaggggctgtttagtacacacaaagcccctagtacgtaccaagcatt

SEQ ID NO: 5291 - DNA, 1214 bp, Homo sapiens
caggtcctttccagaaatagatgtagatacttctgctggactgggaagccaggagctgaaatatcacaacaggacgtttcaggctatgaaaaataactgcttactaattctaacgtaagttatccagattacgagaagcatttctgccaatgctcatgtcagctaagctcagagaagttacctcatcctcagagagcaacgaatggtatggtctatgtagaaagcaaaatttgcaacggaaaaaccagagttcgtgtgcactttatgaggaagagggttaggtgcaccagacagaggagtttctcaggtttccgtgtcgcctgttctctcgaccaggtggccctctcggcgcaggcggggaccccaccctgcgggacttcggctcctccgtgcggacagggggcgcccgcagccgtgcctttcccgccaactccactagtgctccagctcgcccttgtgcgaccgcctctagggcccgggatatttcctgttccggggcgtgtgggacccggatgcaagcgtgctatataagcgttgctcaagtcccacccctttctttttgaggaagacgcggtcgtaagggctgaggatttttggtccgcacgctcctgctcctgactcaccgctgttcgctctcgccgaggaacaagtcggtcaggaagcccgcgcgcaacagccatggtgaggcggcagtcggcggcgggcggcgcaacgcagggctcgggcgccggggggaccccggtttcgagttcgtgctcctgagggcagatgccggggcgtgtaggggcggaaaggcgctcctgaaatggtggggaaacgcgggaagcttccggaagctgcctttctccagaagtggcagaccatttttggcttattgttctttttcatgtatctaataataggcttttaaggataccggaaaaacacccgtggagccggaggtggcaattcaccgaattcgaatcaccctaacaagccgcaacgtaaaatccttggaaaagggtcagtgcattcgttatgcgggggggagggggaattgggcgaaaagcgacgagctttactcgttaatgttagtgtagaaggtggactgcaagaactaaagtgacaagttacttaaaaaagtaaagcgtggcttaaaattgcttttactgtcatacagctggcgatgaggaggtacctattgtgttgagtaacggtgataattttatacgcta

SEQ ID NO: 5292 - DNA, 1214 bp, Homo sapiens; identical to SEQ ID NO: 5291

SEQ ID NO: 5293 - DNA, 1336 bp, Homo sapiens
tccaggttaagagtttcgcggtgccaagatcaatttgttggcagggttgcattctgttaggaggctctacaggagaatcatttccttgtcattccaccttctacaggacatcctcattccttggcttgtgacctccttcttccatcttaaaaaccagtgctgtttcatctctatgacccttctgttaccacatctctctgacaccagtgtggagaggttctctgcaggactcatgattaaatgaggcccaccggatatccaatctaggcttatctccttgtcttgaaatccatagtaaccttaattacatctgcaaaatctcttttaccatctaaggttacatacaggtttggagattaggacattaacattttacatggaacattattcttgcctactacagttcccacccaccccccgctccactcctgtgttaaagattcagattcatcacaaataaatttacatcactcataggtgctcaaaagtcacaatccattattacagcatcaactctaaatccaaaatcttatctgagtctcaccaactcaaaagtctcaaatctcacattgaagccatctaaattaagtttgggagaggatctgtgtgtgatttctgggacataattccaactgtgcacttgtgaacctagaaaacaagttatctgttcccaagtatgatggcatgacaggcagacaataatagttacacacgttcctgttcaaaaagcagaaacagatggaaaaaggagccatcagcaccaatcaatttacaaaaccagcgaggcacccttctttaagtttcaaggcctgggagtaatcttcagctcactgctgttctctgggcttgttgactgtctcagagtcatctttactttttcacaaaaggtagcacacgtttgcagctgagtatcaacttatcagtttgttcttcttttatattctctaaagctttctgttaaaaatggtggtgcttctgctgctataacgttgtcaagaaacttgtgggtcttttacatatgtcacagggatgcactcatttagataggaggctcctcacgtatctttcctggaaaatcctgtctctgtttttggctttttctgaaatagctgagaggatctatgattcacacccttaatatcttcaaagagtcttgtgtgtgacctgatattcagaccttttgatgtttctgaagtattagcaaaaggttatacagccatatcttcatcactttctctagagtaaaggctgtcctgacggtgaatcttagttttagtggcttttgccatttgaataggccgcgaatttcccaaatcatcaagtcctggtttcttta

SEQ ID NO: 5294 - DNA, 1205 bp, Homo sapiens
tatttgcattgttctatatccataattcccagttgttttagctttagatttacacttaaatggtttagtattcctcacaagatctttgtaccaagcaattatttttaatttattcaagggttttattataggaagcagacaagaaaaaatagaacttacttcacttgtttagtaaatgaatagcaaagcaagagtaagcatcagagtaaagtttatctttgggtgcctcctggtcaacttcctaactaaccaaaatgtctttctctcaggtgctgtgacatgtatatggatgaatgaacagtgtagcagtatcatcacaggaggggaagacagacaaattatattctggaaattgcagtattaagtgccttttcctctcctgaatattaaattgaactctatttaatgcatttttaaaccaaacttttaaacggactggtgaatgtgcaatgttagtaattagaagttttaccacatggaaaatttgtggttttaaactttctaaatcatggtgacttcattgaaagccattagttgctattctcttagggcagataaaatgcggctgtgttaggaaaaacatgttacactgtaaggcagatgatcgtccccgtatgatgattgtcagaagacaggactaagtagcagagaatagctaagagataaattgggctggggaaacttgtcagaaagcactgaacaattaagaaattttccaagaaaatgtgcagtattctctgctacttctgaatctgttttgtcttcctaatctatcacaattgccacccatcgggttttgggtgtgtgttttcatagcgtggttactttctataatgctgtacccagattctaagaacctggagaaggattagcagttcttagtaagtttactgtgtataggaacggtttgtatttcattacagctattcatcttttctacattaaaaatatttttctctaaagaaagctgttttcactttatttaagtaacttaaaagactagtgtttttaagaccacaagtctagaatcatcttctagaaaaccatatttagtgatatgaatgtaattccattattttgaaattatcttcagactcaggtagataatcaaatatttttttctcttctaaatttcaaacaaggtaagctgtatagcagtagcagatttccttttatattcaacctctgaaccatggtaagtgtgt

SEQ ID NO: 5295 - DNA, 1231 bp, Homo sapiens
tccaatatacctatcttttatttattttccttaccttattgccctacgcatgtcttccaataccatgttgaataaaagaagggagggaaaaaatgtttgtcttattcttgattttggggaaagcattcagtctctcacgattaaaatgtaacgttagctgtaggatctttgtaaatgccttttatcaagttgcagacgtccttttattcctagtttgctattccttctttatctttttctgtgtctattgatatgtccttaatttttacacttttctttagatcataaattacacttactgatttttgaacaaatgttcaaaacaacctaggaacaaaacaaactaggaacaacctactttatcctaggaacaaaacaacctttgttcctaggataaactccactcagttattatgtattatcatttttatagatatgttgttggtttgattatcttttgttagcatgtttgcatctaagctcatgagtgatatttgtctgtggttttcttctcttagagtgtgtttgtctggttttctcacgagagtaatggtcacatagaatgagatgaaaaatattctagtctatggccataacaccctgaacgcgcccgatctcgtctgatctcagaagctaagcagggtcgggcctggataatacttggatggaaaaatattcccatctcttcaattctggaacttatattttcttatcttcctttctctccctcccttccttcctccctccctccctcccttccttccttcctttctctctctttctttccccttccttccttccttccttcctgcttgcttgcctgcctgcctgcctgcctgccttccttcctgcctgcctgcctgcctgcctgcctgcctgcctgcctgcctgcctgccttccttccttccttccttccttccttccttccttccttccttccttccttctctctctctctctctctctctctttctttctttctttctttctttctttctttctttctttctttctttctttctttctttctttctttttttctttctttcttccaacggagtcccgctctgttgtcaggctggagtgcagtggcacgatctcggctcactgcaacctgtttctcctgggttcaagcgattctcctgcctcagcctcccgagtaactgggactacaggcacacaccaccacgcccagctaatttttgtatttttagtagagacagggattca

SEQ ID NO: 5296 - DNA, 1156 bp, Homo sapiens
gaaggggagagaggaaagagcaggagagctggatggcccggggcatctggtcagagaggccagtctttcagagttaaagttttcagaatgagagcacgtaccagcagtgtcctcagggttggtttgctcaggtggaatggggcagaaggccacggactgacgggtgaagagacttaggccagggaggggatgggtcaccccctgaatgctgaagtcatccagggtggcagcaggaggtgatgcctgggagagattgactagtgggtcagtaagggagaaagaaggagggcgtgatagccttagaagatggtcccctcgggaggatggcttgagcacgtgggtcagagttccaccctgaagggagcaagagtgcactgaccatggaccccagtctgtctccctgggggactgcatggcgtccacttgaaaggcctgcaaaagagctgtgcccttgggcagactcgaagggttcaggtagatcaggaaatggtgggagatgttggcagaaatgcagagttgttctgttctagagggtgcagtggaagataaggagagattgagttagaagtaaaaaacaaaaaaaaaacaggtggttcagggctgagatgccaggaaaggagaacggaccaaagtggtttgcatttccagtggtggcgaaagacagcaaaggtgagaggtgagaaatgagttgttctcaaggttcctggtggactcttggtaccaggttgtgttatctgaacagctgcttgcacggttttagcagctggggtgtggagattatcatcagtacttgctttttgctggtcatcatttcttcatacacaaatttggcaaggaaggaaaagaaagagatggcataatagcagagtttatagaatttgcaagatatgaggttttgcccataaagtagagtctttatagatagaaggagctagtaatagtcgttaagagctactatatggaaaaactatatttgatgctgtagggcatccagattaagaataataatggacattaagtgaattatgatgacccaagcctgttccacagtctttgtttgatttaatcttatcttcaaccctatcatttttatcctctccagcaaacagctgaggaagcggaaggatgtagaggttaactacacttgcttaaggcc

SEQ ID NO: 5297 - DNA, 1151 bp, Homo sapiens
tactactccagaaaaagtcatttatttcatggtctatgaaaatgcaatgcacagctttttggctgtgttatgagaagcacctagtctgaacagcagtcatatcagtactctttcttgaccaaggcaaatcatctcaactggccaccttccattattatgcagtgctctttgtcattgaccacctttttgcttcctatatactactatttaaaactgtattcctttcaagctttctatccttcttctttatcaacatagtaccttgggtgtagtgaagaattaactttacccaaagaggggtctggcctttgccctcaagtacttggctgtgatctttagaccttcagaatattctgcctgatgggagtatctttgtttgcctgggggctttagccaccagacagtctaacaatgtgatttatgatggtggctttgggccacgatgtatgttttgtctccaacagggactggggactaaaggcaatagcttgacttctgaaaagggctggactgaaggtcagccacatgggcagtgtgaaggatccccagcaaaactctggacatcagtggctgggcaagcttctctggttggcggtactctgcatattgtcacacatcaactctgggagaagatcatactgttcatgtctccacaaggggaggacagctggaaactcagtgtctggacctctttccttggctgattttattgtgtatcctttcattacaataagctgtagccctgaatataacagctttcagtgggctctgagagtcattttagtgagttatcaaaactaagggcagtttgggaatcccccttactcgtacttggtatcagaagcaaggatggcaacctgtggggactggtccccctaacctacatagttggcctcaactcctgccaactctgtctctctctcaaactaaaccctagagtaccttgtaattacttacccttctttgaagaaagttatatgcctgatttcgtccttttctcatttctcatttacacttcagctaattgtgattagacttgttctcactgttccactctaaatgctctgacagagatcatgaataattgcctgtttgcagctcagtcatctatttggtaattaaacacatttttatttagtgtcaccacaagt

SEQ ID NO: 5298 - DNA, 1188 bp, Homo sapiens
tcaggtgagagcaacgtagtactccactgtgcgtgcataccatgatttactttgcagtcccagatttacggtttccaatttataaatactgccattttcaccttcaagccccgatgccaaacacagaaataccaggccacccccaccccctcgccgtgtgcctcccacattttcacacacattttcaggagcccagggcgcagcctcacaccgaacgccgcctctgccgtcccctcacttgccccgtgcccccaccgcagggctgaaggcgacggaaccgagcctttgtacccccaccagccccgttccctggcgtctcccggccgccgggctcgcccgctcaaacgtggcggaacaaccggagccgggccccgccctgctggaagacagggcggaccgggcaaggcaggcgcggggcggggcggggcggggctccggctggcggggcgcggccagcgtgcagggctgggccagcgtgcggggctcctcccctttcctccggcggcgccggcggccgcagaacttccgggtcggcgcggaggcggggcggaggcgccgcggcggctgttattgttcggctgggctcggtcgggcgctgtctccctcggctctgcgggtgtcagttcgtccggcttcctcacagcccctcactcccggcggctgacagcagcagcggcggcggcgggcggcgcctggcgtttcgaggctgagcggcaccggggttggggcgcggaggaggagcagcagcgggaggaggagccgtgtgccctggcactgagcggccgcggccatggcgtacgcctatctcttcaagtacatcataatcggcgacacaggtgagggccccgggcgcggccgggcgggtgtcggcggcctccggacccgggctgaggggcaaacggcgtctggcggtggcggggacgcggactccacccggcgcctccctcctggccgcgccgctccatttccgcagtgctggagctggtgacgtgggcactgcgagcggccgcggcctggccaggcccggtctgcggcccccgacccggccagtcttgcagctgagggccgtggcagccgtttgcgacgcccgattcaggaagtgtgtgacaggaggggaggcctagcgcagggccgccggggcccgactcacatgactgcaccccacccccagggccccttgcgttaggt

SEQ ID NO: 5299 - DNA, 1196 bp, Homo sapiens
tcatttaaagttgttacctggaattctatgtcaattcccaggaaaaggccatagagtagccttttctttgacctgaggataattgaagaggcaaatatattagtaataattatgaattcatttattcattcatcaaatatttattgagtgcttcctttagctagacatggccctaggtgactgggaatatataatggataaaatatataagcttcctgtcctgatgtgtaacatcctaatgagaggaaacctgtcccccaccacatatacttaggcagattagcacttggccagaggaagaaaatagctgtggagtggacaatggtgtcttcagcggccgaaaggaggggcaggggaagccccagcagcaggagcaggtgtgtggcagcccttcacaaggggctttcatgtctcagttgtatgttgccagtgtcactttgttcattgtcatagttgagggagaagacttgcaacaagaagatggacccacaggagaaccacaacaagaggatgatgagtttcttatggcgactgatgtagatgatagatttgagaccctggaacctgaagtatctcatgaaggtagaacacttttttttcaagttttaggataaaatataatcaatgacttctaattactgaagtttttcttaaacccctttaaaactgatatttaacttttgcttagatttttaaaagttgaagcttaaagcttcaattaaagcaaattttttcttaaaatagataccttgattttggttcaaagcacttttcagggaaactcagaatatacaaatttcttataaatagtgagtcaaatacttgaggaaactagttttactatattcttctgcttagggtgctatttgttaaataaaattcaaacaactgatgaaatattggacttgataatctatcacaggctcatgttcacacatgaactctgtaattacagtgagcaaaacacaattcttagcttctgtaccaggcattggcaaacttttttttgtaaatagccagagagtaaatatttcaggttttctggatcgtacagactctgttcagctactcaactctgccatcacagcgtaaaagcagcctttgatagttcctaagtgggtcagtgtagctgtgtttttatacaacttatttgtaaaatcctacccaacatggctggtaagtgcagcggcttgaac

SEQ ID NO: 5300 - DNA, 1136 bp, Homo sapiens
tccattatttcagagtaaattaaaggtagccagaaacgctgtcagactttggcatgatgaaaggcaagtgaaagttaaaggaaagacacaatagtttcaattactttgaatctcataatgtcaaagttatgataccctttgttgcttaacaagtagaattggttttaagccctttatactcaagttcttcttgatgaaacaaaaatatgagaaattgcttcttcatgggacatagaaggctttgtaaaatacagtgtagttttctgtagttttatatgaggttctgctttctactattttacagttgctgtgctccaccttcataccttcgcctatgttagaacttctgagaagctgaagcatcacatataaaaaggtctgaagaataatatcacttgggttaacatgggtcagttgtctttggattgctttgtatatctatctatctatctatctatctatctatctatctatctatctatctatctatctatctatctatctgtctatccatccatccatccatccatccaatctatctatctatctgtctgtctgtctgtctgtctgtctgtctgtctgcctgtctgtctgtctgtctgtctatctatctatctatctatctatctatctatctatctatctatctgaatgtcttttttcttcaatcaggtgatagttgtattctacttttggtttagtcattagagttaacaagcttccagaaaaatcagcatctcatgatgtctcttcaagagtgtcagtgaagctggcttctgaatgtattctgttaactttattgcacaaaccaaggagctcatagtctcatactcctattggatagcctgaaggatgcttgtatttgatcaaagtattgctgtgtgtttattcattcatttatttatttattctctacgcagtgaccaaaatggaggaagcagcaaaatatctatcctgtttagagcctagcatttcgtgtctaaaaccagtgattttccaagaaaaatctatccaattccactcaattactttttactgagcacctacaaagtaataaacccgatgctagataccatcaaatccttgaagtctagggagtgtgactgtcttagtctgttggtgctgccataagaaaa

SEQ ID NO: 5301 - DNA, 1237 bp, Homo sapiens
ttcccttcaccccgcgggagttggaccggtggcgctggtaaggcctcccgggctcaaagtgcaacggacactgcagaaatccaaactgctggcattcgcggtttggggacgccagaggaggtaatgatttctggtttgttaacctcaagtgacaataatgccgagccaggcaggagctggacctacaatcttctgatgcgtggtcagacacgttatcccttgcgccactggcctaccacgctactccttcagtcgccgttggattactgtgtgttgagaacacactcggcaaccactttaaaggacaacgcaggctggtaaaggaaaagtacgacaagggggggcggtggaatcgcagggtcttggcatcgcggaccccagacacctgggttgagggcctttcccgggtcagtcaggctagcgagccggagcgttctgtctttctgcgcacgcgtagagcacacaggccggctctggggctctgcgctcctcggattacgcatgctcagtgcaatcttcggttgcctggactagcgctccggtttttctgtgctgaacctcaggggacgccgacacacgtacacgtcccttcgatagctcagctggtagagcggaggactgtagctacttcctcagcaggagacatccttaggtcgctggttcgattccggctcgaaggagacaagtgcggtttttttctccagctcccgatgacttatggcactttccttgggtgccttcagtgacacattgcattccaacgagcagtttgaaagtctagcgctttctccccattttgggcctcccagcctgcacggtaattctttttagccattcgccctgcgggaacgtgtccgggcaggttcccagcgcagctgtgggtctgcgcttggccgagcgactgccgggtcacgacttctgcgtcttcttaacccgtctttggcattgcccgggccccgagtcacacaggaggcagcgccggctccagggggccaggcggggaccttctcctcagagccccgggcagcttctgcgacccgagggctcgcaacggctgccgtgaggaggtggggggtccgcgggaagaggtatctggcgctcccggaacctgggaatcagaaagagagaacacaatactaaaaacacgaagcctaaaaatgacacaatgttatggagacaaggcggcacccgggaagctgtgcccgctcccttcgatagctcagctggtagagcggag

SEQ ID NO: 5302 - DNA, 1212 bp, Homo sapiens
actcactatgaccattatgtcttaaaatcaaaactgccacagtgaaggatatcatgaaatgtttccaccattttcctgccagtgctaatggctcctgtttccagtttggaataagctcatttgtggaaatactaggtactaatgagacaaacatactcagttacagaggtttgggtttgtcagtactgactatcaaaaaagcagaaacaggtaatagaataatagtacttttttattaaaaagtggtttgggagtctgaaaggtaggttgcaagtacagttcctaaaggaatgagattctcttcttggaccattcctacatataagatgcccaacaaaatgcaaataaaaatgggaattcgaaatgtaatatttaatttccaggtgcaagaaagcctttgaggtgaaggtgtatgaaagtcatcataacagatgttttccaaaaacttgtagaaggttgtgaaaaaactactaggatcacgcggcatgtattgaggtacctaaatttaattaatgttagttatgtgatgtattcttgacagataggtttaatagctggcacaatgatgacttaaattactttttgccgtttacccagctgaggttgtctttgaagaaataattttaagactgagatgccagtactgtacattgattaattactgacatgtatgtaaggcaataatttaattaagggtgaatattctttgtttttagcatataggttgctgtagatgaatgttcttagctgtcatgtttaaaaatacttctgcttcgttacctcaagtaagtgatttgtcaagcaactatgtctgctgacagttcagaaagtatctgataaacttaagggtgggggcagattcttgttgaagttgcttttgcatgtgtggtattctcaacattagttttttgaggggcacttgtgaatattgaggttatatgagaactttgagtatggaatgattttcactgtggtttctgactttgttttggaggtgtggcatgcagcattttggaaggaaaattgaagacgtgttcaagaaaacatgaacagaagcaaatgatgaaaatgagcattttacttgatgttgataacatcacaataaattatggagaaaaatacatatttggctaacttttaattgctgaacaataaagtgttttcttttaaatcaactctaaatagctccattctcatagtcactagtcagac

SEQ ID NO: 5303 - DNA, 1212 bp, Homo sapiens; identical to SEQ ID NO: 5302

SEQ ID NO: 5304 - DNA, 1138 bp, Homo sapiens
aaaaagtaggcctgtgcaagagtgtccctactctgtgtgtagaacatctgtaccaccttgcggccataagaccctgtaccagagtcatcttgaaacatgggctacaatcaagtaaaaataatggtatgcaatggcagaggcaggcgagtcaagagaggaggaaaggtgtgaagctattttcagatcccccatttagaaagaagaggccagttccaccagtgtccagtcctgctatagtgtgtggttatagggacacacaggagagactgcctcaaagaggagacctgactttagaaccagaccagaacaactaaagctgccagtgctgagccacactcggtctgagagatccagagagcagccacacctggtgtaatgaagactgggcccaggtggtcttgttttcctctccagccagccagtgccagagactggacactggacaatgtctagggtgatggtggtagtggagatggcttaacagaagacagaaaacttgccataagcaatgactactggtctctcctcttcccctaacctatgtgagcccacccagacttgtggctactctagggatacacactttgcttacattagcacattccttttctttgttgacaggaaatagagcttcttgcaggaatggacagtatggttcagtggtgggaggtaagagcttatttttctttcttttttttttttttttgagaacggagtctcgctctgttgcccaggctggagtgcagtggctcgatctcggctcactgcaagctctgcctcccgggttcatgccattctcctgcctcagcctcccattatttttcaagatagaggtttaatcaaacttgaggaagggggaaaggggaggtaagaagaggttgaagaagaaatagatcgtaccaaaagacttagcttctacttcttaataggcgatgagttggggacttttttttttttttttttttttttttttttgagaaacagttttactcttgtcacccaggctgaagtgcagtggcacaatctggactcactgcaacctctgcctcccaggttaaagtgattctcctgcctcagcctcctgagtactgggattacaggctcgcaccaccaaacctggctaatttttgtattatta

SEQ ID NO: 5305 - DNA, 1213 bp, Homo sapiens
ctttctttcctgctttaaaacttttaaataaactttcgctcctgctgtaaaaattgccttcatctctcactctgacttatgctctgcggatgaattctttcttctgactagggaagaattgagttgctgcagactcatatggattcaccactgctaacatactttggtgctgtgacttggataaaactgtatgggatgggttttgtgagagcaccagctatactgagggaaactttggagggaaccagctactagatgattcaattagtctttcatccctatatccaggttggacaatcgatttgcccatcaggaccattgcggacctccaccagtttcctctggcttcatcttgcccaggcatagttcacaatctttcatttcctaacacctgtgctcatgctccacctccccagcgtggcaggagatacagaccagtggtagactggtggtattccctcagtagagtggagagtccttgggaacccaccgtgggtgatgagtgctccagtcttcaccttcattgcaccatggtccatggcagtcctgatgtgcaaattaggtgtccaacctgggtataggaaaaaagactaatcaaaccatctggtagctggttccctccaaagtttcccttaggatacctggtgctctcacaaacccatcccatgcagtatcccagtcatggtgaacctgacccaattgtcccatagacagttcttcttgataaacataggaattgacacttttggtcttaaaacttaaaacttatatttgttttatctgagttccttcctcaggaaacaactttcaggcctctcaaaaaaaaaatatcaaggaactaaaattcaccagattaccacatccagacaatcagatgccaggacctatcattcaacattattgcttccttgcccctccctagttcctgttctcttacattgttacatttcttcccttctatataaacccctagttttagtgggtcagggagatggatttagactgagctcccatctcctcagctgcagcacctgattaaagccttcttccttgtcaatagttgtcatcttagggcttggctttctgtgtggcaagtagcaggacctagaccgaacccctggtgttttggtaacaacagcaccaaagtatgtaagcagggatgaatccatatttgtctgcagtaacttgatttttgccttttcagaggaaagaa

SEQ ID NO: 5306 - DNA, 1200 bp, Homo sapiens
taaaatcttgagcatttatataatctaaaacctagaaactccatttctaggtaaatgccttagagaaataagtatcatatagcatgaaatatgaacaacccttgttagtatgttcatggatagggaaatggataaattgtgaaatttttttatgcagtagaaacctgaatgcctttcaactacatacaggcgatggataaaatcagtgatgtacaaatacatcccctgtatgtagttgaaaggcattcagatttctactgtgtaaatgtacaacaattgttttcctgaaaaaaggaagccctgatttgtagagattgaagatttccgtggtgtgaatactcccaccgtggctgatttcaagcagccaaactgaaatggcagttggttctcccactctggtatagcaagttgcagctcaccattaaatgagtcttaaaagcctaatgcttcttaaacaaaagcaagtcacagaatgccatttttataaagctccaaaaagcaaatctaaataatatgttctttaggaaaacataagtgacaaaactatatttaaagacaggagttgtctcccacacgggctagcggttaggattcctggtttttcacccaggcggggcccgggttcgacctgcggtggcaggtgcctgtagtcccagctactcgggaggctgaggcaggagaatggcatgaacccggaaggaggagcttgcagtgagccaatttcgtgccactgccctacagcctgggcgacagagcgagactctgtctcaaaaaaaaaaaaaaatgacaaacacaaaatattggttattctcaaggtaagaggaggctgggtgatgggataaggaaggagcccacggatatatgaaggttattgaaaatgccctaattattaagtggtgggtttggggtgtttattttgtctttgtaatttgtaatttaaatagatcatatatactaatagatgtgatatattttacatgttatatttatataaatgttttacagatgttgcatttttataagtcaaatattaggtaataaatattaaaaaaactgctaagggaacataaaccaatgttaatgtagcataatagaaagaaatgaccatagttaatgcatactcaaatctattataatggtgatgacatggcatgttcttatgatcgacctttaaccctgacaatgaacattaagtaatgt

SEQ ID NO: 5307 - DNA, 1396 bp, Homo sapiens
tatctttcatttatcaattgtcatctttttgaacttaaagcaaaatctattatattatctgggtttgtgacttgagctactgagctgaaacttctccaggggtgattcttgagctaccaaatgaccaggaagagttttctcagttttctgctcttggccgagactgttggacaggatgattcactcagttccacccagctccgaaatatttccctaaagtatcttctctgaatatagctttattgccccatcgtattcagactatagaaattaaataaatacagtctgttaattcagacctttgccacatgcacaactcagcttcctcttcaccacacttgattttaccgtaggacaacatggtgtctttagatagttgaccagccctcccagttgactggcatttctggccatgtcattcctaaatccttcaattatatcattcaaaccattcatctccttgcctgtgtctcatgggtagcttaatctacttaagagttttttctccattgtttaaatattttagcaccattccacaaaggcccgcggcgggtgttgacgcgatgtgatttctgcccagtgctctgaatgtcaaattgaagaaattcaatgaagcacaggtaaatggtgggagtaactatgactctcttaaggtagccaaatgcctcgtcatctaattagtgacgcgcatgaatggatgaacgagattcccactgtccctacctactatccagcgaaaccacagccaagggaacgggcttggcggaatcagcggggaaagaagaccctgttgagcttgactctagtctggcatggtgaagagacatgagaggtgtagaataagtgggaggcccctggcgcccccccgtacccgcaaaggggcggggcggggtccaccggccttgctgaaataaaagaggatacaaacaaatggaagaacattccatgctcatgagtaggaagaatcaatatcgtgaaaatggccatactgcccaaggtaatttatagattcaatgccatccccatcaagctaccaatgactttcttcacagaattggaaaaaactactttaaagttcatatagaaccaaaaaagagcccgcatcaccaagtcaatcctaagccaaaagaacaaagctggaggcatcacactacctgacttcaaactatactacaagcctacagtaaccaaaacagcatggtactggtaccaaaacagagatatagatcaatggaacagaacagagccctcagaaataacgccgcatatctacaactatctgatctttgacaaacctgacaaaaacaagcaatggggaaaggattccctatttaataaatggtgctgggaaaactggctagccatatgtagaaagctgaaactggatcccttcctt

SEQ ID NO: 5308 - DNA, 1198 bp, Homo sapiens
gatttgggactgcacttttagaccctttcacctaaccttccttcacggtctttccgctcttctagcctcccctcgattcctccctactttcaggcgattggcaggttaaggagctaattgttaagaggttttagatgctgaactaaggaaggtctgttacgcaaaagatagaacccttgtaggaaaagcctggggcccttcaacatgggtggaaatatctggatggatacttctgaagctattgactgaagctccctgagccttctcggcttgtagagaaggcccatccttccctaccgcgagctatcggcttaacagctacaatcaaaaaagataagaatgggcagtttgaatcgcggtgggacgaaggagtctcgccatgggtctgattagccctttctctgccttgcttgagcttcagcagaattcgaaatgactggcggtaaggctgggaaggactccggaaaggccaagacaaaggcggtttcccgctgccagagagccggcttgcagttcccagttgggcgtattcatctacacctgaaatctaggacgaccaatcatggacgtgtgggcgcgactgccgctgtgtacagcgcagccatcctgaagtacctcaccgcagaggtacttgaactggcaggaaatgcatccaaagacttaaaggtaaagcgtagtaccactggtcacttgcaacttgctatccgtggagatgaagaattggattctctcatcaaggctacgattgctggtggtggtgtcattccacacatccacaaatctctgactgggaagaaaggacaacagaagactgtctaaaggctgcctggattccttgatatctcaggactctaaatactctgccagctgtccagtgttgcggattccagtggactgcatctctgtaaaaaacacaattttgcctttttgaaattctatgtgagcaatctggaagtttaattagctttccaaccaaccaaatttctgcattccagtcttaaccatatttaagtattactgtggcttcaaagaagctattgattctgaagtagtgggttttgattgagtggactgtttttgaaaaactgtttggattttaattgtgatgcagaagttagagtaacaaacatttggttttgtacagacattatttccactctggtggataagctcaataaaggtcatattacaaacctaa

SEQ ID NO: 5309 - DNA, 1221 bp, Homo sapiens
tatagccctttttgatatgtttattaataatgattcttaatggggctcataataagtttaatatgcacagcatcttagaaaagtttaacctgcaaacacttttaaaacataatgcctacttgatttatatctataaaaagactgacaggtaattatatttggaaaacatttaatgcactaactttaaagaaattgaaaattcaggtggataaatagtcttacaaaagacaatgtgctttatgttatacctatagctttggtcccatctttaattgagaaacatttatctgtataaaacatatttttggataaatatatatatatatatttgtatctctacagaaaggctctaaaaagcatttgaggaaaatatttggttcccttttctataatcatcctttaagattcttatagctacatttggtttattcatcatatttacagtatatatattgttcttttcagtgttcacatcttgttccccatttctcacttgtgtcaccagctgtttgtgccatttttagtgtaaaagttgcagacctattagatctgcagtttaagttgccatgctgctaggaaattgtcctttttctttctagctgttaacctacttcctggaaaaagtagtagctctctgtagcattatggagtttcagtggaaccaaatttttgccattaaaaactggcattatactgaactatacattgagaaatcaatcaaaataaaaatttttactttcacaagttgtatcctggatgtttctgtcattgttggtgtttaggctattttggtatataacctcattaaaatgtaccatatttaaaacacttcatagacattcagaataacccttttcaaaattgtgttctgcaaataaacagatttgttccacagaatattggtgaggactactggggggatagatggtcataaccaaataaatctgggaatcactggattaaactaacctaaaggtgtctctttattatgggaccgttcagtccttaatatgcaaacgtgtttcctggtgcaccaagaatgttggatataatatgcagtgtttcccaccttatttgcctgtagaattttctgttcactgaattactatagcactttgttttctgcagcatacactgtgtttaggcaaagaaaaaaaaaagcccttgacatgtcattaccaagggctaatatatacacagaagcacatatacacacaagta

SEQ ID NO: 5310 - DNA, 1176 bp, Homo sapiens
gtttctctaactcttcctcctttagttctcaattttgtttgtgatgttctcattagcattattattatttgtaaatatataacacttccagtctgtcttataagtgtaattccaacagttactttgtcttaatttaagtggtttcaatgtcaagcatgaataatttacacaagcttctctatttctgagtttattttaattcactttcgatttatgattagctaggtgttattgtcaagtgggttttccaagagtgactcctaggtgttatagcctcagagttcttgcatatttgaaaatgtcagtttcctgtgtagttgaatgacaacttgcctgagtacaaaatgtggatcacactaaagactctgagccacagtctcctggcatttgaatattggtcatgtttctttattacggtttctttgttcttaagtatggttgttattgcaaaggattttctaagtttctttgtttgctttttaaaacatatcaagaatgagataacattttacatgggagagatctgtgccaaacagaaagagaaaggggacaggccaagcctttatgcctgagaaattgtgggggaaaatagagggacagatgaagtgagtcggtagggtgctggggtctctctcttcacacccattcttttttcaagacaacactttttgcagaggttggggcttggcctttaacaacaaccagatgggtatcagggtgcctactaaaactgggccaggtaacttggttccctgaacataataggggagattgcaagcctctagaaaaagctccatgtggccacttctaacattgcacaggagccaaggtgaggagctgtcagaggcagacaagtggatgggtgagcctgaagcacgttagtagttctcatgggccccagagagggtacaagagagaaatagaataaagtaggcagagaatttgaggccagtaggaaatgaatggacccctgagctccagaaagtgaacaaaacattgctcccataatgccggatgggagtatcctaatgggcgctgggtcacaggaccctatcagaccatctgtggatacccagaggacacaaaagggaatctgaggaccctacactgctgctaatattatgttatgcagaacacacattcacacacacacacacacacacacacacacacaca

SEQ ID NO: 5311 - DNA, 1219 bp, Homo sapiens
gctccatgatgcagtccattgccaatgagcacttggaagagccctaaccagtgtcacaccagtgatgaccatctccaatatggaatgatgcaaaatcctagatcctatctccaacctaagaaccctgtaccatggaggcagacattcatccccaggagatggcattttatggcctaagtatatatactaggtctgtaccgcttgtcattttacaggctccttacagaccatatattctgtggttggaatcccttggcatcagctgctcctgtactcttcacatgagcagttatgagatggcagtagtgcattttatgctcgcaagtgcatcattttttttaatatatcacagccccaatcctgccttagctaggcatagtaacaaagctgctgtcttcctgtactgctaaaggcagacccagagacagtattatatatagttcacttttattcacttggcttagctcttagtgttgtcagagctaccgggctcctatttcaaagtaacttatgggtggctgtgttcttctggagcttcagaggggcacaggactgctctaaatgctatcagctaaagtgcctggtgacctcacaactaaactgaattatgttctgatgcttttttccagtctttaagtactcatgaattaaaccacacctactttaggatgaaacttcaaatggaaacatcagtgattctcctacctttaccaattttagatagtgatccttcagtatctaaatttcttcattagtaaatgacagatggtattggtgagtcttcacaactgtggtcattgatatttaacacatattctgtacaatatattacaggttacagaatggtatgttaggccacctgccactgaaatgtcaattgatgatctttttctcttcagtttttcattagtgttgtcacaagaatatttcaccttcattttaaaacatggatgaaagattcaccatgttgagttggggagtgttttgggagtgtgaatcaactgtgtttttactattgttctatgtatattcaagtttaataaatgtcaagatacatatatacatatatgctgatacaggtatatcagaaatactatatatacttaaatatataatatcttcaaatatatacattttatttattaatgctgtttgaattatattttgctttgtgtatttgcatttttacttactgatatttagtgcttaacattttata

SEQ ID NO: 5312 - DNA, 1109 bp, Homo sapiens
attctgtcaccacaaagctcttccttatgttgtcccttaactactcttctcttcacctctgctaccctactatctctagcccttggcaaccatgaatgtgttctccatctctatgcttttgtcatttcaagaatattacataaatggaatcatagtatgtgactttttgaatagtattctatgtttttgagtagtgttctgtgtaccacagtttgttgaacccttcacctattgagggatgttttgtttttcttcagtttttagctatacatataaagctgctgtgaatatctatgtatgggttttgtatggacataaatgtttatttctttgggataaatacacaggagtgtgatacctcagttgtgtagtaaatatatgtttagtgttctaggaaactgctacactattttccagagttgctgaactgtctggcatcacaatcaggaatgtatgagagattcagtttcttctcatcctccacagcatttgtggttgtcactatttttattttggtcattctgatgtgtagttatatatcattatggctttaatttgacatttccataatggttagggatgttgaacatcttttcgtgtgtgtgtgtgtgtgtgtgtgtgtgtgtgtgtgtctggctgtgtgtctttggtgaaatatctctgtcttatgcacattttctataaaattgttttttttttactgttgagttttgagagttttgtatatattttagatataaatcctttgttagatatgtggtttgcaaatcttttctccctgttcatagtttgtctttccatcctcttaacatagtttttcatagagcagaagttttttattttgatgaagtccagtttatcagttttttttgtgagtgtgctttgggtatcaagtctaaatctcctcaccaaatctagatccccaaaggtgttctcctaggttttcttttaaaggttttatggtttacatttaaatgtacattttgaattagcttctttttatcaggtgtcatgtttaggtcaaaggtttttgtttcggttttttgcctgtggttatccagttgttcagcaccatttgttggatagctctccttcctccattgaattgc

SEQ ID NO: 5313 - DNA, 1366 bp, Homo sapiens
gaagacgccgcagtaaatcatcaaaagtccttctgttatttcggtcagcctttgattgacccacaagagacagtgcttcgtgtcccagtcagcaaatatcagtgtcttgcctgtgatgtggctatcagtgggaatgaagcacttagccaacacctccagtcaagcttgcacaaagagaaaacaatcaaacaagcaatgagaaatgccaaagagcatgttagattattacctcactcagtctgctcccctaatcctaacaccacatctacctcgcagtctgcagcttcttctaataacacctatcctcatctttcttgcttctccatgaagtcctggcctaatatccttttccaagcgtctgccaggagagctgcttctcccccttcttctcctccttccctttccttgccttcaacggttacctcaagtttgtgcagcacctcaggggttcaaacctcactacccacagaaagttgttcagatgagtctgacagtgagctgagccagaagctagaagacttagataattctttggaagtgaaggctaagcctgcttctggcctagatggtaatttcaatagcatccgaatggatatgttcagtgtgtaggagtgaagacaggatcccgtgcttaaaaaaataaaaaataaaaaaataaaaaaaaaataagactttaactgcagttccaaagcttctctaacccaaaaattacagtaccaaatgattgactcaggattgtttttcccatattgatatgctggcaatataggatggtatgtaatggacagaactgatgcagatggttgaatgcgcttgtactatatgctaaaatatggaaaaggaaaaaaaaatctcacaagttcttttggaacttgtttcaagccaaaaactctcaagaaagcaaattgcacctcagctggattgatttccaaatgctagcatgtactgtatgggaggatgatccagatgtttcaaagagaatttctcttagtttagttaggtgtaattcagtagctttaaattctcaggtcagaacataacatttctcatttgttaaaagcagcaagaagcctggtaaaactgtgacttttccccaaacgtcaatctttattagaaagcattttctaggtgtgtttagtgtacaaagagactttataacccttactggacaacacacagatccttgagctcacgctgcaggatagtacagttttaccgcagagggaatctggaacagtggaatcatgtgtctgccctgtgtattgcagtttgtattgccacaagctatatttataccagtgtcacccttttcttgtagaatatactaataatctgtgccaactctaccttctcacttttacctctg

SEQ ID NO: 5314 - DNA, 1177 bp, Homo sapiens
atccggaggcgcctgctttgcgagcgccccctagcggcagcctcggaccggtgctccctgtggtcacctccgcctccaaactgtcgccgcctctgctctcctcagtggcctccctgtcggccttccccttctctttcggctccttccacttactgtctcccaatgcactgagcccttcagcacccacgcaggctgcaaaccttggcaagccctatagaccttgggggacggagatcggagctttttaaagaactgatgtagaatgagggaggggaaagtttaaaatcccagctgggctggactgttgccaacatcaccttaaagtcgtcagtaaaagtaaaaaggaaaaaggtacactttcagataattttttttttaaagactaaaggtttgttggtttacttttatcttttttaatgtttttttcatcatgtcatgtattagcagtttttaaaaactagttgttaaattttgttcaagacattaaattgaaatagtgagtataagccaacactttgtgataggtttgtactgtgcctaatttactttgtaaaccagaatgattccgtttttgcctcaaaatttggggaatcttaacatttagtatttttggtctgtttttctccttgtatagttatggtctgtttttagaattaattttccaaaccactatgcttaatgttaacatgattctgtttgttaatattttgacagattaaggtgttgtataaataatattcttttggggggaggggaactatattgaattttatatttctgagcaaagcgttgacaaatcagatgatcagctttatccaagaaagaagactagtaaattgtctgcctcctatagcagaaaggtgaatgtacaaactgttggtggccctgaatccatctgaccagctgctggtatctgccaggactggcagttctgatttagttaggagagagccgctgataggttaggtctcatttggagtgttggtggaaaggaaactgaaggtaattgaatagaatacgcctgcatttaccagccccagcaacacaaagaatttttaatcacacggatctcaaattcacaaatgttaacatggataagtgatcatggtgtgcgagtggtcaattgagtagtacagtggaaactgttaaatgcataacctaattttcctgggactgc

SEQ ID NO: 5315 - DNA, 1159 bp, Homo sapiens
gctactcgggaggctgaggcaggagaatcacttgaacctgggaggtcgaggctgcagtgagcccagatcacaccattatactccagcctgagcgacagagcgagactccatctcaaaaaaaaaaggaaaagagaattacctccattagttattgctcattctttcattatatcccatatttcatactaaatagttcatctttccaggtatttctgtccttcacatgtttacagcctgatgtcatatccctcaaagtcatcaagtaactcagttccacctacttagctcctttaagtctttcttcatatatcagatcctttcattcctctgcacataagaacttatactcacatatattccctccattctatttcacagctctttagtggcagtggcccagtgtgtacaatctgttccatgtgtccagactcggcaggaaatggggagtgggagaacagacaatgaaattctgtaggtcaaacagaaggctaggatggatgccattattgtattgggcttggagtgagaggaccaggtttgcagcctatctgtgctcagctgcatgacttgggacaagccacttgaccttttgaaccttggtatcttcagttataatacaggaatgatttttagcccataaggggctcaagtctatcttatattcttccttcatcccctctcctttattccctaaggagaatgagggctgacatggatgaatcaagggcttgttcctgggccaactggtgagtagtatggtctcaccctctaaagaattataatctctttgaattgcaaatccctcatggctagtaactcaggatgggtcctgggctactccagcctaggagctattctgctctgatgaagtaaaataagccaggcctgctataggcttagaaagaatctccttttcctctcctttgctgatctcatattttcttgaaccagcctctccttggactcggggcttaaaaacagagggttgagaattaagtaaagcttggtggcaggcaagtaaagcttggggcctacttaccacattgctgcctctgctgtgtcacgaggagccctacaagcagtccagcctggctcccgggcatgcccccgggttcaggggcaaaagactttgccttggctttagcacatgtctctgggg

SEQ ID NO: 5316 - DNA, 1224 bp, Homo sapiens
gaactcctgagctcaagcagtctttccacctcggcctcctaaagtgctgggattatacgcatgagccactgctcccggccaatgataaattattatctattcactcaagatagacagaaaaatagaatgtacttgaaatttttagtaaaatatcttacttattaaagagtttaccattatgaggtgatatgttgttttccttctatgaataaaagtaaaaatcagaataaaaatatacaaaaataaattttaaaaatatacaaaatgaacagatttcaagtgagataataaaggttgaaatggacattatgagataattgtttcttttgtttacttagtaatgtgataagacagtctatagtactgcggacagctggcaatttaagatagcctttgacattttcagcagctatctaattttcattagctgcttgttagaaaatgtaaaaaaaaaaacaaaacagaaatacaaaccaaaaccaagcagcacagaagagtacaaagtgaaaaacaaaaccattgctatctacttccctgatttttgagtcctatttttgagagagaaccactataatgttttagtatttacctttatattttttattatgtatctctgtgtgtgtgtgtgtgtgtgtgtgtgtgtgtgtgtgtgtgtgtgtgtgtgtttatttagaaatcacaagtgggacctgtatttgtcaggttctagattataggataattcctgtaaaaatctcaaagtttctgtttctttgcataataaaatttgaacacttgctggtctgatttgcagtgtctttatttgggtttttcttcttggcagtgctccattaaatggaaactcaggaacccaggatctgtccacatggtggctttactcccacctgtttggatgtgaaaaacagaattcgaattatagaattagagaaaaagaaccaagagctctatagccaggctgccatctttaccttttgagtttgtaagtaattagatttgtgaagatatgaacatcctgtcaattttttgtcattctgtcagtttcactctatagttaacattcatgcatttatacaatgattgtcaaattatcaaaatatacatgaacgtgaacgaagtgaagttataatacacaggaggatgataatccatcaaaaatattcaggccatcagtttggatgagagagctggagagtgttgaaatgtttcaagttgtatcaaaagatt

SEQ ID NO: 5317 - DNA, 1198 bp, Homo sapiens
gaggaaaagcataactaaatccatttctgtcaatttatcctttgcttcccacctccaaccaccctcccttccaggctatgttattcacccaacaccatttcaagtacccttcttagatttttttcaaagtgtttattatctctttcatatccacacccactttgtttcaacaatttatcaaagagtcattttgtggagggagatgacagcctttcctagttcacagtcttggcaaaaaatcaatgtgattctctttttcctctcttctgtatttcctcaatattctgttttaattctattcatctacctccctctaaatttaccagtgcacttgaactttattactatagtggtttccagccaagaataattggtgacaagtccttcaataaaaaaaggtctttcgtacagaccatgacttaagcagaaggtagatgataaggtataagtctagatagaagacacactaccaaggaattaacatctggacattaagaatataatttgcctttaggcaatgagtaaacttgtaagaattgtttaatgaaaaatgactggttcgtttcaccttttacatccatatctctggactatatgaagaatgacttgagaggggtagtattcaaagcaaagagatcagttaagttgatttgtggtaaaaccggagttatagcatacaagagatgagagaatgactttaattaatattccgtaagttcatgaggattagttaatgatcagatatgaaatatgaggtagattgaagaacaaagaagagctttcatgtttctagtttggatattaagatggttgtcatttgaatggagaacatcagggagaaaaaaatagttggtacagagcattttgggcttaataactgtgggacatacaggcggaagtctgaggcttgtaagagagaaaaaaattcagttcaattattgttctaaaaggccatatattggtgatcttgctatctcatcagatttttgttacctaatcttactatcttaaatttattgtctatattttgtgttaaaatagataagaagagattaaatattccaatcctaaattaaaggcaatgaaacaataatgttttatagttctataattaaacaccattgtatatggtccaagatcaagctaatttaaattcaattgtctttcataataggcatagagtgggaagattctactt

SEQ ID NO: 5318 - DNA, 1102 bp, Homo sapiens
catttctactgggaacctgtaggtactgaatcagccttagtgacagaggagcagctttgctgcttgaataaagcctggaaccacataaggggataagactggtgggaaccagccagggatgtgcattttaaggccagggcagtagtggaggacacccagagccaacagaaacaaatctgaatggggactggcaaatacagggtcgacctagctgggccaaatgattgtgagacccagttataaggggaaggggtttggcgagataccaggacaggtctagggactcttaccaaaatacacaggctggtcggagaaagagctgaagtcagatccaattctagactggtgagctgaaagtgctgctgggacagggagccatgatcaagttccagaggggttgaactaccagaggggcaggagctagggttgtgggagaaaaataaagccaacgtcttcagaagaatcagcggtatcactgtggaggcaggttgcttgatgaggcctgtggacccatgctgtaattcaggactcagaattcctgcacagccatctggaatgaccactccagacagacctggattgttatgatctgcagaaggctaggtatctttcctatggtctcagaggttagattttattagtctctgctatttgacttgaccagagattctcttcagcctcatgtggttttagctataatgatctggtctaatgaaacatgagtaatagtacgttgtaaacatttgtctccttcccatatctgtacttaaaaaaaaaacaaaaacctcaaaatggccgggtgcagtggctcccgcctgtaattccagcactttaggaggctgaggagggcggatcatgaggtcaagagatcaagaccatcctggccaacatggtgaaaccccatctctactaaaaatacaaaaattagctgggtgcggtggcacgtgcctgtagtcccagctacttaggaggctgaggcaggagaattgcttgaacctgggaggtggaggttgcagtgagccgagattctgccattgcactctagcctggtgacacagcaagactctgtctcaaaaaacaaacaaataaaaccctcaaaata

SEQ ID NO: 5319 - DNA, 1195 bp, Homo sapiens
caccacacccggccctatcaattcttggtatggcttatccattgtttcctttgccttctttattttttggtactatcactgggctttttttcttactattgttagagttttctcttttttcctccctttcaaatgttctttagtcagtgatttattatgctagaaagtatgcctgttagcaaaactataaaagttaatgttagatgtgaaaaatgattatatgtcatttgaccttcaaagattcataatgccaccactgctcaccaaagcatgatatttcaggtggatcttttagcaagactcaatgtcacttccattggtggtactcagtgacctgcaggagtcctaactagagcattcctttactgtacccaccattaccttcagcctacaatctagcttccttcccaccaatattttcccttcttgttcttgcttgtgagtgggaatcgtattggggttttttttggagagactatttattcttttaatataacagcttagcagtatgcaatcataactttttaaaagacattaaaattcatcagtattatggtcacatttaccaatatgaattaggtggatagcatattagtaagtttcctcataaaaaaaaagaaggaaatactacatactcattttagtaaatcattttgaaatgtctcttgcaaatggttgtattatatctagttcctgtgaaaattaccagagcaactgtgtggttttctggacacattgttatccggctatttcaccttccctggcttttagtttaccacgcctttagacttcaaggtgacggtcagtacctgttaaaagaggtacctgcaactgtaaagaggaacttacttatctgtccacattttcatgtttatgtgtcagaattttttaaaaagaagtgaaaattaagacaaatacttcctgatggtattgtcaaaacaattttataaaatatgtaaaattgcaccccaccttcagtacttcttgttctccttctttattgttccctgtagcacttactgccacctaatatactatatatgttacttatttgtcttcattgttgtctgccttcctgcagtgtaactaacctctccctgatggggatggtggcctgctttgtttattgttggctctccagcaccttagaacagtgcctgacacacagtaggcaatctataatatttgttcaata

SEQ ID NO: 5320 - DNA, 1207 bp, Homo sapiens
agcccctctgtgatgacttctcatgtctcattggccaggatgagtcacatgctactgatggaacttcttggtgccctttctagctctccttttctgggctgttgtatccatcctttagctgctggtactattgattaaacaacttagaaccccttccttttctggagaattatctttgattgaatgagagctgtattctcctctatagtttgcaatcaacgactgactgatttaggggtaagcagcaaatggcagctcccttgccttagagtgatttcaggaccaacgttatggtgcagtttatgctctagagctccctgtaatttagctcaagctaaattatagctgaggccattcttgcttagtttcttcccctaccattttctgattccattattccctttctcctgagagctctccctctgtaaatcacatgcaaacaaatcactgtcttaggctctgcttccagtgaacgcagtatgagacaagaacccttgagtatgtcagtcatttgcaaaggaggggacagaattaccatgattgacttaatcatttggggtttgatgaatgtctgaaagccaaccacagtgatccttctaccgttctttctcgtctttcctatactccccaatctttgtcatcatcatgcatattcttttagaggcttaactgaatatataccaacataaatgtatttttcccaactctttcaatgatgtgtctaaaaatttaaaactgactagatgtgttaaatttaaaaaaattagcaattgctggtccaacctgggggtggggaggacccattaagttttagggaggtgattattaaattccttgacattaaaaaagttatgtcatctatcttaatgaaataaatgcatttttatttacttttcacattatttatatctttggacaacattttctaatctcttatttgaaagccatctgatattacattgtttgtgctgatttatatgttcttttggcactattataattattgaaacatgctaatgtttctttgaaaattagcctaaagctattgcatactatatgtaatatatagaaggtatatgaatccattacagtctgtattaaccctttggatggtgaagatcttaatttgatctgataactttgaaaggtagtaataataggtgccattcaatgagtgtctactgagtgtcaggcattttgctgggta

SEQ ID NO: 5321 - DNA, 1099 bp, Homo sapiens
acctttcttttgtagtaaaaataacattagttgatctacttttgtattctacagaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgacatgtttttctttccccttttgatttataatttgctttaagcttaccagtgacctcttaattgccaaatccagttccttttttcctgtctgccttgcgtttctgtgcctgacaattggcacttttgacagactatgcccttccgcctggtcttctgctgtagctctttttctagttcgctccatgtttcttcagcatctttattggattctccttagtccttcattgacttctctattgctcttcctttagtatttctgttcatagaacttttgtccttggctcactcatcattttttatttacttccaaagcttcactcatctgtttcatcacctgtttactaagaactcccaaatcaagcctcttgtctgtcatgtgtgctgtggaatctgtgtttctactggatcactctacttctttcttaacagtcttaatgttagagacattgagagaagtacataaagcacagataataccacttacttccaaaaatacaacgttgccagcactctagaagcctttgttgtggtctttacaacctcctctaccttcccttgaggtagctactgccctggcttttgtgatcataattttcttgctttcttttatatttgtatcacctctgtatgtatccttaaagaacattctttaatttgcctattttgaacttcatataaatggaatcatacaatgtgtattcatcatcttctttcactaaagagatttatttgtgagatttattcaagttgtatataaataacaatttttttcattgctttaaggtgttagagcctgggtgcagtggctcacacctgtaatctcagcactttgggaggccaaggcgagtggatcacaaggtcaggagttcaagaccagcctggtaaacatagtgaaac

SEQ ID NO: 5322 - DNA, 1184 bp, Homo sapiens
tatggcccataaaacctaaaatagtttctgttttgttttgtttttgctgaggactgttgatggcaatcaataaaatatttttttctgaattttattttgccatacaccctgaatatgtttataaataaaatattttctatctggctgtttacagaaaaagtttgctgacttttgagtagatcatacctgtcactttatagatgtagaaataaggctcggagacaatgagtgaaatattctgagattacacagttaattggtggtcaaattgcaaacacagttttgttctccttttaactgcttccattccattatttttgttagagggactgataccttggtgagataagaaaatctgtggtacagaattttgcttatgaattttatatatatatatatataaacactagggataatctatcaactcttagataacattggtgtacaaaaactttttaaatttaggtacagaggtaggatttgattgtagtatatatggtttcctgcgtataaatctttgcactgatctgctaagcagtttgataatatgatactttttgttgcctgtgcagccaaatgggcggactgttgaagtggctgagggtgaagctgttcgaacacctcaaagtgtaacagcaaagcagccaccagagattgacaagaaaaatgaaaaggtaagtttgggagcatatgaaattgtatgcaagactcttaatagaatgacatataaggataatgcttttctgtttcataagattgtatgtatacctctcatttaaacaaaactcagaaaatctgaattaaccatagtggatgggtggtaaaagtttaactgagttgtttttgtttttttaaaggaaagttgcatcaccaaatattttaaacattgctgtggcaatactaaatattcattataccaaaaacaattcattcacaacttgaacatcttgtgtaagttttcagatatataacatatataccttttattcaaaaacagaactgtggaattgtgttacctttgttagtaagacacatctagcatgaaaaccttagcaaaatcgttcagtgatgtttagtgttgaaatagatttctgttgtgttggaaacataattgtctatttactagacatagattaacttcatttaacaaaagaaaatgtgggccaggtgctatggctcatgcc

SEQ ID NO: 5323 - DNA, 1165 bp, Homo sapiens
attgcagaaggatgatcctggatccactatgtagctttgcattcattctctgaaactgcttcctagatggcttcaaagctctcaaagctccactagtttgaacctgtaaaatgtttgattaactgagacaacttgggttgcttacctttagctctagagtgtagctgactcactggaaagtttttgtgctttttcaaccactggcgccagggctgatgcctgtgtttgtgtgtgttgttcactgctctatggtgcctgggccagggggaatgaggtaaaatcctgctgttgtcttcactccaagccttgtgcacttggctgcaactgaatgggctggcagcatttctgccttgggaatgtttatctgctccctccatgggtggggcttagtgttgagagtcaagccactgaagaagttgcctgtggccagcctgactccatgtggtcagtgtaattttctattataaggattgcatcctggggttacttaaattcttttttttttttttttttcttgttgcagatcatcaatgctgtggtactgttgattttattgagtgccctggctgatccggatcagtataacttttcaagttctgaactgggaggtgactttgagttcatggatgatgccagtaagtagtagatatttgggtattttcaagggcagggaatctgactgccagcacttcctattaaattacaaatatagactcgtgagttcatttgagctgatatataacttgtcattgcaaatcaacgaatatttgtgtgcgtctaacattctgtcttctaggtgcaagagtctaaataagatctattttcatcttatgttaacttacccacttaaaaatgattgcattatcatagactttctaccctgggccttttggccttttttgagaggaaggggtataaatgccaggaaggaaggtgaaaaggcttgtgcttatctccttgtgtcttctattatgtttcagtatttatttttattctaggagtgatccttttccattctagaaatgatgttgcagattatttgggggaatttagggccttttcccagtgaatggaaatatgtacagggatgtggatgtggggtaagcagggaggaagctaggctcccagcttgaagatcactgcagcctcatcattttataatcat

SEQ ID NO: 5324 - DNA, 1176 bp, Homo sapiens
ttaagaatctctgtttaaatctctcgtttgtattatgtggtactaggaaaaccaatattatactggaaatttttttttttttgggaagacggggtctcactctgtcacacaggctggagtagagtggtgtgatcttagctcactgcaatctccgcctcccaagttcaagtgattctcccacctcagcctccagagtagctgggactacaggtgtgtgccaccacaccttgctgatttttgtattttttagtagagacgtgatttcaccatgttgggcaggctagtctcgaactcctgaccttaagtgatccacccacctcagcctcccaaaatgctgggattacaggtgtgagacaccacacacagccagtcctggaaatgttcactgaagcttatttgttgactgcttatatttggcatactggtttccaccatgacctgggttaatgaattccaatttttccatttcctttcagattaataaaatactttgaatttaagaaaaatattgttttataatattgaacacattaactttctattttctgttctgtttagcaacgcgcagcctggatcatcccattcttctgttaccagatctttgactttgccctgaacatgttggttgcaatcactgtgcttatttatccaaactccattcaggaatacatacggcaactggtacgtggacctcttactgctccttttcattaattcttttcattagggaagctggttaagtaagggatgtgtagagatacacagacattaatttcaggatttttagcttgcagctgagttactcataggaaatttcttttttcttttttttgaggtggagtcttgctctcgtcacccaggctggagtgcagtgatgcgatctcggctcactgcaacctctgcctccagggtctcagcctcccagctagctgggattataggcatgtaccaacatacctggctaattttgtatttttagtagagatggggtttcactgtgttggtcaggctggtcttgaactcctgacctcaggtgatccacccatcttggcctcccaaagtgctgggattatgggtgtgagccactgtgcctggcctgataaagttttgagggccggggttatgattggtggcagtgatggtggtggttgatgtgcctacctaaattatagtcca

SEQ ID NO: 5325 - DNA, 1203 bp, Homo sapiens
ttgcaggaaggaaggggtcccttctggctgacaaccccaggatgaaaaggcctgatgacgtgggcacagaggtcccctatttaaagtgataagggggcccgaagaaagcagggctatggctgggagtgctggtggaccaggccacattttgccttgtgggtgtgccccttacatctggactccagagctttgcataaggtgtgcaagagacaaccactaagagagcccccaggtccctctggtcacatctattgctcactgcaactttcctgtcactctgaccccagggacatggccttgggggaaaagtgctgggagtccaacgtcattgtacttctgaggtggtctgtgactggctcacttagacattgattaacttttcaaggaaacacaatcattaggcaaattccatccacctatcaggaaagatataaacatcagcaaacattaacccagacccatgggtttacagctcacagctgcccctgggcacactggcggtaccagcttgccccaggtccaggtagctgcttggttgaagggaatgaaactcacagtcatgtgcaacagatacaggaatgtgacccttggaatgggggcctgtgcatcaccaacgtttgtgaatcagcaagaaacacaaaacacacatgccctccaaggctgaatgatagctcatgctgcatctgtttttttctgacaaggctaacctagttttaattatttatactaaaacttataagccactaaaaatgtcctgcagaatgaggatacaagggaaagaagtcttggtaatctgagaccctgctgcagcaggagctctgctcttaagcctcactggcaacaagctcgggctgtttctggggagtcctttgctgtgtggtcaaggcagaaagggtgggagaggtttctgtgagtttctgttggaggagtatgggtggaaacagagctagggagtctaatctacactcaaaaagcataaacctctcagagactgctaaggccagggcaatataggactgaaaaaccccctccatgaagcccaccaggccactctgctgtcacaacccccgcaggtgtctgggtgctggtggctggacattctggaactcacagtaaaagcactggtcgtattggcagcaccaatagcttcactccaagatgatccctcagctgatgatctttgaccccttttatgcagttcag

SEQ ID NO: 5326 - DNA, 1169 bp, Homo sapiens
cctcccaaagtcttgaaattacaggcgtgagccactgcgccctgccagattttgtatagtaatatatatataaaatgacctgtcacaggttggctttcatagttttacctttcctttttgggtggtgcccttgggtctctactactgtctttcatcactcccaagaaattgagtagtgcagccaggatcaggaccagggattggcaaatgttttttgtaaagggccagataggaaatattttgggctttgaggactgtgttatctctgaaatgatcttgttccagtgttaccatgtcaagacaaccatagatagtatgtatacaaatgaacaggtatggctgtgttccagtaaaactatggataaaaacaaccacattgcatttggctaagggctttaatttgctactgacaagtgatagtcctggtcttaatttgtttttttaacatttacagattgatcagggaccatgaaaagaaacttgtgcttcaccgaagaaaaatatctaaacatcgaaaaacttaaatattatggaaaaaaaacattgcaaaatataaaataaataaaaaaaggaaaggaaactttgaaccttatgtaccgagcaaatgccaggtctagcaaacataatgctagtcctagattacttattgatttaaaaacaaaaaaacacaaaaaaatagtaaaatataaaaacaaattaatgttttatagaccctgggaaaaagaattttcagcaaagtacaaaaatttaaagcattcctttctttaattttgtaattctttactgtggaatagctcagaatgtcagttctgttttaagtaacagaattgataactgagcaaggaaacgtaatttggattataaaattcttgctttaataaaaattccttaaacagtgcacggatttgctttttttcaaagtctttataattgccatgcataaataggtaatatcttaatggtgctgagccgacataagaatcttttatgaaaaatgtactgttaagttcagggggtctattggttttatgtaaaaggcacaagacaattcctgtagtgcattttatgagttaaggtttccatacggattattgaaacaatttgttacatgtatttgttacatgatcttaatatttcatgtacaagactgacacccatccacttttgaa

SEQ ID NO: 5327 - DNA, 1220 bp, Homo sapiens
taaaaggtctttcaatggaaaagtatacctacctggggcatagaaggctgggagggaggagtcaagttacggagctttgaaatttttttcatggctttgtatgttgaaatttgaaatgtataacgtgaatgttgtatggaatatctttgatttatgtaaaaaaattttttagggcctgccttaagtgtgaaagtaatgactgatgaaagtggaaaatccaaaggatttggatttgtaagctttgaaaggcatgaagatgcacagaaagtaagtggtctgtattcagcaggaagaagggggtacaaagttgagttgctcttgtgttgaagtctatgtgcatactaatagctatttgacatgttcttatattttcagttatttgcattttatgcattaggtttgagagtataaattggtaacctatattgtcccaaaaccttgagattttgggatgggtttgtctttagcttttgtgacttaacaaatttgtcttaactgttaaggaaatgaactgtaagttgaaagttttgtgattttttttttttctttttttttggggggaaggctgtggatgagatgaacggaaaggagctcaatggaaaacaaatttatgttggtcgagctcagaaaaaggtggaacggcagacggaacttaagcgcaaatttgaacagatgaaacaagataggatcaccagataccaggttcatttttaattgaacaaccaaaataagacagggatgaggaaacctattttacgttgatttcagttacttccaggtagctggagggtttgagaggggaataggagaagaaatatggggtaaaataatagacccgatgtacttaggtaccaccatggttttctttttctatagttttcttttcttctttttagggtgttaatctttatgtgaaaaatcttgatgatggtattgatgatgaacgtctccggaaagagttttctccatttggtacaatcactagtgcaaaggtaagaaaacatatggttcatttatttgaggtctagtaaaaattcatacatgtagatatatgtatataaattttgtattattatagccactagagaggtgtttgcttcgttacttctaaaacttaaattcacatttgaactggttgtcatagcctaatggttaacttaaaaatggcaagcactgaactctttgctaaggaaggctgatatcctcacatgatatgcact

SEQ ID NO: 5328 - DNA, 1173 bp, Homo sapiens
ctagcccagtgatccttgttctgaattactactgttatattcagaaaaaattaagttttagtgtcattttgttgaaaatgctgcagttatgtcaggctgttgtgtgttagagtacacgattgggaagtttaaatttttattctaggagatggcaaagaaagcgcaagcgccactttaaaatgacgatgaaagctttttaatttgatagaggtctttttattggcatggtacacatgcacttccactcatttgtattgatgggagtgatccctttaaccctaggttagctagagaagagaagtgtgtattaaaagaagtggttttttttttgtgattgtagttagaggcttattcatatatttcatggtgtcatatcttaaattatggccctatttctattttgtagtgtgctttttattagggattctgaatattctcattaacagtaacaaaaccaaccatcaggcttacttaatctgaactttataaaatagaatctaatgttatagtccttgtatatcttattagatttgttggacgatttaagtctcgtaaagaacgagaagctgaacttggagctagggcaaaagaattcaccaatgtttacatcaagaattttggagaagacatggatgatgagcgccttaaggatctctttggcaagtttggtaatgtgtcttaattaaatttttacacacaaagctctgaattagtgctcagtgttaattttagctattactttatactaaaaaagtcaataaaattagacttacatggtactttaaaatatttgtggttatttgaattaagctgctggccatctattacactacaaagtagtataatgcaaataaatagaattctatccaggttaaaggttaatagcattagattagcacagtaaggtatgactaagtaattagaacagattttaaaatattttactacattaagaggctggagatatatatgtgtgtgtgtgtgtgtgtgtgtgtgtgtgtgtgtgtaattagagatcccatgtcatcagaagcatatatttgacacagccagcctacagtggaatgcagtctcatagaacaataaagctggtcagtctaagtaacatcatgtttgagcagtttaaaacaatgactttcagcgatgaaaccaaaaattcagattttccagtga

SEQ ID NO: 5329 - DNA, 1124 bp, Homo sapiens
gatacttgaaaggtctagccatcttgaagcttaaagaggaagcgttcaactgtgagaccatgtgtcctcccactccagtcaccatagtttatataatcttaagtagccagcaaaaattttgaagtaatattgactctgaaaatgtccttcctgcagcggagcgtgctttggacaccatgaattttgatgttataaagggcaagccagtacgcatcatgtggtctcagcgtgatccatcacttcgcaaaagtggagtaggcaacatattcattaaaaatctggacaaatccattgataataaagcactgtatgatacattttctgcttttggtaacatcctttcatgtaaggtaagccaaaaatgtccgatacacatgtttacattgttgagctacatttagtttagtgcttgaaataggaactgtgcagtaatggatatctttatttcacaaatatccaggttagatggctaacagattgtctctcaacactgaacaaatgttaaatcaatagcaaataaagaaaaatgggtatatgtttttccctaggtggtttgtgatgaaaatggttccaagggctatggatttgtacactttgagacgcaggaagcagctgaaagagctattgaaaaaatgaatggaatgctcctaaatgatcgcaaagtgtaagttataaatatctagctaatcatattttgaatcttatttttaataattccaaatccattcattttaagttaatatttgtcagggagaagttagatgcacataagataaaagaataaaaacattttaaagatgaataacaaaaattcatgtagttgtactggagtgaaaattaataagctaatcttgatttttacaattgaattttctacacagtaagtgtaacatacaaataacaggtttaatataattaacattcatgccaaaaggaaaacagaagataagtaaacagaaaaatgtagctttttcaaaatgagtgcattagtgaaaaatcaggaattcagacaaacctaatattcataattcttgaggtactggttaaattaacccattttataggtgaggaaactcaaagtaatttgcttttatgtactgtaaaatgagagacatacattactc

SEQ ID NO: 5330 - DNA, 1392 bp, Homo sapiens
tccctcctccccctggcctccgcgtctcctcctactccggcgctgacgctcgcgtaggggccctggcgtcagacgcgcgggggcggggcgagtgcggcgcggggtataagtagagggtgcaggaggcggtgcttccccttctccccggcggttagtgctgagagtgcggagtgtgtgctccgggctcggaacacacatttattattaaaaaatccaaaaaaaatctaaaaaaatcttttaaaaaaccccaaaaaaatttacaaaaaatccgcgtctcccccgccggagacttttattttttttcttcctcttttataaaataacccggtgaagcagccgagaccgacccgcccgcccgcggccccgcagcagctccaagaaggaaccaagagaccgaggccttcccgctgcccggacccgacaccgccaccctcgctccccgccggcagccggcagccagcggcagtggatcgaccccgttctgcggccgttgagtagttttcaattccggttgatttttgtccctctgcgcttgctccccgctcccctccccccggctccggcccccagccccggcactcgctctcctcctctcacggaaaggtcgcggcctgtggccctgcgggcagccgtgccgagatgaaccccagtgcccccagctaccccatggcctcgctctacgtgggggacctccaccccgacgtgaccgaggcgatgctctacgagaagttcagcccggccgggcccatcctctccatccgggtctgcagggacatgatcacccgccgctccttgggctacgcgtatgtgaacttccagcagccggcggacggtgagcgccgggctccgcggtcggccgggcgggcgggcggccatgaggctcgggcggcggcggcgggcggggtaggccggcgggcccggggaggggggcgggagggcatgtcaccccgcgacggccggcgggaaggcgccggggtccctggagccgcgtttcccgagccggcggggacccgcgctgccggcagccacacgcccggctacttcctcctttgcgaccattttctcggcctcagacgctctcaaactttagggtgatgacgcgccgggagggtgggtgagattcggttcctccgcggcgctcccgccagtggccccgggattctggggcgttgaacgctgagctccttccgtgggtaagaggtggaggcgctcccaccacccggagctcctgccggcgccccagcctggggaggaagtgcagttctgtgctcgaaaaataccacgtgttgaaccctgtaacctcgcaggcccgaggcctgcttctgctcctgctcctggcccagtcgcctgggggagccaccaggccttaggataaagttcctgtggcgatgt

SEQ ID NO: 5331 - DNA, 1170 bp, Homo sapiens
cagtgtctccccagcttgcccgtcggccctccatggtgctgcagcagtggctttagccagttgggaaacccagagatccaaattaactgctcagtgtgcagccagagtcttgtgaaacctacagtaagctgaattcagaaaatgtgcgatgacatgacaaggccacagagacagagcgaagggaacaggctccttggggacacggatatgctccacaggggccacttgcttccactgggaattatgttaatcctgtgcgggtatttactgtggcttctctcctcaaatgcacttccctccaactgatcaaaaagtccccactttctggagggttgggaatgtgttttattgttctcaataatatccagttttggatgtgagggcgatctggctgagacatctgtcaccccattgattgccagggttgattcagctgctctggctggctaggcgggtgtctccttcctcccttgctgctccatgtgcaccctcccgaagccgcacgctcagtggaagaggacgaccatctccgatagaggacgactggtcttcggttaagggtatagactagctgcgctcccctgctagaacctccagacaagctcttgataatatccagtcttaaagaaggatctgttacatgtgcttcagaacaagtggattaagtacaattgaagattccatgtataatttcaatcatcttttagttaaaaaaaaatttaactgaaagcatttccgtaagagctactccaacctggagatcaccaagtaaaacggaggagaagggccaaaagtttgagaaaatggatttcagtttgagctgaaatactaagtaaagtcctacctaaagttgactttatccccaagtgaaatggagagaaatcaagagggtaacatatgagatcagtcaaccgtgggcatgacagggagtcagtgagtaagcagttttagagaatcaacagcctgcaattccatcaagatagttgagagacagacccaggaatcatcctagcaaagcgacagcctccgtcacttgcagtggctaaaagatgtgaagacaagacaccatcaagcccaaatcttattggttacaaaaatggctgaatctaataatgctgacaacacattatatcaaccaaggtgaagtctaagtagttttactttatttag

SEQ ID NO: 5332 - DNA, 1136 bp, Homo sapiens
ggattcgccctcctgcccgcccctccgggccgcggacacacgcccggcagggaggcggcggcggcccctgcgtatttgcttccctccatttggggactgggaggcggcggcggctgtgggttttggggaggggtagagggctggggggcgggcgagagcgggagggggccgccctcgagtggaggacgagaaggaaagcaccatgacgtccatccatttcgtggttcacccgctgccgggcaccgaggaccagctcaatgacaggtaatagggctggcgggtcggcgggcgcggggggaggggcgcccttccctccctcccctcccccacgggccgtgccgggcgggtgcgggtgtttacgcgccggccggccagctggggtggggtgcgggggtccttactgcctcctgctaggctccttccggggcaaacttctcatcccgggggcagggggccgcggggggagcgcggtgtagacgggactcgcggtgtagactggagagcgctctgtaaacccccttccccctcccgcaaggagcggcgttgaactcggcggagatgggggggtggtttctggctcccggggggcaggcggtaattactgcccggccaaggcccgaggaatccatattagtcaaagttgaattgagacagacaatgcggatgggggatggtggaggtaaaaagagagggaagaggagaagcggggccaggggccccggggtgggctgggctgggcttgtcccgggcccccggcagctgtgtccggtggggtggtctggacctggggatcccggggtcgggttggggagagaagccgattcccggcagattgctgggagcgggcggggggtggggggaaggtgatagttgggggagggagtgagggaggaagcgccatgattattgttattattattaaatttgagcccctgcagtgaggtttgcctgccccgggaggggatggattcaagcgggggtggggaagtgcattggattccctttactctcctcctgaaatggtgctggcagctcctgctactagcccctgtggtgcgagcttttttgtttccttttctattctaatgatagtgttttcctgagttgtaatttgacagctgaaaaccgtgcgtaga

SEQ ID NO: 5333 - DNA, 1131 bp, Homo sapiens
aggtgtctctacaactttctgctcctttaaatttagtattctatgtgtttcagatttcatgtttcgagtgcttgcaaagaatctcaagtatatgtacatgctctatctgatgctcgatgtgtgtttgacatggctgtaagttctttcttttaagttattttgatattttattttagccaggatgttaagttaaagactaagtattttctgcctgtgtgaattactctgactacattcaacgtgacacacacctcatttttattatataagcattcagagctctgtacagtcacaccttttaagcaggtaaaggagtgaaatagtaatttacttgcataagtctagaagagagtacaaataaaatcaaagagacagcatacctaacattgaataatctgtttctatcagtaaaaaaccaagaatttgctgtactaaagatcagaacagatatttacctccctaggagggggtttttaaaatgttctcatatccattacaatttggaaaaacatttaaattttttttttccatctctagggagaaattggctttacgatgaacatgttagacattggtggaggattcacgggaactgaatttcaattggaagaggtaaacttctcagtagatgacattaacagaataattgctttctttgttacttaagtggtggatgtgtagagcaggatttttacaatggcagaaactaaaccctataacatctctttaaaattatgttcttagaaaaggaataggcagttagtagacctagctaactttgaaaagtttgatagaattctttgaacattatcataaaacattttctatttcagttgtgtttctgtacttaatggcacaaatgatttaatacttagaaaacttcactactacctttttttttttttttttaaagtcttcctgtgttgcccaggctggagtggagtggcgcaattatagctcactatagcttccaactcctgggctcaagcgatcctcctgcttcaacctcccaagtagctgggacttaaaaaaaaaaaaaaaaaaaaattgagtctttctatattgcccaggctggtctcggaactcctggcctcaaatgatcctcctgtccccaagtgatcctcctgcccc

SEQ ID NO: 5334 - DNA, 1183 bp, Homo sapiens
tatgctttagcaaacagactggcagcattgtgcccctgacctagagatctgtggaactttgaacttgagagagatgatttggggtatctggtagaagaggtttctaatcagcaaagcattcaaaaattgatctggttgtttctaaagtgtacagtaatatgcatgaagaaagagatggtctgaagttggaacttatatctagaaaaggaaaactcattttctggggagaaattaaagctggttgcagaaattggcatcagtgatgaggagccaaatgttaatagctgagaaaatggggaaaaagtctccagggcatatcagagatcttcaccacagcctgtcccatcacagacctggaagcgtaggagaaacaaatggtttcatgggccaagaccaggaccgtgccactttctgcagcctcgagacattcccagccactccagcttcagccttggctaaaagcggccaagatataaattgggccattgcttcagaggatgcaagtcccaagccttggtagcttccacttggtgttgggcctgcagatgtgcagaaattaagagttgaggcttggaagcctccacctagatatcagaggatgtatggaaaggcctggatatccatgcaaaagtctgctgctggggcggagccctcatggagaacctctactagggcagtgtggaggggatatgtggggttggagcccccacacagcatccctactggggcactatgttctgaaaaggctgcagacactcaatgccagcctatgaaaacagccgtggtggctgtatcctgcagagccacaggagcaaaggtgcccaaatccttgtgagctcaccccttgcatcagcatgccctggatgtgagacatagagtcaaaagagattattttggagctttaacatttaatgactgccttgctgggttttggacttgcatggggcctgtacaccctttgttttggccaatttctcccttttggaatgggagcatttacccaatgctgtacccccattgtaccttggaactaactaaattgttttttattttacaggcttataggtggaaaggtcttgccttgtttcacatggggctttggactagaacttttgagttaatactggaatgagttaagacttttggatctgtttagaaggcatgattagttttgaaatgtgag

SEQ ID NO: 5335 - DNA, 1196 bp, Homo sapiens
ataatgcaagacttcactttagaaaaacacaagccagaaaacaatggagtaaatttttaaagttctgaaaagaaataaaacctcatcaactgaaaattctgtctagtgaaaatatcctttgaaaatgaagaggatatctgggtagaaaataagcatgtaagaagaagctcggcagctgcagccattgccttgagtgagtgtgccgctctccagcccgtttgaacgctccccgcagccaccgccacccattggaatggccaacaggggacctgcattatggcctgagccaggaggtgcagcagaagattgagaaacagtatgatgcagatctggagcagatcctgatccagtggatcaccacccagtgccgaaaggatgtgggccggtcccagcctggacgcgagaacttccagaactggctcaaggatggcacggtgttatgtgagctcaataatgcactgtaccccaaggggcaggtcccagtaaagaagatccaggcctccaccatggccttcaagcagatggagaagatctctcagttcctgcaagcagctgagcgctatggcattaacaccactgacatcttccaaactgtggacctctgggaaggaaagaacatggcctgtgtgcagcggacgctgaggaatctgggtgggttggcagtagcctgggatgatgggctcttctctggggatcccaactggttccctaagaaatccaaggagaatcctcggaacttctcggataaccagctgcaagagggcaagaacgtgatcgggctacagatggggggcatctcaggcaggcatgactggctactggatgccacaccagatcctttgatcccaccccaggccttgcccctgccctcccacgagtggttaatatacatgtagatatatattttagcagtgacattcccagagagccccagagctcttaagctcccttctgtcagggtgaggggttcagcctgtcctatcacctctgaggtgcctgttggcagcctctcccccgtgcttactaatacattcccttccccatacccatcaaaactggaccaactggcctcttcttttcccctgggatcaaaatttaggggcctcagtccctcaccgccatgccctggcctgttctgtctctcctttttccccctggcctgttctgtctctgagctctgtgccctccgttcattc

SEQ ID NO: 5336 - DNA, 1196 bp, Homo sapiens
tttaaaaatctctgtcatatgaagccttttctatttccagggatatttatctaataacgagttacagaattcaaattaatgaatcataagcctctgacaaattgattaccacttatatttttattagtaatgattgcagttattgcctgattcactgcatcttcaccttcacttttgtttgatcattattaattggtgtgtagaataaacttgtgccaatcttttttttttttactgtcaagttattttatgtaataactatttcttttgtgaagtttttatttgtcttagtgtttcttaccaatttgtatgatgtgttttaaatttgaataatgcttctatatcaagtgagttaatttttttcttctttttatattttggaatgttttttattcagctcattaattcatctggaatttgtttttccttttctctctggtgtgccatatatgcatatatttcacaccccaccttaaggcacccccccccccccccgcccccgccacctcaaaattacactctttttacaagctttgacagatttgtattaagatactgaagaagactgcctggagtggcttggtgcagtagatgtagatttttttttttttttttttaatttagaaccttattagatattccttcttaggggaatccttaaccattagttaatactactaaatgtgtttcatagagttgtttatgtgagcagggtgtctcagcaaatcagtggctaatttagagctgtgcatatagaaattaatctagtgttattactgaaaccagaaggaaatttaggagactcattccaagcaaaagcaacagaggagattgagaacaacttggtcttttgtttctgtttttagacttgtgagtctttgatacaggtttcaaaggttctgttttcaagaaaaacctgaaaaatgtctgccaagtgtgccctgatgtttctttgtcacgtagagatttgggggaaagtgtattctagcagaattcatgtaaccgaagttaaaagtgtcatgggaagctggcttaccaggtctgagttctggcccaacattttactgactaaaaggaaatataactgttcttctcactcgctatcccttcctagtctttttggatacttaccagctttatttaatggctgaacattaattagtactcaaagaagtaaaatgagcatttctagatta

SEQ ID NO: 5337 - DNA, 1176 bp, Homo sapiens
atggcccaagttgttttctcacacagaaattgtgaaaagaatttaagtgtaaaaagtaaataagtttgaaaattattactacagaacatgaatttttgaactcctccctgctgggaataagctatagaatcccatggtccttgtcagccatctctttaggcctgtttacaattgaaaaacatgactttttcttcaagtatgtctcggggaaaggaaaaaaaattattattccccttatgaatttatatttttaaatttctctaaattgattttgtttttgttttcttctgtgacttacacttattctgttaacattatttaggaaccagctatacaagttagaaactatcctttgcttctccttcgatacttaaaaccttggacatttcaatgtcttgtagctcccctgctagagaatgagcaaataaaagagaagtaaaaatagatattttaatttatgttcttagtcttcttactgttgttaagagaagacatactttttaacacagtaaaattgtcgttttttagtgtgcagttctgtgaactttatacatatgtataggttcgtgtagctaccaccgtcaggatacagaacaaacagttccctcaccaccaaaacctccctcatggtattcctttatagtcccatcttatttcaaggcaactcactaatcctgttctcaatcaccataattttgattaaaattatttttagtatacatattgattacatttccagtggacttgaattaattatatagtcttgatttgtaggttggcttaaactaaacagtttgtaaagaagaatatctggcttatttgatttgtataacttttttatggaaatactgaactgtatctgaagttttccatttccccagaacacaagtaaatacgttagaagttttagttaacccccccctttttttttttttgcatttatggtttaatattctgaatagataatagtcaaatgggtcaaaagtataacatataacagttgtaattttttggatttttactagctcggagtgtatatatgtgaattatttcagtaaaatacagattaccttctaaaacatataccagtttatactccacgtaatatgagagtgctcccttagtcttgccaacacaatgttgccaacagtgtgtatgtatacatatatattttta

SEQ ID NO: 5338 - DNA, 1180 bp, Homo sapiens
tgaaatgactcccttaacaaattccagcatttttagattgtaaagtacattatgtaacttcattcatcatgtagacctcagacagatactttaatttttttttgaaaaggtcttgtagcacacttaatctgcagatcttttctggcaggaggaaaaaaaagcatatactgttagatttggtgacataaaggtcaaaagataaactgtaagtgatacctatgtttatttttttgacagtgttaaattagcaacccctcagacctctcttggagcagtacaacctgagtaattgaacatgtcgctggggagtatgcttggttaagctgattcctattatgttgacttgtcagggaccaataattaaagctgaagagcgatgctcattagtgtctgcaagatgattcgaagaatgagaagaagtccttgaggcacacctgcaaaaggcaggcattgcatggaggtgagagcagacggactggcctgcttttctgctatgttagcaagccagcgataaaggggatacactaaattaagtgttgcaaatgtattctccccaatttagattataaaatgcattttacttccgcctttgaacataattttattccaattttattccatgtaatcatattttgctcaattatgcttttaatgctatataagatgttttagaaactagatataagtctattcaaaagcactttgaaaaactttatactatgaatcatttcattcattttcctggaagcatcataataatcaaaatctgctttgcttctttgaactctcaatactctgcacgtaaaacatgtgagttatccagctttgatgataaagactttagtggcatacatttgtcacatttacttcacaaaaatggaatttttaaatgtgtatttaacacgtactaaaccacatacagtatacaagcattggctcccgagaaggccagaggaaaacactacatcataagtatagaatttatatttatcacaacttgagcaaagctgttgacttttggaaacaattcaaactttttagcactggaatgatacagaaactcaatcctaaagctctgagaagcatttttcttcttttgaaatttgccttaggtaggctcactttttacaaatctatcataaaatcatgggatatacaaatatcctaatattttggaata

SEQ ID NO: 5339 - DNA, 1216 bp, Homo sapiens
aaccaagagggtatatacacagtatgagcatatgtatacacacatatacatatacatgtacatacagagagagatttattataagaaattggcctgtgtaattatggaggctggcaaatccagaatctgcagaaccagtgtcccagttggagttgaaaggctagaagctgctgtagaaccaggaagagctaacatcctagtttgagtccaaaggctggcaggctactataaaattaagaaccaatgtcccagtgcaaaggccatcaggcaggagaattctctcttagtctagaaagggtcagcattttgttctactcaggccttcaactgcttagatgaggcccacccacattatggaaggcagtctgtgttatccacttcaccaatttaaattttaatcccatccccaaacacccagaatgatgtttgactaagtacccgggcacctcataaccaagtcaagttggcatataaaactaaccatcacacttgctcttgtattactgccattctagtggagcacacacagtcatgctttttctatgtatgctcaagcttcagattgcggcaaaactctaattttccaagactgcagcagagtaccatgttcctgctgcgggaacatcctcactgaatattccctggcccgagcctctacaaggagttctggggaatgtttttagccctgagggcacctaataaggctaaacaatacagaactgggttgtaagaggtccctctgatttctctaagttctgccaggatatgcctatgcttaccttacccccagacaactcagagctttggggttcgaggagagtcttgaaggaataagagcattcaagaaaagaagaatattttaattgttttttctttgtttaattctgtcgtgtttattcttctgcatatcccaagtgctctctaaagaaaaaatagcagtaatgctaccaggatttcctccttccaatgcatcctctctcaagcagtgactcaatttcttgctcggaaatggtgcctccagccattggtggctcaggttgaaaatgtgagtcatctctgatgtctgtctttccctcagaccccacttctgggcattgtaaagttattaaaaatatagccagagttttactatttcttattacttcttccctgccaccccagtacaaagacaccattacctcctgcttagatgactgtgatagtccgcggactcctc

SEQ ID NO: 5340 - DNA, 1220 bp, Homo sapiens
tcataatacttagaaaatattaatttttaaaagatgatttggtaacacactggtatatggccaaatttgtatagactataaggaactatatattcaacttcctggccacaatgctgaaaaactctgtgtgtaactaattacatgtcttatttagatacttctcccattcctgatagaagtgataaaaacttaggaatccctctttacatactgtcatcagcttcctctttctttagtctggctttccgtatcatcagcaggaattcatttgggtatttttaatcttgaaggtaaagaacaagcacctttggagatgagtatgcatccagcggcaagcgctccactctcagtctttactaaggaatctacagcctccaaacacagtgaccaccatcaccaccatcaccatgagcacaagaaaaagaagaagaagcataaacataagcacaaacacaagcataagcatgacagtaaagaaaaggacaaggagcctttcactttctccagccctgccagtggcaggtctattcgttctccttccctttcagactgagaaggggacaaaaagacctttcctttcatgtccagaagaatgtatgtaactaaagctttgtcctctgtgaagaattataaaagggaggggggaaaggattcgcctctcctacagaaattctgaattcatttaagttctaagcatttgatttatgttatttatacagttgggatctaattaggaaaatgtgttttgtagttctggataaactatttcatccgctgtttcctccccaaaacacacacacagagcaaactccctttcataaaagccctcatatccactggcagtccccgttcgcatcatggtctccatgtgtaccgccaaagtcaattatgtttgaaagcctttggtggatgttatggggcaaagttatgatttacacagaagcaactgccaaatctgtggtgcaaccactatctccagtgaaatattgtataacaccatttggaactactgaaaagacagtggcttttctacagtactcttccttattgcaccatttttgtattaacgtagaaactaagcatcagaatttatgaacaaagaatatgttatttttccttttgctctaaaatactgagatttggggaagcaattcttttttaaaaaaattttgaataactatcttttgataacacattcggcggttacgatgttggaattt

SEQ ID NO: 5341 - DNA, 1232 bp, Homo sapiens
gcaccactacactccatcttgagcaacagagtgagaccctatttctttttttattttatttatttattttttgagatggagtcttgctccgtcgcccaggctggagtgcagtggcatgatctcgactcactgcaacctccgcctcctaggttcaagtgattcccttgcctcagcctcccaagtagctgggattacaggtgtctgccaccatgcccggctaattttttttgtatttttagtagagatagggtttcaccatgttggccaggctggtcttgaactcctgacctcaggtgatccacccgcctcggcatcccaaagtggtgggattacaggcacgagccaccacacccagcccctatttcaaaataataataataataataataataataataataataataataataatttggagatagcatggacaacagtgaacttggagtttgaattaaggtcttgccagaagctaaaatataaagctttaaagtgtacatatattgtagttatgagagtgcctatgattcctgggcgctgtggtgcgtgcctgtagtcccagctactcaggaggctgaggctggaggatcgcttgagtccaggagttctgggctgtagtgcgctatagcgatcgggtgtccgcattaagttcggcatcaatatggtgacctcccgggagcgggggaccaccaggttgcctaaggaggggtgaactggcccaggtcggagagtgcctatgattgagatcatccagggacagtgtgatgtgcaactgataaaagggctgaagttaaagcctcactaacatttgaggtggaagccttgaaagaagtatctgccagaggaaaaaattgcaagcaattggagaaatagaataaagcagtgtcttggaaactgtattactttgtttcaaatgagcaagttctggtttacagcaagattcatttcattctatgaaaaatagagtagcttaaattttaatttcacatcttttgttaaacttccaacattttgcttataaaacaatcaggcttttaccccactagatggcagtattatttaatgttttatagagcagcctgctttgccttttttttcttccactgccttagaaaaggaaagtgaaggaatatttattcaattatttactgagttaagcacttaactgagtaccctgtataggccgggcgcggtgactcacgcctgtaatcccagcactttgggaggctgag

SEQ ID NO: 5342 - DNA, 1177 bp, Homo sapiens
aagcttcccagggcagatggtgtcttgactgcatgtacgccatttgcaccacagctaagggaccccaaaaggcagcctgacctggcttctatatttcaggggccatgtgactcattgggcaacgctttgaaggacatcctgcttttaggggacagaggaaaaaaacccaagctatcctgggcagttcctccctatttcaagatagtacatttccagtgcattctgcagttattctgagtaaaatgggcatgaagaatggggagagagacacggctaaggctatcatgggaccatccagcacatttatctaggttggattcattgtggaggggactgcacaaaaaggaataacaggagatgtggttcattcaatggcttttgggggtatctttacagactagctaccattccctatctgtgatttctgatcaggtagaagaaaatgtgattcagggaattctactttgctatctaaattccctcaatttaaaaatcaggtcaatgtttaaaatgcaaaataattgagtatgcttattttctgctgcttaattattattattatttactttgaaatatgtaaggtcgagagaggtgagtgattgacttttattttttgttaaatccttgctataacacatttcccaggaactgagtactaattgttggcaaagggcatcattaatgttgaccttttttttttcttatttctcaggttttccttttgacttattatcacttccacatttttctggggagcagattgtacagagagagaaacagttagctaatgttcaagttttagctttggaagaatgcctaagtaagtaacaatttgtgtattttatcctaccctaaaaatgttgacttgtttggacataagctacctttatttgcacactttttcatatatagtttatcttttagttatgctacttaattatagaactatttttgaaagcaatgatgtagagtagaagagatattttcactagattcagaatatttctgtttatttgtacatcactgttaacatttgtaaaagtatttcaacaggcaaattttgtatttcaaaatttgtttttaattgtatgctagagaaggtatgtaagttttatttttctatgtataactcttgataaaatatctttttatatatttttgtagcggaagttgggtg

SEQ ID NO: 5343 - DNA, 1177 bp, Homo sapiens
tcacactttgaggcaactaaaaaggcttcaaacgttttgatcagtttcttttcaggaaacattgtgctctaacagtatgactattctttcccccactcttaaacagtgtgatgtgtgttatcctaggaaatgagagttggcaaacaacttctcattttgaatagagtttgtgtgtacctctccatatttaatttatatgataaaataggtggggagagtctgaaccttaactgtcatgttttgttgttcatctgtggccacaataaagtttacttgtaaaattttagaggccattactccaattatgttgcacgtacactcattgtacaggcgtggagactcattgtatgtataagaatattctgacagtgagtgacccggagtctctggtgtaccctcttaccagtcagctgcctgcgagcagtcattttttcctaaaggtttacaagtatttagaactcttcagttcagggcaaaatgttcatgaagttattcctcttaaacatggttaggaagctgatgacgttattgattttgtctggattatgtttctggaataattttaccaaaacaagctatttgagttttgacttgacaaggcaaaacatgacagtggattctctttacaaatggaaaaaaaaaatccttattttgtataaaggacttccctttttgtaaactaatcctttttattggtaaaaattgtaaattaaaatgtgcaacttgaaggttgtctgtgttaagtttccatgtccctgctctgctgtctcttagatatcacataatttgtgtaaccaattatctcttgaagagcatttaggaagtacccagtattttttgctggattaattcctggatgcagaattcctgggttttcattttaatgaaggaggatgcttgctaactttgagtgaggagtcatatctgattgtagcatgctttatggcatttttatagcttctacccatggatctgagccctggaactttataaaattagtttaatcctgtttcctcataaggcacacacagactagatagcaggtgccatgacattcctgagcccttttttttttttttcctcgagggtgaacatcccagtctgtatcttgggccttcgacaggccaacttcactcatcacaaggtgaggtgacaggaagcaggttgtatgtatgtc

SEQ ID NO: 5344 - DNA, 1180 bp, Homo sapiens
tttctaatcactctctgagattatcttacttcattatctatttgtttataaattatcccaatgaggatgttaagatcaggagagagggtaccacgacagcgctgacagccgcagctgcccagtgtctagaactgtgcccaacaaacacttgtggaatgagtaagcagacgaggaactagacacttcgtttgccttcgtcccctttaaataccctccaggtggacccagccgcattaaaactctgagaactaggtgaatggcatttggcctcgccactggccggagcgtttgccgttgatccaggcaaccactgttttcccaccagtcgtgtagtcgctctacctggctccgccccccaggacgccgagcctcggccgggcggtaaaatcggcgcttaccctttaagcggcgggacttctggtcacgtcgtccgcggtcgccggaaggggaagtttcgcctcagaaggctgcctcgctggtccgaattcggtggcgccacgtccgcccgtctccgccttctgcatcgcggcttcggcggcttccacctagacacctaacagtcgcggagccggccgcgtcgtgagggggtcggcacggggagtcgggcggtcttgtgcatcttggctacctgtgggtcgaagatgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcaggtacttaccggagacggggggcgtggagactacaggccccaggaggcccagcggcggctaagcgtaggctggcatgttgcgggcgcgcggtgcctgctgggatttgtagtgggtccggcgccggcggtttagggcggggtcctttgggcccggggaggctctgggatctggagcggggtgctggatagctggagttgtgggctggcctggtggggaggggttgacttcactggtatagtgagattgtgcttcccgctcttcgcactcagtgaaggaagcagtgagattagtcgttggtagttgtcaatctgttggacgctggcgattaggtccgcctggagcattgccctctgacctccctctgtcacccacgtgggtggcctgta

SEQ ID NO: 5345 - DNA, 1184 bp, Homo sapiens
tcttggatttgttcttttctccattgcctctttcttagttgaggccctccatatctcctgtctgaattattacagcaacatataaattagtctttcttgttcaatctcttcccctccaccagatatcctcaaagtgctctttctaaaacatagactagatatggtactcttttacataaaattacctgcaagagaaagcccaaactcactagcatcaattttgaagttattcttcatcaaagcctttgtcagccttgtctcctacatgaatgagatgttgctaacatgttccgtcatacactttatcaactagccacaagcttccatttttgtggatattaatggaggtgcctcatataatacctaaccacccattgcatcagttcatctatggtgtttatatgtaatgttacttctagacgtacagtgttttacctgggtaacaattttactttttaccacagtcaccaaggagctagttagctggatgagaggacatgaatcatcagtattttcgatctctgtgcatgcatcagggaaatatgccatcacaacttcttctgatacagcacaattatgggacttggatacctttcagagaaaaagaaagctgaatattcgccagtctgtgggtatacagaaggtcagtgagggggtacatcttggtctgttgtgcttctcgggctaatttcttggtcaacaggatgtatagatgatataagagtaatgattcactttgtccttgtagctctgtaactcagcaacaagcaaagcaaagtggccaacacaaagatgttgcctatagctacaatttataacttagtgagctcttttctaaaattatagctatgtaacttcaactgtcctaaggcgaaagttatttagttgattgcttttgttttcatttttaaccctctgacattttattatgaaaaatttgaaacatgcagtagatttgtgagaatttttgaacacgtgtacattcagtatctagattctaccattaacatgttactgtactatcctttactctactttacatggtaccatactctcttatgggtctatccatctttctttttttttttggtttttgttttgttttgttttgagacagaatctcgctctgtcacctaggctggggtgcagtggcatgatctcaacttactgtaacctctgcctta

SEQ ID NO: 5346 - DNA, 1287 bp, Homo sapiens
cagcactttgggaggccaaggtgggcagaggcaggatcacttgtgctcaggagttcaagactaacctggccagactcttgaagaagtctttttttgacgtttaatcaattatattatgggaaattgcttctgaatatgaggtggaaaagcatagctcactctgtaataggctattttcatgatttcaagtggttttatgaagaaacagaaagcagtgatgatgttgaagtgctgactctcaagaaattcaaaggagacctggcctacagacgacaagagtatcaggtagaattcaacatatggtgcttgaagtgggctcttgttttatcagttatggcatatgtaaataacagtgtaccaagttagtgtggtgtttatgaagatgagtttaatcttttgtgatgtgtgtttataatctgaggctcccaagtttccgttcttttctgcttggctctgtatgatttgtttgttttctgtaactccaacaaaaggatctctttggggtccttgtccttgtaggtttattcctcaaggttctgaatctcctcattacttaggaccctctagcacagacatttcacagtgccacaggagcaaatcaccccaaaatgtataagaaaaagaactaacaactagatgttagattgcgttacatatgtatctcatttcatctgcatgagaatcctgtttttattttgctgatgaaaaggttataaagtaagttagtggcaataccagaattcaaagcctagtatatttggtcccagaatgttctttctgctatatcatgatgctttccatagtagtagtgattatattctctagccattccttctctaccttttaggaaagtaggattgactagatgtattagtccatttccatactgccatgaagaaatacccaagactagataatttatttaaaaaaaaaaaggtttaatggactcacagttctacatggctggggaggcctcacaatcatggcagaaggtgaaggaggagcaaagtcacgtcttacatggcggcaggcaaagagagtgtgtgcaggggaactgccttttatgaaactatcagatctcctgagactaactaccatgagaatagcatgggaaaaacccacccccatgattcagttacctcccaccaggtccctcccacaacatgtgggggttatgggagctgcaatttaagatgagatttgggtggggacacagctaaaccatatcactagaatagtgaaatcttctttaattcatttaaatattcatgtaattcattggtcagt

SEQ ID NO: 5347 - DNA, 1287 bp, Homo sapiens; identical to SEQ ID NO: 5346

SEQ ID NO: 5348 - DNA, 1190 bp, Homo sapiens
tgggagggcaaatggcagaaatgaacaaaagctattaggtgaaagcatccccaatgtatcagttgtgagatgatttttgtttaatgatgatcaggtttacattgaagtggcttggaagacgtatttcagagggactgggtttgtactgcaaaactctgaacactagagcaggttctactagcacttgggcagtaaggtagcgggtgtgtattatgctattgccatagttctcgtctttgtggattcacataccctttcccatgaggagcttgctactaacagcctcctgtttctgttgtttttatatgggagaagagaaagagcttggaatttcaattgtctaaacaattggtatgatttacaagaaggcaaaccattcaggagatgttcaacagtgtatcattcttagcattcaatacaatgtttattataaaatatacacctgagtttatgtttttctgccaggctgaagggcaataatgtcttgctatgcaaacactctattttatgtgtgaatttttttaactgtaattttatgtgtgaatttttttaactaaactctatcatcattttctatgttgacatcttttttttttttttaatctgtttccaactctgagtctgtgaactatctcttctgactggatgctggcctaaaatcctattagtgcttaaacagacctcaaaacactctgaacctgtaggccaatacagagatgttgttctttgatatatcttgggtccttgatggcttcaacaaacaaggtcataatttgtttaaattcagtgttttctgtagataccttcttctcagtttcattaagaagagtaaccatctttggttttccaaagaatggaaactcctaccctagactttagacttagagcgtctgcctttcacgatgagtaagagatccagaatgtttaggggatgtgcgtcagcccacctggtacagtggcaaagctgaatgcgaacttgaggcctcctgaggcctgaccttctatgcccccagccctccaccccaagcaccttttggtgtggctggaaacacatgacattggatgtgatttttctcaagcccttcactgtggaaggcatgggagactgcccagcattgggcatgtggctgttaacgtttccatttcaagtccctgattcttactggagaagttaaggagccacttaatgt

SEQ ID NO: 5349 - DNA, 1099 bp, Homo sapiens
gacttttcaagttaccttccttgggaagtttgtgcagtgttatagtttagtttagctcctcttacagggtaatggtttgctagtttaaaactgtaaccaaacgaactggtcagacaacatatatctaaaacacttaaaatgttaggaagtttgggaatgttataacctaaacgtttttgctggtaactttttgttatttatagatatttgtgtatttaacatacatacttcaggaaatatatgcctttcctaaaacttaaccatgcattcaataccatggcctatctatagaattgaatattttggaccatgttatctgtggcacagtcagtgctgtgtttgaggtaaatgcagtaacggttagttttctactttgtcttatagaaggtagaaaccatgtgtatgttatgtttgtctataaaagaaaaaatactaatattaaataatttcttacgactctgagtcactcacttatttttccaataattgatattgtacattcctagtgccattaggtatgtatgtatgtaacttttacagtttttcagctgaaagttgtaagtattttttttttttgatcggggctctttaatctcattttaatttcctttgtttgaactgtagttattttatttattcctatattaaccatctaaaccaactgtaatgacatgtacactaatacagaattgaacatttgtagttgttggcagtgaacccagttgttggtgaatttaaagcttaaaatatgggaatgatttgctgctatatttcctttgagagagaaaggaggaagaaatagaacctaatagtgatcatgaattttagggaaagtaccgaagaaccatggggtcccctctggtttcttgtgttgaatgaggcaagggtaatcatctgattccgagctgaagacctctggtcctcttaaggagggagagtgcatttttagagcttttagcaaaatgtgaaaagctgatgtttgcgccttgctttgtgaatttggctttgttttacttatacattaactcatgtaatctcttaaatcttacaagcattgatccatttcaacaaaaaggtaaatttaaaatgcagactttgt

SEQ ID NO: 5350 - DNA, 1208 bp, Homo sapiens
tgatcttggctcactgtgtgtgatcacacagtggtgtgatcttggctcactacaacctctgcctctcagattcaagtgattctcctgcctcagcctcccaagtagctgggattacaggcgcccaccaccatgcccggctatttttttgtatttttagtagagacagggtttctccacgttggccaggctggttttgaactcctgacctcaactgatctgcctgcctcggcctcccaaaatggtaggattacaggtgtgagccactgtgcccagccaggcaaaggtttttaaagtcttgcaagatctacatgattcctaccctatctcctttccagcccttccccatactgatacaagttatagctttaaaaaaaataattgccactctcctgcttaaaatcctttgggtagtgataaaatctaagcaaaatgctggcatataagagccctcacaatctgggctcactctaccttcccagacttgacttctgcttacactgtgcatcctactttctgccacacttgttcctctggattagccaggcccttctgcagtctgcctttgcttaaggtgtttgtttgtctttctctggcctaactcccagtcatgggtaaacaactgaaatgtcaccttggtataactctctcctgtttcccctcaaagcagacagttgatgtgccctatggtcctggtcatagattcctacttgtataacagcactactatcttggactctgtctgcttatgtgctccaggagggcaggggtcctcgcctgactcactgaatgccttatctaaagtgccaggcacagtgtacctattcatctggtggatggataaagacagggactgtcttggttcttcctgtgtagccttagtaacttgtacctttcctgacatggcaggggctccaaaacatctgttgcaaacaatgtatatctaaaagacctctataaaaataattagaatgtaaaactgttaacagaatggaggttgagaaaatgactttgcaagtagcaattaacttgccaactcataattagcagtagattagaggattgtgtattttttaaatgtggtttaaatcttttcagcttgcagatgctagattttcctaagctctgcaactaactgaagaacaagtattgatgaagccttcacagttcttttttttttttttttgagatgtattttcacttttgtcttc

SEQ ID NO: 5351 - DNA, 1202 bp, Homo sapiens
gtttatcaaaattagaggaaaattgttgccttattaagctcgatagcataaacataagtgagttacacagcaatgcaaggaaaaatctaaaaaaaatactaaggatagaaaaatgaaagaataatgacaatagcagcaattaatgaattagaaaagcagaaaaacaataaaatgatcaatctaagagctggattactgaaaattgaaacaaaattaagatcaaaagaaaatatgaaggccagctctgtggctcacgcatgtaatcccagcactttgggaggcccaggcagtggatcaccagaggtcaggaatcagcctggccaacatggtgaaacctcgtctctactaaaaatacaacaactaactaggtgtggtgaggcacctgtaatcccagctactcgggaggctgaggcaggagaatggcttgaacccaggaggcagaggttgcagtgagccgagattgcgccactgcactccagcctgggcaacagagcaagactccatctcaaagaaaatatgaaattaggaataaaaagaggtatataaccatagacgtgttgggaatttttaaaaaacatatttgaaaagtaatatttttaactctgtgacaattcagttttaactctgtgacaattcaatctgcaaaatgaatcttttcttttttctttttcttttttttttgagacagagtctcactcactctatcacccaggctggagtgcaatgtcgcaatctcggctcactgcaacctccgcctcccaggttcaagcaattctcctgcctcagcctcctgagtagctgggattacaggcatgcgtcaccatgcccgactaatttttgtatttttagtagagacagggtttcaccatgttggtccagctgctctcgatctcctgaccttgtgatccacccgcctcctcctcccaaagtgctaggattacaggtgtgagccaccatgcctggccccaaaaatgtttcttaaatgaccaaaatgagcttcaaatggctaacaactataaatgacattgacaaaaacagaatttaaagaaagactcctccctcccccaaaatgcaaattccagacatatttatcactcaatactgtcaaactttgaaggaacacaaatgtcctatgttatctaatctatttcaaagcatggaaatgtcttgtgaaactttgcattttattttatgaagctagg

SEQ ID NO: 5352 - DNA, 1200 bp, Homo sapiens
ctgaaagcttctcgggttaccagctgtcttagcttgatgagacatagccattggcccagttagttggtcaacacaaaaacctgggagtaattttaaactcttctttttccattatttctcacatgcaatgttcattaagtcctgtttctgctagttacctctgatgttgaccattcaacaagtatttattggtccctcaacaaatatttatgagaccccactatgtgccaggtaatgagcatatagcagtgaataaaactggcaaaaattcctgtcctaaggtgctgatattccagtggcatgttggaaaccactgatctgttcaatgaaacctttgtcattgcaagccactgggaactggaggctgtttgttactgcagcataacctagtccattctgacgaatacaccagtaagcagtgcaccacagcagtgaggaaagagctggaaaaggaatgtatagtgttctgtgggaacacacaggaggggaggagagaacagacattaaccctataggagaggtctctgaatgatttctacttttcatctgcatcccccttgcctttccctggctcaggctttcctaacgtcttgcctgggctttgtcaatattcttgtctttgaacttctccctatgagctattctctacccttctaaaatgtaaatctgattgtgccactcccttgctaaatctgataatgataccctgttgcccataagaagaaagttagactctttagcttggcatactttgttcctcatgatgtagtctctgcaaacttcccaacttcccgaatactgggcctaactctgataacttgggattctttgaccatctgtttgttcttctctccatgcctttgtacaccctgttccctctacatggaatatattctccttttcctcctggaaaactcctactcatgttccaaggttctgatcaaatgtcctctccaccttgaagccttccctgatatctccaggcagagttaaggccctcgtccactgtgtgcctgaagattcctgctcatctttatttcccagtgctttgcacactgaaattgctgctagcccgatagtccttggagagcagggactggcctctgtgcctgacacctagagtagagggggtgtctgacacataataggtgttccaatcatgtgtgttgaatgaatgaatgagtgattcagtgacaaaga

SEQ ID NO: 5353 - DNA, 1199 bp, Homo sapiens
cttgggccctctcttcctcatgcggtctctcatcttcgtagtgtagttgaaggttctttacagtccgacagctagattccaagaggcaagaagagaaagcttcccaaactcttgaagccaggcttagaaactctaggacattatttctaccatattcatgtgggcaaagtaaatcgcaaggccctaccagattcaaggggagggaaagacagacttcacctcttgttgtgaggagcagatatatgtggaaagatgggagaaagtgttggtggcaatattggagactctctgtcacaaaggtagaagaggagtggtggcagaaacccaaaattatcctcaggcaaacaaggagctgttaaggattaggctgtggtttgcctgccagaaagtaactggtgtcctactcaggtaatagatacctggagtgttaaacttctccagtgtgtcctggggagtctgagctgaccaggccacttggagctatcaactttcatattcttcttttccaggttatgacacctggaaaaggcatggagagaagtgatgtgcacagcacactgcgaggctgtgcaggaccagggctgctattgccaagtggttaagagcatggctgttggggtcaaatgttgattttgtcaccaaaaagactaggcaattcatagtatcttatggaattccacctccttctttatttaatgtggatactcataccttctttatagggcaaaatagatcgtggtgaatagtatgagatccggaaccagactgcctgagttcaaaacctagctttcccaccaatcacctgcattaccttggaaaaaatacttaattaccctatgcatcagtttctgattctgtaaagtggagataataatataataatgtaatttagattggtgcaacctaaattgaaagtaatgacaaaaaccccaattacttttgcaccaacctaataatattatataataatattacaacaacaatattgtattattgtattatataatgtacatataatatataatatttaataaacataatatcacaataatcatagtgtacagagttgtgaggatccaatgggtttgtagaaacatctagaacaatgcctagcacaggattcacaatcagtggatgttatctacacttattagagtgtgttgatgaaaattaaaatgagataatgcttgcaaaagcct

SEQ ID NO: 5354 - DNA, 1172 bp, Homo sapiens
aggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaagatttacacaatgtttctctgtaaatattgccattaaatgtaaataactttaataaaacgtttatagcagttacacagaatttcaatcctagtatatagtacctagtattataggtactataaaccctaattttttttatttaagtacattttgctttttaaagttgatttttttctattgtttttagaaaaaataaaataactggcaaatatatcattgagccaaatcttaagttgtgaatgttttgtttcgtttcttccccctcccaaccaccaccatccctgtttgttttcatcaattgccccttcagagggtggtcttaagaaaggcaagagttttcctctgttgaaatgggtctgggggccttaaggtctttaagttcttggaggttctaagatgcttcctggagactatgataacagccagagttgac

SEQ ID NO: 5355 - DNA, 1431 bp, Homo sapiens
attgttggtctgttggcgttctcaggagccctttaccagtacccttaggccccagacgacctactcctcaagctgatcatatctgctggctgtgtccctgctctgggcccagcaccctcatggttttccataacacgtatcccaactcctgctgatgggaccctcgtgagctgtctgtgtagggagcatggctgcccctgggtctgctttcctgcccctgacccacaggaataggatgtggcagagtgggggccagatgacagagatgctggtgctctctgagctgaggcccactgctgacctgctggtggcttgtcctgctcttggatcataggcactgggacatcctgccttccttcagtgtcccctcccactccctctccttcagcatcagaggaatgaaggaggcctggaggagtagcccctatctaatagagacaggagtgggctgggtgagcatggggtggtcgcagggggaaggggataggagatggagagaggaacctgctatctggtgggttccaggatggtgacagacagtggcagaagcagtgcagagaccttagtttgtgctggaggttcagttaatcactggtgaaggcagacatcactgcaggagaccagactgttatgtattgtctgtgcattcatattagtacacagggaagatcttgggctccgagacctaggcagatcttgcctcccatctgccgaccctccgcagatgctacacattatgccaggtaaacacattatcaaggagccttgggccgtgttagaggaaggctccttgtgcctgtgaggagtttgcactaatgctatgtgtgtttgtgtgtaaggcttgcattcactgattcactgtagaggatgacttgaaacccaagtcatcagctgggcagtgcatgggctgctcgcctgaatggtgaagctctaccaagtggtttccacctagggcctggcttagctggcctcagatgcccttctcagttctgctcaagacctgcctgcggccttcctcgggcttgcttgcccagaatgctaggaatggccagggatactgcctgggcatgtgtttggcctcagccaaggtcaggctgtcaggaaggaagaagggggaggggcacacttgcctgggagggtggaggaggaggggtccaagccgccacagcctggcagtccttttttgtgcaaaggagacccatcagctcctctgcctggaacacccccatttactcctccgcagttagaggggtgggaggtgaggaattttgtgaggggaattatctctgatcttgatgtgcacattcctcggcagtatcccgggcttggccagcttgctgacacctggctggaataacaatgagcgatgcttctggaggatgctccgctggggagggctctgctgaaccagcacttactccctgcttttcg

SEQ ID NO: 5356 - DNA, 1239 bp, Homo sapiens
accctaaacccctcagctccctgcagggacctctcagccctgcaggggagcccaggctatgtgccaggcctggccttgctgtcagctttctaagccagtcacaaacattctcctctcaactttataatggatgccccccagcctcctctcccctctcagggtgctcctgaggctatgagcagctggcagttccctgtctgagaggtccttcgtaccgcaggagaggcagctctcacctgaaggcctccctggacaccggtctcaactttgtgtgttaccagttatggagaattatttttagtgagttacactctgttagggccaaacacaaggaggaaagagtgactgaatactgctctgagtcagtgactgtgacaagactgtttttttcttcttccctgttgcaggcctgatcttttggccagaaggagattaaaaagatgcccctcaagatggctgtgcctgtcagctgcatggagcttcgttcaagtattttctgagcctgatggatttacagtgatcttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgctcagctgggcttgaggtgaggctgtcctggctggtcacggagggttcactgggatgtggctggtgttctcaacgaggtggcatttaatgagcaccctctgtgtggttggcgtgatgctgggtgcctgggggagacagatggaactaaagaggtccttcctggaagccgttactgttccctgccctgacgtgtgttattgtacctgtcaccattttctgatgttcccagtttacgtatctgtcaccatctacctccctataaagtgcctctgctgttggttctgtgtccttaagacattgtgtggcatttggcacagtctctcatgctgcagaaagggtaaattaagacaggattgttaatgaatgaagacatgggagattcaatggaaagatatgcatggggggataatttcttggctctgtgctcagagctaggaa

SEQ ID NO: 5357 - DNA, 1209 bp, Homo sapiens
tacagtttataaagtgatttctcatcctttctcctttcttgtattgcacaaatatcgaacgagaacctgcagtgtgccactgtgcagggtgcctagaataaaggagaaaagccactgtgctttctctgaaggaatcacagggagtgaagctagcttcatggatgccagaatttcacagatgaagggactggaggcttggagcaattgcattgcttgagatcccccctgctcatggatggtggctcccaaatcaggacatgagtcttctgaatcccttaaacctgccctgtgcctgcctgttctcccagcacattctctgtactctcttgtgctgctcctcaccccctctccaactgtctctccttctccaccattgtcctctgcccactcctagtcccttctttcagctctgtttcttctgaaaatgaggatctttctctctacagtgcctcttgtgggacgggttctgctgatgggggctgtgtttgggatctcgcctggaaacacgatctctccaactttccctgggagcagagccttgggtctcactgaacccacctccccagcaccttgtgtggtgactggcaggaggtagccattccctcctgtcctctctgcccttgtccactttcctgttatgagtcagttgctgagataggctatgaggagttaacagagtggataaaaaagagctttgtccttctttaaagccttcaaaatatacagatgtattagtcagggctttccagagaaacaggaccaatagaacatgaagatagatgcgtatccatgtctatatcaatatctaccttgatatttatatctatatctaggagatttatttattataaggtattggctcatgcaattatggacccagaggggtcctgtgatttgccacctgcaggctggagacctaggaaacagctgtcgtgtcacaaagggcagagggctggagaacctgtagtgtagattccagtccagattcgaaggcctgaggaccaggaatgccaagggcaggagaagatcgatgtcccagaacaagcaatcaggcagagatgaaattcaaccttcctgtgcctttctgttctattcaggccttcagtgggttgaatgaggcccaacccacattgaagaggaccatctgctttactcagtctcctggttgaagtgataatctcatctggacatactcagaaatgctgttta

SEQ ID NO: 5358 - DNA, 1208 bp, Homo sapiens
tctgagtgaaaagggaactcagggtgatattttgagcaggtgagtggcataaaataatgtatgttttaagagattcactctggatgctgtgcttagaatagactctagggtgttaaggaagaaaggagaacatcaggtggtttttgcagtaatacaggcaaaagatggtggtgccttgagccagaagagcagtggtgtggttggtgaggagcagttggattctgatatttttctgaaaatagagccatcagtgcttcctgacaaattgaatgtgggatatgagagaaagaatgacagcacagatgactcctattcctggtttggcctgagcacaggatggatgagattcctgtcctctgagatgggggagctgctggttacacagttttaagagaggaccatcaggggttcagtttagggcatgttacgtttgagaagttcatgaagtatccaagtggacctatcaagtagtgagttgaaatactagtctgggacttgggagatcgggctgggcagaagatgtaacatctgggagttgttgacatgtagatacatggtattggatgtgagggcgatctgactgcgacatctgtcaccccattgatcgccagcattgattcggctaatctggctggctaagctggtgtcccttccttgctcacagctccaagtgcattcctcccaaagctgcacactaggtcgaagaggacgaccattccctgacagagaaggactggtcttcggtcaagggtatatgattagctgagctctcctgctagaacatccagacaagctctcaagacccattagatatatggtatttaagaaatgcaacgtagctgacaactattccaccactggctttcctaagattaatttcaccttattttggcctaagtccaagaagtagaggttttcccttcctttctcctccctctgcttcttccatctctctgtcctaccccagtgagtccttgcttctgtatagaaccattcaatcacaattgaactctcttgtgcttttctagtttatccgtctgtctctacttagtttccccagtgcaatgactgcacactttgttgggattttgcttcaagccacaagggaaacaataaaactgagggatgtaggaaatgaactcatggacttggctttgggagactgggtcacacaccactgagaaaccagggacggaggatttttgcac

SEQ ID NO: 5359 - DNA, 1162 bp, Homo sapiens
ggggctgggggcggcgcgcgtgcgcagagcacttccttgtttggccccgtgactgcagcgcgagcgccgcccgcccgcccgcccgccgcgggagtgtgcgctcagtcagtcaggcccgcgccgccgcctgtcagcgcgtctgaggaggcagcgccgggcgccccagccgcccagcccgcgcacgccccagcggccggccggagcccagacccccgcgaagaccccgcgcgcagccgcgtcccctcccccgccgctgaggagctgccgccgccggcatgagcagagggaggcgggtcccggagagccccctgcctcgcgcgcggcttggagtttgaagggccccgcgccgagccccgccagcgccgccgccgcctgccttcgcccgcctccttccctccctctcgccgctgccggggacgggagccgcgcgccaggccgggcggcgggtggcgggctgcgcgccggggttcatgagcctccgggcggcccgcggccccgggagcctgcgccgtgactcaccccccgcccccgcttgtgtctcgtccctcccggcaggatgccggaccagatctctgtctcggagttcatcgccgagaccaccgaggactacaactcgcccaccacgtccagcttcaccacgcggctgcacaactgcaggaacaccgtcacgctgctggaggaggtaggtcgggccgggacccccgccgtccacgctcgccgctgccgccgcgcagctggaggatctcctctccgagctgggaggaaggggacgcgggggccgggggcgccacaccccctcagggagccgccgggtgaataagggacttcggacgggcggcgccttccccatctcctcgccctttctgggtcttgcgggttgaaaggcctggggactggaggtgggagaggactgagcgagctgtggacactccagggaggacagaagatggaagtcctgtccctggcatgcactgttcggcgcttccacatcttcgtgaccctcctgtaaccctcgaggtaggtggcgtcaggccaccgagggcccagaggcgaagtagtgcagccaaggtcaccagcaagggactaggagatgggcagtgaacgcacccctcagcggcccgactggaccaggcaggcgtagctgcggagacgagggccgttg

SEQ ID NO: 5360 - DNA, 1183 bp, Homo sapiens
aaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggtggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgcagcggcttgtgtcttttttctgtccctgagagattgtgtgtgtgaaacattgcagtgcagggatggctgtttcactggggggttgcccgtccttgacacctaggggaccccagcccctcatctctggaattctttcctcggagcatcacgtccagcagaaatttaagtcagctcatatgttaattctaatttccca

SEQ ID NO: 5361 - DNA, 1181 bp, Homo sapiens
actgtgcctatcttttgtgagtggttgtgagtctcaataaaatcacttgccatgcaatccctgcgttgagtgctggcggatgtaatatgctcttgggttgtagagtagcactggtgtgtgtggtagacccgcagccttgaggttgagtaccacctgcctccacagaactctcccctctaagccccatcccttccttctgaaatggagctgatgccattcccccattcccctactctcgagctccccaggctgtgcagcgccaggtagagggtgtatgtatgtgcttggaaggatgtactttgtctggttttgatgaagctgatgataatgatggtgctgatgagaatgctagtgttgatgatggtgaggggggtcgtggtgatgttgatggtggtggtggtggtggtgatggtggcagtgctggttgtggtggtggtgatgactgttgatagtgctggtggtggtggtgttggtggtggtggtaatggtgatggtggtcgtggtgttgttgttggtggtggtggtgttggttgtggtggtgttggtggtggtggtggtgatgactattgatagtgctggtggtgatgactattgatagtgctggtggtggtgatgatgatggtgatgatggtggtagtagtgatggtggtgatgactgttgatagtgctagtggtggtgatgatggtattgatgatggtgatgtgatggtggtggtggtgatgactgttgatagcgtgagtggtagtggtggtggtggtgggtgatgatggtgatgatgatggttattttttacagaccacagatttaaatgagaaagtcaactgattatgttctctttctattaaggacaaaaggagttattcttgtcctgtttgtgaaaagtctttttcagaggatcgattgataaagtcacatatcaagaccaaccatcctggtaaggttgtgcattttggagtggaagattaatgttaaaaatgcttatgtttattttaaaacaatgttttacattaactgcactatatagaaataaaaagggatgaagctgtgaatatattcatgggaaacaaacatctttattcgacgctgggaagttgatgtaattatttatttccttttgttcttttatctggtcttcagatgcatcaaccctcacccctgcaatttcagtgataccctctgc

SEQ ID NO: 5362 - DNA, 1149 bp, Homo sapiens
actgggcccacgtacataccttcactgctctaaactccaggttttcactttgtaaaataggcacgacactacctcccagacaccagacacacgatgaggattcagtgacctgcatcaagatggtgcctactagactccaggccctagagagctggggcatttatccttgctgggtctccagtgcccagagctgtgtctgaaatgcaaaagacaaactgtgtttgttgaatgaatgacgtatgtgaaagctcttcctagcagtcttatttggagaataaagctaatgcaggaatgtgtggagaaatgggacaagaggattagacagggactaggatgaagggcctcatgcatggctaaggagtgcaaatgtgttttaaggttctggatcacagctgaaggatgtcatgcaggagaatggcgtgctcagctctgttctagatggatcgcttgtgggtactgaacagggaggttgaaacgttttgtattatgtgagtttagaattacatgtggtctttctagacaccagccttactaaaatgcattgccctgactttgaagttgtggctgaggatgagatcactcagggagtgtgtggaatcaaaagggaaaggacaggggagggatccttgtggctctatcaccattgaaaggttggtcaaaggaaaagaatccctcagttcttcctttccttgcttacttagcatgactaaataaaaagtttactgaattctgtaaattacacctaaaactgtttatttgaaaagtttttttttttttttggtgatgcattttttaagtaggaatcttaaaactcattacttccagtgatgcttacctgcatgcttcttgagccataagctgatgagaatttggaggagagacctttggtacagagagctcagcaagtgtggtggagtagctggggtgtcacaggctcctccgtccggaaagcttcctggctcctcaaagcttctcttcattggtgaccacgtggcttccaaattgacttggacttggttcacactttccatttagacgacgcgctttgtggcttcccatccacaccagcacatgcatgctgaaactgctgctttcgttctgaatgtttttggttagtgttgctacttctggtagtggttggacttagat

SEQ ID NO: 5363 - DNA, 1337 bp, Homo sapiens
atttattcttgcattgctgggaaacattgatgtgtggggactcactcctctccgtgtgctcttttgtcagatgacttccatagatctatgcactgagattcgtagaaagctgttggtggtggctctgctgggcgtgaggccgtcggtcacagcgaaggagcttgcctggccctgggaggcccaaggatagcagggccagcagagggcatgggccgttcttctggggtttgcatttggggccccagacttgggtttgccaatctagaaactgttgcactaagagtgacaccacggacgattttgaaggctaacaacagacaactctgtttgtgctgagtgggctttttgtctctgtacacagttttagtaagactcaaatccatgttccgtgtagaggcgtcaggaaggaggcgagcctcccctagtgctgctgtgcgctccgtaggtcccctcttcctgctgctgttccctccccggccctgcgcgacacttacctcggcactgtggtggggtggggtgccaaaggagctgcctcctgctcagcggcacccccccccccacctttgtgctcagctgctttggaggcagcaggaggggcagcaagccgcaggtcgggggtctcccgatacctcgcctggatattggcggcaatgacaaagggatgactattatttgtgaagatgtgtactcagagtggtgtgtgtgtgtgtgcatgcgtgtgtccctgtgtgtgagtgtcttattaatggcattagtctcttctggctgtatttttttttaatctttttaaatgacagaagctcccactctaagaaatggcagttccttttgttttagtggcaagtggcactttctcctgttttcagaaggatacagacatgctcgtagcttaaattaatggatgcattcaagctaaggagggaatcttgtgactaataacttttcaaatctgaaattagattagtttccagccatttttacaatcatctggaaccatgtgtctcaaaggtgtgtttcttccacctgcgtcaggctgtctgggggatggcggttcttgtttaacatgcagatttgtgggcctgctgccacctcctgcgtgcggtacttcagggatggccagggcatctgtgtctaagcgatggcctgcagccctgggctccctggggtctgaggacccagctctggtggcacccagcagggaggaggtgcttcctgagcagatgcctgagacagactgggctggcagaaaagtaggactacaatttttgttttttttaatcattttgaaggaaaactttcatttttagtgggccagagtacttcgaaaagggtacttt

SEQ ID NO: 5364 - DNA, 1144 bp, Homo sapiens
tggagtcaaaaggctatattccagccaggcacagtgactataatctcagcttctcggcaggttgaggcagggagatcgcttaagtctaggagtttgagactagcctgggcttagcaagaccctgtggcaaaaaaaaaaaaaaaaaaaaaaaaaaaaacagtaaaccctaaagggaggaggatcaagtacccagaattcctacaatatattatctaaaatgtctaatctccaacaaaaaattacaagacatacaaaggaacagaaatatatatgaatgatagacaaaagaaaaaaagactgttctggctgggcacagtggctcatgcctgtaaccccagcactttgagaggcagaggtcaggagttcgagaccggcctggccaacatggtgaaaccccatctgtactgaaatacaaaactggcatgcctataatccaggctacttgggaggctgaggcaggagaatcgtttgaacccgggaggcggaggttgcagtaagccaagatcgtgccactgcactccagcctgggcaacagagcaagactccgtttaaaaacacacacacacacacacacacacacacacacacacacaaaccgtattctaagaacttcctgtagctagatgtgagcaaagcagagcatgtttgtggggaaatggaaaatacttctcactatgtggtgtttttttttttgtttgtttttgtttttaacttaataaccatgtaattggagcatcttcatttggtcctaaacctgtctgttgggtaacctctgagatagtttgcctggtgctaaacttggaggccatgatggcatcgaggcactttcccactcaagtacctttcctttttttttttttttttttttttttcccggaaacagggtctcacactgtcacccagggtaaagtgcagtggcacaatcacggctcactccagccttgacctcctgggctcaatctgtcctcccacctcagcctcccaagtagctgggactacagtcacgcaccaccacgcccagctaatttttgtatttttggtagagtttcatcatgttggccaggctggaacaagtacctttcttaatgcctgtgagatggtattgtatttttctctttgcttgttttccttacttagactgagc

SEQ ID NO: 5365 - DNA, 1123 bp, Homo sapiens
agctctccctgccctgaacgttcggatggacagggtgaagtgggggtgctgacagtggcctgggactcggaggcatcaggagggcctgtggagctcagcctgcccacagggagtgggaggtggctgagcgccctgctcggtggacacctaggccacagcaggttgtctttgacacctcgctgatgctccagggtggcggcatgcgtggggtggggttggcctagaggagcaggtcccagctacaccaggcggctctggtgtctctgctgcatggaggacgctcgcccttgccgagcaccctgacctggccttcaaggtgggtgagttgcctgcttgcctgggctgatgctgcctcccgcaggtgcaagcggttcagggtgccagtggagaagatctacagcaaaacacagcgggagaggttcgcctgggctctcgccatggcaggagaagactttgaattctaacgacgagccgtgttgaaacttcttttgtatgtgtgtgtgtttttttcactattaaagcagtactggggaattttgtacaataaaatgtgtgcaagtgcttgtacatcactagaaaaagtccccaggccggccgggcacggtggctcacacctgtaatcccagcactttgggaggctgaggcgggcggatcacaaggtcaggagatcgagaccatcctggctaacacggtgaaaccccatctctactaaaaatacaaaaaacttagccgggcgtggtggcgggcgcctgtagtcccagctactcgggaggctgaggcaggagaatggcgtgaacccgggaggcggagcttgcagtgagccgagatcgtgcccctgcactccagcctgggcgacagagtgagactgtctcaaaaaaaaaaaaaaaagaaaaagaaaaagtccctaggccaggcacagtggctcatacctgtgatcttggcatgttagaggcctgaggctggaggattgcttgagcagacattgaggctgcaatgagctgtgattgcgcccctgcactccagcctgggcaacagagcaagaccccatctcaaagagaaagaaaagtccctgacgcctgccgtgtcctttgaagcctccaccccgagcatggagtctgctggg

SEQ ID NO: 5366 - DNA, 1159 bp, Homo sapiens
gggcgggggcctcttgcagcagcccctgagccttgggctgccagggaagctgttgggaaggcgggcctgtgcccactgctgagttagctttaatgatctgggcagtcagagctgtacatgatgcaagctgggcaattagacgcaaccctcgaagctgtgggtaaattgccagctatcaagtggaagggaactcgggcaaaagattcctgttaattgcatgaaacattcagcaagaaaaaagccgtcgtgtctatcaccctgcaaaatgttatgaaaacagtgactaagtacataagtctgtctgggcacagcggtgaggaggtgccgcttgaggaggtgagtgctccagcgcccctcccctgtgcagggcacaggccaggagcctcccagccccgcccctctggcctgggtggaggtggcccatctgccttcctcactgctctgctggaagtcagtcagccacctcgagtccccctgttgcggatactgtctaggggactccaaggcatccccggctgccagacccctggcttctcctggttttcctgtggtgtgggcattcccttgtttctccagatggctggagggtgtgcggggctggtgcccgcctctcagaggctgcactggctagctcctgaagcgtcggctgccaggcgccctggggatgtgtgtgccacatgggttgagggttttatccacggggcgatggagggtcttcaagctccggcggaggcggtgggcagagctggcactgtgggtggcctctctgaccctacccttgccggccttccctgacccatgtctgtgccctgggttttctctacagcgtccagcctgcatgccgtgcggactgcacccaccagcaaggtgatcaagacccgctaccgcattgtcaagaagacgccggcctcgcctctcagcgccccgcccttccccctgtctctgccctcctggcgggcccggcggctctcactatccaggtaggaaggcttcctgcaggctcctgcaggcctgggaactgggctgtctggccctgccctgagggctgcagggtagaatccaagggccagggggagctgagcacatcccagaactgcttggtgttgggctcgttggctggggaccagcctgatttttctgtgtctttagcaatttctgc

SEQ ID NO: 5367 - DNA, 1197 bp, Homo sapiens
gccgcgcacgcgcagaacgaggcggggacgtcactagtgagcgccgggaagtggcctggtaacggctgggaagggactgcttgggctctgggaggccgcgcgggcccagcttgtgcagtccgggatcgcgtccccttgggagacttggcgaggggcgagacctggggcccacccagcccataccgcagttccttcccacagtccctgcgtttcatttcgccccagttgagtgttgggggggggggggtctacgcggggacccatgggagaagggccagttaacaattactcttgacccaggagggtctgtgaaacctcttactgtggccagaggagaagacatcggagagcaaggttccctggatagacatgttgaacctctgaaaacatgaaagtttttagttcgtcattggaaacatgtacaagtgtaaacctctgtgcgctgttggtgggaatgtaaatggcgcagcaccgcagaaaactatggagattccacaaaaggttaaaagtagaactaccggatatgagggcgatctggctgcgacacctgtcatcccattgatcgccagggttgattcggctgatctggctggctaggcgggtgtccccttccttcctcactgcttcatgtgcgtccctcccgaagctgcagctcagtcgaagagaacgaccatacccaatagaagagctgggcttccctggtagaacctccaaacaagctctcaaggtccatttgtaggagaaggtagggtagtcaagattccagacacatccaaatgaggcgctgcatgtggcaatctgcctttctaggagaaaacaaaaatggaactacggtatgatccagcaaccctacttctggctatattcccaaaagaatggaaaccagagactcaaacatatttgtgcccccatgttcactgcagcatttttcccaatagccaaaagacggaaacaacccaagtgtccacgggtggatggaaggataaacaaaatgtgatccatacaaacaatgaaatatttttcagccttaaaatggaaggaaattcggccgggcgcagtggctcacgcctgtaatcctagcactttgggaggctgaggcgggcggatcacgaggtcaggagttttgagacaagcgtggtcaacatggtgaaaccccgtctctgctaaaaatataaaaaattagccaggcgtggtggc

SEQ ID NO: 5368 - DNA, 1166 bp, Homo sapiens
ctcaacgccctcttcctgcagctggtggccgtggggggccagccacgaatgaagctgaccgaggaccccgagaagcagacgttgcctgggagcaaggctgctttccggctcctgggctctgacggtgaggccctcccatcccccctgctgtccaccttcaaagcaccagggcccccgcttattcttgccccgtccacacagggtctccactcatggacatgctgcagttagcagaagagccagtgccacaggctgggcaggagctgagggtgtggcctccaggggcccaggagccctgcaccgtgaggccagcccaggtggagccactactgcggctctgcctccagcagggacaggtggctgccccaccgccctcatcctgacccccagccccggtagagccctgactgggagctagccccaagcttctctttccttacctcctccctgcagctgtgtgagccgctcccatccctggcagagtctagagccttggcccagctgtccctgagccgactcagccctgagcacaggcggctgcggagccctgcacagtaccaggttggggggaggcccaccctgtcattctgccctgtgcgcccccgccctcaccctgcccaccgctcctgtcctctgctccctgcaggtggtgctgtccgagaggctgcaggccctggtgaacagtctgtgtgcggggcagtccccctgagactcggagcggggctgactggaaacaacacgaatcactcacttttccccacagcttgtcctgtgttgtttgtgtcgtttgttcacccagcccacgggctgcgcctcccgggctgcggctgggctggagtcgggaatctgagctcgaggtagcaggaagatttgcatcccagtgaaagcacaggccctgccggcgtgggagacagccctgtgctgaagcccgaagggcagtgaggagttccccggctttgggtaggctgtggggagtcagatcccacactagaactacaaagccacaggcagggagggctttggtgtctgccttggagttgagggagttgctgcagacctttccttgctagaggcaggctggggacaggacagggttgggggtagtgccaggtaagagggtccagccgtggccctgggctcccacgcctgcctaggcactgcccccc

SEQ ID NO: 5369 - DNA, 1199 bp, Homo sapiens
ccgagtagctgagactgcaggtgtctgccaccaagcccagctgacatttttttttctttttttttttttttttagtagcggcagggtttcgccatgttggccaggctggtcttgaactcctgaccttatgatctgcccacctcggcctctcaaagtgctgggattacaggcgtgagccactgtgcccggcccagtctaggggttttctgtcacgctcctcaaaattcttcccgcctcaccactgcccaactccaaagccatctccacattgttaggcattccagcagcaccccacttcctgggccaggatctgtgttggtttccacttgatgttgctgtaacgttgccacacttccgtggcttaaaacagcacaagttcctcaccttacagttccgggggccagaagtctgagatcatcttatggggcaaaatcaaggctgtggtccttctggtgtctctgcggggagaatccgcttccttgtctcttctggctgctggaagctgctcacggtccttggcccaaggctcccaggcagctgtcttgtcactcagcctccctctcccctccctcgctcctgctgcctagtgtgggcccttgtgatgacagtgggcccacctgggtgatccagcatcctctctgccgcttaacttaatcttatcacatctacagaatccctttgccatgggagaccatatttacaggctctgcggactcgtatgtggctttgtgggggccattgttctgtctgccacagccacagccacctaggggtgtgctggctcccgggccataagctgggcatccctgggtgggtgggcccaggaagggctgccactcctgtctgccaggtggggtgctcctttgtgccttgcgttctgcccactggcttgcacccctggcttgcccaggcacctgaccaagtccaggctaggcagacatgagattaagggagcacagatttttgcgcccaagtcaggcatattgcactccagtgcccagaaggcagcggtcgggggcttggccctggggctgcaggaactcttcagccctggctgtgtggagtcaaccctaaggtgtctctgggacaggcaggtggtcgcactgttagggcttagggactggtttgctgctataacaaaggtccatagactgggtgacttaaaccacatgtattttctcacagctctggaggctgga

SEQ ID NO: 5370 - DNA, 1096 bp, Homo sapiens
aaaaaaaaataacaaaaaaactcagaaatgctaagtgtacttatttgttgaagaaacttgttacatattactaacatcttttttttttatgagaaatacttttcccataaccaaaaaattcagtgagcagaatggccttgcttgaggtttttgcaaatctctcgggtgtctggcttagtgggaggcagctgggccctcatacctgcctccgcacttcagctgtttgacataaacccagcttcgtgtgagtgaaagggaagggcctggggaccctcagaggttctcggaccacactttgagaactcctcgtctggaagacaggcctggggatgccatgtggggtgagggcttacgggcttggtgtcgctttgtggagaaccgctggtgtctgaagcgggtgtcagccccactgcaccttggtgcttctgggctgtcctgatgccgaggcccacttcccagccatgctgactttgcctctttcccctcccagcagaaaaatggctacaaacttcctagcacatgagaagatctggttcgacaagttcaaatatgacgacgcagaaaggagattctacgagcagatgaacgggcctgtggcaggtgcctcccgccaggtgagagctgcacgtggggcggctgggcggctctgctgcccgacaggagtggccggggcacacaaagcggattcagccaggccaggaaggcagaggcaccctggcccagtggctctgctgtgggtgctgggagtggggtctcggggcaggcggccttggccgggcccccgggccgggtctgctcagggccctcctgccggcgcctgtgcacttggtgtggggccaggcctggcactccttcccccgcagacatgggcgcctttgcctgtcgtcacagcctcaggcatctcccgcttttctggcccgccaagctctcgttctgtgcagtactttcttgctgtctctatgtgagggttcatggggttttttggtttgttttttaattaaattcttttttaataataaaaaaaagactggttctttctgcactgtctgcaggagaacggcgccagcgtgatcctccgtgacattgcgagagccag

SEQ ID NO: 5371 - DNA, 1159 bp, Homo sapiens
gtactgagattacaggcatgagccactgcgcccggcctgttttctcttcacaacaaaacgtccccacatgggcttgacttcgaagtcctcgaatgtcatctcatggaagccccactggggagcatcctcagcccctgcccagggagggcagccacggggagggcgggcacggggagggtgggcacggggctgcggccacccgctgtgttgcaactctgccctctgcttgctttttatcgctgtgtccggaagatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgcgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgacggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgc

SEQ ID NO: 5372 - DNA, 1345 bp, Homo sapiens
ctggccgaggccccttcccctgcgcccaccccgtcgcccacccctgtggaaggtctgtgggtcagggcaggtcgggggggtcagcctgccgcatgggctgcttccaatgcccgcttcttgtccccccagacctcggcccccagaccagcacctccccgggacgcctggtgaggagccggtggctatgccttcccttcacccccgaggcatgggggtggggtctggcctgcccccacccccgtggccctcatccccccctttcctctcactctctgcctctcccctcacgctgtcctttcaagcccttgtctggaaagaagtttgactacagggcctttgcggccctgccttcttccagacctgtctatgacatccaggtacctggcctccaggcctctgcatgcctgccaccctgtccgtgcctgccaccgcccccatccgctcccgcagggcctccccacgctctgccgtggccctgcctcttcaccccccctcccccttcagccgggctctgtgggcctcagggctgggagcccacccgtccacctgggtggtttggggcagggctggcaccggcctgaccaacactctccccatcacagtcaccggactttgctgaggagttgaggtccctggaaccatctcccagccctggtgagttggggccgggctggggtgagctcccaggagcccagctgccctcagctcactgcccacctgtccctgccctccaggcccgcaggaggaggatggagaagtggctctggtgcttctgggcaggccctcacccggcgctgtgggccctgaagatgtggcactgtgcagcagccgccgccccgtaaggcctgggcgccgtggcctgggccctgtgccctcctagaggagcaggcacctcccccagacttggggtgggggccctgccagctccagcaccacccttgccccaagtcttttaacctgggtgttagcattttaaagagaccccacaggagttctggcctgtgactaactaactgccccaccccagccgagacctcggcgagactgtaactagtgatgtttgtacaaccaaagactctattttgtggtttaaggagaataaagttgactacattttacctcccgtctgcctgtccatcccccacccactagcacagacccttcctgccctccgaggcgaggctgagctccgagggctgcaccctcaccgtccctcccacgtctcccgctgcgcctcactgcgcacgggtcggccgggcaggctgcccatccccagcagggcctcccccaagtgcctgcagacccatgtccgccggccggggcccgggactgccggagtcctgga

SEQ ID NO: 5373 - DNA, 1175 bp, Homo sapiens
ggtggccagcatggaggaggcgcggcggcggcagcatgaggccgaggagggcgtgcggcgcaagcaggaggagctgcagcagctggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctgcccaatggccgggatgcacttgatggccccgcggcagaggcagagccggagcacagcttcgatggcctgcggcggaaggtgtcagctcagaggctgcaggaggccggcatcctgagtgcggaggagctgcagcggttggcgcagggccacaccacggtggacgagctcgcacggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaacgaggctgtgaaggagggtgtggtgggccccgagctgcaccacaagctgctgtcggccgagcgcgccgtcactggctacaaggacccctacactggccagcagatctctctcttccaagccatgcagaagggcctcatcgtccgggagcacggcatccgcctgctggaggcccagatcgccacgggcggcgttatcgaccccgtgcacagccaccgcgtgcccgtggacgtggcctaccggcgcggctacttcgacgaggagatgaaccgcgtcctggcggaccccagcgacgacaccaagggcttctttgaccccaacacgcacgagaacctcacgtacctgcagctactggagcgctgcgtggaggaccccgagacgggcctgtgccttctgccactcacggataaggctgccaagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcggg

SEQ ID NO: 5374 - DNA, 1187 bp, Homo sapiens
gcgcggcgaggcggaggcggcccggcgggcggctgaggaggcggaggaggcccgggtgcaggcggagcgtgaggcggcgcagtcccggcggcaggtggaagaggccgagcggctgaagcagtcggcagaggagcaggcacaggcccgggctcaggcacaggcggctgcagagaagctgcgcaaggaggccgagcaagaggcggcgcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatcgaggctgagaaccgcgcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacggagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgagg

SEQ ID NO: 5375 - DNA, 1298 bp, Homo sapiens
cggttagagtctctatcattcctgtgactcttcagccaatcctttcaatttactgatcaatcgttggtcccaatctggttaaatgaggaggcgtctgcttcaggtggtaaaagccctttggggacccatttctcttccagcccccagccccttttctagtgacctcttggctctggggccttggatgccagggtgaggtgtggagagggctcaggcaggctgtctgagggacccagtggagtccagcccagcctgaccccacagggcctccggagtgtcagtgggtggtagagagcagtgttagttttgcgatgagagctgagctccaagaggaggaggttgtccttgaaaagccccttccctgtgaggtgctaggaattaaaatgtcgatggcaaaggcaagaggctgtcttgtcagtggaggtagaagatgaggaaggctcaggttgggtggatgcttttggtggaagtttgtgactggaggggtgtggtcctggaggccacatggagctgctggtgggtggctggaggggcgagaggcagctctccctgcagtgttcagtgccccatgcctggaggggcagttgtcaccaacccagtgtttccttgcagccccccctcctctgcacctctcctctcagccacagcaccggcagcgattctggcgtctccgacagcgaggagagtgtgttctcaggcctggaagattccggcagtgacagcagtgaggatgatgacgaaggcgacgaggagggagaggacggagcccttgatgacgagggccacagtgggattaaaaagaccactgaggagcaggtgcaggtgggtgagcgaggagccccctcgagggctgtcccccatgtgcaggtggccttgggctttctgagactgccactgtactgccttctccaccgtccctcagaaccccaaggccggcgtccctccttcactgcacctggggcacgcttgggctctaggacgctggtttccatccccagttgcgtgccgttcccaggaactctgaaaatccacatgcctaggcccttccccgtcagacgatgctcgggcaaccctcctggcaacaggttgggtttccttgaggtggggattttactgcttggaatccagtggcaggacccagctgaggagggagctgagcagcatggcagggctcaagcaggcggcatgggggccccaacggaacccagctgggcctgaccccacagggcttcaggggcctgagcagccgacgggtagagggtttaacattgtacctgttgcagcgatggtgggggagg

SEQ ID NO: 5376 - DNA, 1158 bp, Homo sapiens
cgggccctctagggacgcgccccgccgccccgcatcgccacagtcacctccggctcgggctcaggctccagttcgggctcagaccgccgcttctccggccgcacgctcggcgccgccgtgcgccccgcaccccgcgaacccgccatgccccaccgcgcgccggccgccacccgcacagccgcttccgacagcgaccgggccgcgtgcgcaggaggacgcgccccgcccagcccggccccgattggcgggtggagggaagggggtgggaccaacacgcgcaggcgcgcggctgggccggggaccagggcggggtcggggcctgcgtgctcgcgccgggggtgacgcgggagggcggcagcggcggcggcgggagcgcgcccgttgcaagatggcggcggccatgctgggccccggggctgtgtgtgcgcagcgggcggcggcgcggcccggaaggctggcgcggcgacggcgttagcccggccctcggcccctctttgcggccgctccctccgcctattccctccttgctcgagatggatctgcccgtgggccccggcgcggcggggcccagcaacgtcccggccttcctgaccaagctgtggaccctcgtgagcgacccggacaccgacgcgctcatctgctggagcccggtgagggcagcgcgcgggcgcggggcccgtggggaccgggagggagcagggccgcggcggacggcgcgggagggctgcggggaggggccctgccgcacttcagcttacgcgcggtgagcctgccctgcccccgccagagaagggcggcgggtcccgagcctgctcagacccagagccttaagttgggaaagcggctacgagacccacactcggttcaacccctgccccagcgaagtttccctgggatggggagaatggggcgtctcttgtattgggcttctgctaactgttgggcggttgcggaagtgtccgcgcttagggcaagcacccggcttcgccagcggacgctatgccccagaggacatcggcgtccccaggggacagcctacggggtgctgggtcggcaactattaggagaaagtcaggacttggcacgtgaagtggagggcgttgctgtagtggaacaggaaaggcagtggaaacagtaagacgtcatgaagcttcaggt

SEQ ID NO: 5377 - DNA, 1159 bp, Homo sapiens
ctgggggcgcgctgctggcgctgctgcccaccttctcgtggccgcaactctttctgctcctggctgccacctactggctggccgcggccctggcctgggctgcaccagccctgcggcggctcccacagcagcccccttccgagcagcgtccccacaccgcgcaccttctgcgggacgtgctagccgtgccggggaccgtgtggacggcaggctttgtgctcacctacaagctgggtgagtgaggcctcgagccaggcaacagcagttggggcttccgggacagctccaggtgtgtccccaggggcttgcaacccattacagggccacgctctttctggggtatgacctgcaagacttggccctgacatccggggctctgcagctgggccttgtgtcttgtccgcccccagctctagccccatccctgagcgctctctcgggctgccccacttctcccccagtatctgcagctctggaacactgaggagagcagggcaggactgagggcccaggtggggagaagggaggtgggggcagatatggaacctcccgtgctcatgccccccccaccacccaaggtgagcagggtgccagcagcctgtttcctcttctcctgctggaccacggcgtttctgctcccgagttgggactgtggaatggtgtgggtgctgtggtctgctccatcgctggctcctccctgggtgggaccttgctggccaagcactggtgagccctccccagtgtaccctgcccacccacttgtacctgagctgcccccaatccactatactgacccatttcccacccccatcccaggaaactgctgcctctgttgaggtcggtgctgcgcttccgcctcgggggcctagcctgtcagactgccttggtcttccacctggacaccctgggggccagcatggacgctggcacaatcttgagaggtgaggggctggccttgaggaggaagagaggggccaggagcctggggcactgctgacttctgccctcccagggtcagccttgctgagcctatgtctgcagcacttcttgggaggcctggtcaccacagtcaccttcactgggatgatgcgctgcagccagctggcccccagggccctgcaggtgagtagatgtagcagggacacaagagagaccacgg

SEQ ID NO: 5378 - DNA, 1171 bp, Homo sapiens
aatcttgtaaccatccctcccatcctttttgttatagttgttatgtgtaatacatctacataacattttaaactcagaaagacaatgtgataatttcagttttaaacagttatatagtttataaaaaaggaaaaggaaaaaggccaaataaatagtattttagctgtttctgacatgtaaggactttagaagtcatcactgtgtcctaacaagtaaaaagctgaacaaactgaaaaatcaacaaatcttagctccatcagagaggtgtgaggtcagaggacaaatcactgctctcaaaattggagaggtatggccgggtgcggtggctcacacctgtaatcccagcactttgggaggccgaggcaggtggatcagttgaggccaggagttcaagaccagcctggccaacatggtgaaaccctgtctctattaaaaacacaaaattagctgggcgtggtggtgggttcctgtaatcccagctactcgggaggctgaggcaggagaatcgctgaaactcaggaggtaaaggttgcagtgagccaagattgcactactgcactccagcctgagtgacagagcgagactctaaaaaaaaaaaaagaaaaaaaaaaaactctggagagataaacaggcagatacaaagaatcacaaccacatcttgtgagcaataatctcccagggaaccggtggccagatgggtaagcctaaaatgtaactggcaaattgctagaggctcagtgtggacaactctgaaaaaaaactccagggggacccggtcatgggaggaccccatacttttgtgagctttacctccaggagctctattaggtactgacagtgaatatcagagaaaaatctccttgtgcttctggcaggaggaagtgaaaagggaccactttggaatataccattctgttcttaacaagacctgccctcaggagaaacaattttaccagggcctaacctgctggtgtttttatcagaacttaaccttcctgggggaagggaaatacctaacactagctacttctggatattctgtcccacctaatggcaggtgggggaagctgaaaagcacttgggaagttcatagtccagggacacaagctcagcaagactgagccctgctcatagtatcatagaacactttcccaccccaacacctgaaaac

SEQ ID NO: 5379 - DNA, 1175 bp, Homo sapiens
catcttgaaggctggccgggcgtaccacaaatataaggcaaagaggaactgctggccacgagtacggggtgtggccatgaatgtaagtaacccagaaatgcagggttgggtattgaagttacagtggccacactgttgggtaggcaagtcccatccacaggtgtccctgcaggagggggatctacggtgggaggagcagcaggtggtggtttgtagtcacgggactgttgatcctgctccagcactcctgaaggaggtgggctcaccctccttcaccgtttctccgcaagaaacggaggctgggaggggcagtgggggcctgagctggaaagagtcagcctgactggggttgtctagcggcacatgctgtggagaggggcttcgcggaattgggcccctgacgggtgggaccccgaggccgggggcgggggtggtggggaagaggtttctaaagccatctttctctgcctgcagcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccacctggctgtgcccacccccatggtttcaaagggaggggtccctgctgggaggatttctgtgggatccccctggttggtactgggagggagttagactactgaagtagaccaccagtgagtggtagaagcttgaagggaaagtccacaactagaaacggggtgcaggtaccctgggcaagacccttgcttccccacagaggggaccaagaatgtggcatccaggacctgacacttatgtgggtgactcagtcccatggcctgcagtgcttggatgtgaacactcatttcacgtatcaggaaacagaataggacacaatcgttgagcctggtgttctggaccataccctcactctgtcagctccctgctaactttctcagcacctgaggcagtcctttgcccagggtcttttagcgacaccctttccctccatactggctacagccctgctgatgtcagtgtgtttaagtcactgccagggatacctggcttgcaggtgtctgccttgc

SEQ ID NO: 5380 - DNA, 1094 bp, Homo sapiens
tgccctcccggagaccccggtgaaagccgagcactcctgcaccctccttccgagcccacgcacaccaggacaccttcagccgcgtctcctggtgcgcctgcgcgggggccctggaggaggagaagtaggcggggccggcggccgctggtgactacaagccccggcgtgcaccgcgctaggctggccgtggcgcgcccggaaggtgtcgcggccctgggccccgccccggaagataaggccgctcgctgacgccgtgtttcctctttcggccgcgctggtgaacaggtaggtcatccttgcggccttgcggcatgggcagtatccgccgccatcctcttccgtgaggcgcgctgagacccggaccggccctcctgagaggatgccggtgcgggcgcccgcggagagggtagggagtggtgggcgcggcggcctcgggggcggggtcccggaaagccgggctggcgggggtacccgggccgcccggccgcgctaatcgtgagtcgcccccaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggtgcggaacgctggccggggcgggaggggaagggacgcccggccggaacgccgcactcacgccgcctctgcccacaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaagggttagcatcgcggcggggaaggaaggtcggggtggggaggggtctgggtgttgcctgaggagttaacgtcctaagccgatatgggaacctcgcaggcagaagcttcaggtggggacatccgcgtggccagaccagtggccaccggtgggtgccgagagagttgtaccgggaggctggatgttgaatgctgtgctcgcaacttcgcgggttgcctag

SEQ ID NO: 5381 - DNA, 1200 bp, Homo sapiens
cctctgcccccagtgtgggctcccgtagcacagctgggtattagcttggtaatggggaaaggatggtattcaactgggaatctttggcttctaggaacaaaacaaacttggggaggatgttatcaggatactgaagtcctccccaaaatccaggatcttcagagaaaacctaagaatcaaaaatagaaaagcacaggaagttgaaggactctgtctctgtgtgttgtccctgcttctctcagctccatcctcacctttctgcactccagctctgttgtgtcgtccacagcatgcaacacacagatccagctccatctggagcccgcctgtcagctcctcagccccaattttaaaaccctaggggagaagcatcttctcagcataggtctcacatctttatgtggtccagtgagccatggtgggggaggtaggtgggtgcagggaggcagtatgggaggtccacctctgaccctgtggcccagtcagaagaccccaaagagaggagtagcttgcatagatggaacaaaagcattctccctatgttattccgttcacatgttgctgtgggttcattaaccccacacttagaaagtaatcatctttggctctaagaaaatctggaggttggacctgaaaaacctcaggccagacagtgaatcagtcctggattgtgctgaattttctaatatgactccaccccatgaggcttcatgactgtcagcatctgctgtctccagtgatgctgtgtccgaaattggtgggttcttggtctcacagacttcaagaatgaagccacagacccttgcggtgagtgttacagttcttaaagatggtgtgtccgaagtttgttccttctgatgttcgtacgtgttcagagtttcttcattctggtaggttcgtggtctcactggcttcaggagtgaagctgcagaccttcgcggtgagtgtaacagctcttaaggcggcgcgtctggagttgttcgttcctccggtctggagttgttcattcctcccggtgggttcgtggtctcgctggcctcaggagtgaagctgcagaccttcctggtgttacagctcataaaggcagcgcggacccgaagagtgagcagcagcaagatttattgcaaagagtgaaagaacaaagcttccacactgtgggaggggacctgagcaggttgccactgctggctcaggcatctg

SEQ ID NO: 5382 - DNA, 1234 bp, Homo sapiens
acaatttaaaaaataacattacccattgttagagggggtgtggaggagtgggtattgtcatgtgccactgggtcaaacattgtgtagggcaaattaacaatatcagatcctcacattttctgtacatttgaccttgaccttatcccaggcaaatacttgatggtatagtgaaggatatctttctcagcattacatatataatcaaaaataagaggtgacttaagtgcttcaagggaatttattaaaatggattattgatcagtcattaaaaatgaaagcatacaagactattaaatggtacagaatttctatcagaataagtgggaaaaacaagttacaagtaatatcatatgatttacttttagtgaaacttacatgcacttacacatttgtgtattatgtttatgtgtcatgcatacatataaaagtggaaggcggttcaacaaagtgctaattatcctcatgatttttattttttctttgatttttatgaacttacagtaaagaacaaagtactactttgaaggaagaaaaattattttttaataattcagcataaattacataggttatccaaagatagtaatatggtatttgatctgaacctagacttctgttctgttgatttgacacattttggtgtctttccttttatgttaaataagtaactatcatttacctacagcagaagaagaatataacttagcatttgagacttgataacatagagctgttgaatagttctgtaagatttgttagggaaccaaaaccaggcatgtgaggatggtgctggaagagaaaaggcgggaagggtttgcagtcaactgtcagttatcttcagctttcaggctcgctgcacatggacaggtgaggaccaagggaagaagagcaagcttgggtatttggttgagctgttaagttcagggttagaaaatgaccagcacaaaccttttggcttgagagccaaagttcttggcaggaagtctctgcttgtttccgtttgccttcctcccagtttctcctcaatgccttgcagtcagcatcctgtatctgccattttgaaaactgcccttaggggtcatgagtgacccccttccttattgttaaacccagtgacattttgtccttatctgcagcatttgatgtgttactcaactctctttgggcttgtgtgcctctccacccttgtggttattctcctgcctctgtaaccactcagtgtcttcttccatgt

SEQ ID NO: 5383 - DNA, 1218 bp, Homo sapiens
gtctttgtatagtgttttaaaaacttctcacttgatagcagcatagaagtctgagtttagaaagaaaatgcatcctattctttcatcaagccttaagtggcctgaattcaaagtttttagagaaatcaatgaaatattattgaagtgccaagtccaggttaaagacagagtttttatgtaggatgtacaattatttaatattaggtctaagagattcacatttttttcttacaatatgctattacaaaaagtaagaaagcagtgatttttaccctttaccttacccaaactgtccataattcagttgtttctttgcaaagctgtactttgccattagatacctggatatttccaaaaagagcatttgtgtatcaaaaattacagaggaaactacttcagttccccaccttagtttaggtctatcaatgcatccgaagtgctgcttttttttttatgatcacagagaaggaaaaagtgcatttattcatctgggaggtgtataatcagtcactctctccatcagcccccaaaagcagttcaaacagcatctatttaaattgaagaccaattaaataattatcaaaagcatcaagaagacagcaaggctaagactcaaaggagcacatggagtccggtagaaaaacatagttgctgttgtgaatttttccctcaccatttattagaccatgtgctgccagtgacctccgcatatcaaacagggccttgggcagcttcttttgagtgtatggacctccctgagcacaaaaatgtttcctagtgttttgcagatttagaaggagatgtattttttgtttgtttgtttgtttgtttccagctaagctgccaggccatttggctttgcagaaatgagccctttggttcaggactgagtgaagcctgcactctggccactacgcatgaggagttttctcctttgaactctgcccagcatacccacttggccagcccgatgtatctgtaatcttcagaacgctcaagaagagtgctaaattcagatccttgttttccatggataatttgcttcttctctgactccttttcattgtttctgcctctttccaagaggcaaacccaggagaatgtaaaccagcaccttctgaaaataaacccaaactggccacctcgaagccatgcacctggctggtgatcttcctaagggctgcccccgagggctggccattgtcttgctgctgtccc

SEQ ID NO: 5384 - DNA, 1220 bp, Homo sapiens
taaatcaaggatgtactttatcggcaaagcttaatcacagttaaataatatcctagttaagttgaccaggttccactctagagcaatttctggaaatgataggataagcccattttgcaagattactgattggcagttaatggagctctcacacttttattttagagggtagttaaagaaggctacctgtagtagcttttactgagggcttgccacgtgtgagcacctgctaagtatttagaaaatattgcatggtcttataaatgtgtattactcaatttacccagtgaggtcacatagttagttagttgtggggttgggattcaagcccagatttacctgacttctaagactatctctaaaccagcatacatataccattctttccagtcattgcttagggaagagatctcattttccttctaaatatactcagatttgtagaagttaagtgaatttctcaagaacggaaatctagtaagttgcagacttataataagacagacagttcaggcttctgacttccagtcctgaacacttcccccatgtgattatcttatttatctctaagtcaggagaatgttaattactttaagactaagacggaaatcccccatgaacctggaaactcaaatagcagaatggatgaggctctgcagggtctcagcaactcagcaacacagacttcccctcaccaaggctgatacggccattgctactgctgagctgctgagcgccagcctgcccataacagaagtgaacactaagcttcctgaagtggccgtattccccaaggggaccaagtggcaggtttattatgtaggatctttttcatcaaagagagaaaagcaactctcttaaaggaatagagaaatattccagatgtagatttgccttttccatcattcttccatttatagttattttattcatgaatatgatatcctacacaatcctactactgattatagaactaattatatggtgaagggatgtgggctttcaccacagaattcagaaatctcatgcgtttcatcatacagaagcagctcactccatagaacaagaaatagaacagcctgctaaaggctcagccatgatgtcagctgggagacaataaatacccatcaatatttggcactatttctctcacactcagaatacgtggttcctggaatcaaggagtctagttgagagtagcccctttttacaccaaataa

SEQ ID NO: 5385 - DNA, 1163 bp, Homo sapiens
taggttttttaaaaagaaaaatattgtatatttaattcctattatttgtatttcctcttattgggaattaatgatgtatgtcataatcaatgtattagtgtaaataattttcagtcctggtatgcacgtctttacttttttgatgagggtaaaggtgcttttaattgttttaagaatttttgtaaacattcatttaattatgaattttaaaaatggaaatctttgttcttgtaggtcactcttttgtggaacaaaagtaaaatactggcagctgatataggtggtacaagctgagacttgcccagctgggctttaaaagtgtagcagcgctcttaagtagcagtgaatgaacagaatgaatatatgaacggactgccctttattccatagcaaccagacgcaatactggcaactatgctattatctgattttttattttcttaatctgagtttttggaaggttatgttgtttactttttaatagtatgggactgtggcaggaattgtaattaccaagattttgtctaattatttctctctctctcctctctgtgtctctctttctgtgtgtgtgtgtgtgtgtgtctgtgttttacaattagaagtaaatcagtgagctcagacttgaattagtttcggtattgtgctaaagatgagcagtttgagccctaaccctgttaattatttgaaacagtcaatttaagagaaaccaagaatatggcaattgaacttcccaatgtaacctgatgctctctgcagcctcatttgtggtaacaaatatgaaaggatacatttatataaaacaggagtatgtttcctgtgggggaaaaccgcttgtcatttgcttttaacaaggtgtaaatccccacagataaaccttcttgtaaaactgttccctttggatttagcctcaccttcaacaaaaagggagatgtaataaacgaaagtatgatgaaatattagttagctcttgcattttttgcctagaagttcctcttttttattctttatcattttttaaaatttaatgccgctgtttcagatgaattgagagagtcagaatataatgcattacattcattttactttctgttaatgtttttagggggagagatctaaataatatacttttagattgaactatatttctgatatatcaacat

SEQ ID NO: 5386 - DNA, 1172 bp, Homo sapiens
atgtccctgtatcaatattaaattaaaagacctactattaatggcactgaatgccataaagtacttgccttttcttggcatcatgtttggtgaatgaggtatatgagaaatatcatttcaggggccctagaggatgctggttgctggtgtgatgatttaagcacatcatttgtaattcccctctgtggtcagcctagtctgagaatgtgctgttgggagactagggtgcttattaggatctcttttctgtgccctgccatgactctggcaactcagatggctcagagaggggtttactttattactgattattaaattacattcacagtttattattgttacaggggcttgacagtagtgagtcagcttttggagcgaagtgtgggctcttagcaagatggcatttcgagcactcttggatgcccttgtcaggctttccccttggaactcactgccttcattacctttgtgacattttagtttttttcctgctgaatgtggctctttttcttctggtttaaggaacaaccttatattatcagcctggcctcctgtatggtggatctgtggaacatgactgtagcgtccttcgtggcattgggtattacctggagagtcttctttgcttggctccatttatgaagcacccgttaaaaatagttctacgaggagtgaccaatgatcaggttgacccttcagtgagtattgagaacaaaccgtggtgtggtttttgttttgtctcttgtcacaacccaacttgtgagaaaaaagttccttataaggcacagttttattacaaatgtatattgcttttgttatttactttgagatttagaggttaatcactccaggaggcagatgaaccaaaacttaggatcatcaaattcaggactattgttaacagttaccaaggtgccttttgttgttacctaagaaccttcaaaacagatgctctccgtctcatcatagttgacatgaactatagttctgctggctgtatatgtgagagtggagtttttgtaagatcctgtggtagctgaggctggagggcagctgaccaaaattttgggcaggagatcatagctccttggcattgttacagcgtaatcttgacttacccaggcttcaatcataaactcaagggctttcttcttctgagaagagtttgcaga

SEQ ID NO: 5387 - DNA, 1198 bp, Homo sapiens
ggccatattggctctctgatctaaatgatctggatataatttatgttcaggggctcccaacctggatgtccctgagaattttcagtatttccaaaatctagtagaagtagtttaagcatctgtattttgttgaattatatcaatccaatgtggtaaaccgtttagcatctctgccttttacattcatgttttaaacaggggaaatgacttcatttttatttaataatgttttggtagatccgttatttgcatgggaggagaaaaaggggtttctgattattaagaaatgggctcagatgatggactaggtcagctctatattttaaggataaagaagtgacctgttcagggttaaagagatgagtggcagagccacttgggtaatcgacttggactttgacacatgctgcacaggtactctctaggagccaacataaggtgctgttggtcttgaagggaatgacagattgaatatggaagagctatgccttgtaaggaagcatctgctggtgtaaaccttcctgggcagggtgtcagggtaatccattgctttgctgcatcctcgcctcatctttctcactctctgtgtagattgtgcgacggggaatgcctcccggaggaggaggcgaagtggttttctcatgtcctgtgaggaaggtcttgaagcccattcaactcacagatccaggaaaaatcaaacgtattagaggaatggcgtatcctttccatttatttggatttcttttttttttgttgttgttgcctcactaagataagaatgactaacagctttacttcttcccgaggttatttacattttagactacaactttgaaaagtcttaacagtgaaattgtaattgctggctgagttaggatgttctgttatctgcctcaccatgactagattgattgagtcattctttttttttttttttttttaattttccggttaacatttaggcaaatggctctgatgtatgtgatcctctctcaagggctttggtttgggggccatgaatatactgcagttcctccctcagaagacgtcatcattcggtgaaggaaccaaatatgaaaacacacagttctgatataacatgcaaaatgatatgtgcagtggggtgggggcctggagtagacagtggtcaattttgtctggaggacctagggaggctggagtaatcataatgaatgat

SEQ ID NO: 5388 - DNA, 1159 bp, Homo sapiens
atatatatatttaaatattataaatatatataatatatattttaaatatatatatatatttattttattttattttattttttgagacagtctcgctctgtcgccctggctagagtgcaagagcgtgatcttggctcaccgcaacctctgcctcctgggttcaagtgattctcctgtcttagcatcctgagtagctcggattgcaggcatgcaccaccatgcccggctaatttttgtatttttagtagaacggagtttcactgtgttggtcagtctggtctcaaactcctgacctcgtgatccatccacctcggcctcccaaagtgctgtgattacaggtgtgagccactgggcccggcccagttttaaaaatagatttaagaagattcagattttgtatctcttcctatgtcattttggcaagttgcattttttccaggaattggtttctttcttatacaccttcaaacttactggcataaagtttataataccctttttatttcacattgtgaaacaaaaatatgcatacaaagtagtacataatccagatattcatagttttaacgttgtagtagaaacacccatctcttcacaactggatcagtaaatagaacattactggtctccagtcacaaactgcctctgctacttcctagtcacaactcttattccctccttgactcacttagtaactggtcaacattgtgagattcatccatgtcatttaccagtagttgtaatcattttttaaattggtttataaataacgttccattgtctgaatatagcataatttatccactttgctgttgacatacttttgccttatttcttggtttctaaaaaaggagacattctcttgtataattggaatatctttatcacatgagataattaatgataaatccctaataggatctaatacccaatttatatgcaaattaacccagttgccaccagctaaatttcttctatagctcctttgttccaaacagaatcgatcaagattcattaataatatttggttattatttctctttagttaccttttaactacaatagtccttatgccacttattttcatgacattgactttttttgagtctgagtcgattctttatagaatatcctgcatcctagatttgccttattgttt

SEQ ID NO: 5389 - DNA, 1241 bp, Homo sapiens
gtgatgatggagggagaaactaggtgatgaactaaatgatctgttctctgctgtttatgaatgagatactcatttcaggaattatcatgctgccctttccatggagacatatctgccaggctatcaatataacatgttacactaaattctgaatcaatgaggccactttagaataatttagagttaaaaccgaaaaaaaaatccacttttccaaaatgaatgaatttggcattaatgtcccttttgaatatttatgctaaaatgatatcattatgtacagtgctatttgattaccactcaagctttgcagaatggtgtcatgctaaggacaattgttataagtgataaaattgcttctgctgaaacatcgcctatgtgatatggtatttgagcaatagcaggggtgttctcctttgcttgggattctccttactattcccaaaataagtaatggaacatatttcaagatatatcttattcaaaatgttctcacttccagagcttgaaaacaaaaatctgtatgttctctcagagtcagaagtctgtaatgcgccgggcgcggtggcgcgtgcctgtggtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagaagtctgtaatgctactggtgtcccctaattttcttatagccacagttcctttcgcctgagctcattacagagacaaatatccattagtgacaggtaacttttcattctaatgcgcctgtagtactgatgtctgggcctctgagatattctattttgcacctgaaattagtttctgtgttacagctctgaatttgtgataagaaaacagatactgtaatttagataaactccactaaatggcttgactgaaataaagcccaaatgaaggtataaatgactgtcaagttctctggggtacagttagagaacaaaatagctgatggattgttatttatctgtgcatgtgagtttgggggatttaattaaagatgttctattatattttcaaagtctttctgaagctgtaaatcaaaagctgaagaaacagagaatgttgccattgatcaaaaaacca

SEQ ID NO: 5390 - DNA, 1199 bp, Homo sapiens
aaactgtttgtgtaagttgcttctatagaatcaggaagtaggtaaaataacccatatatcttctaaggttgtaggcattcagaaaaacggatgagattagagatgtaaaaagttgaaagtcttatataagaaaaaaatgtggtcagagctagacttagagtagaaattaaccatggccctaatctacatcaagcatttggaaaagctagagagaaactagagccatttctttctttacccaagtcctgacaaagaaataatttgcatctgtccctccccttaaccatagagagaattagattccattgataatggtgactcattggtatgtctactaattcagctttgaattttgtttctcttccacacatacaccctgccagtttattagccttctgaagacagcaaagatgacagtaaaacttaccatccatgctgagaatccagattcccaggctgttccttcagcagctggtgcagccagtggagaaaaaaagaacagctcccagtctctgatggtcccacagtctggctccccagaaccggagtccatccgaagtaaggcctctggactcatgagagtcctgcacatatggaacacctgaactcagcagagggtttctgcttgggagccagctgcctacctgtggctcactgtttggaaggttgtagtcagggagccctatggtgagggcaggatataaagagaggacttctggaaaaagagtactggactgttaggcaggcaatctatgtgctgtacattaagcagctgtggcatcttaggaaacctacccactcaaagcctcagcttcttcatctctaaaacaagggaatagtattctttgctctccaaaaatatattgctaagggcaccttgattccaggcctctaactaatgaattagaaatatcatttcgtagattctttttttaagctgggaaagtaatttaacttctctaagcctcagctttcttttctgtagaatggatatgcaattatcctatttcataggtgggatcagtactgcctgccactgtaagaaactctttagtcattgccatgatctacagatctgagttctatgctttaggtgtaatagtgggtcctgtcataatggaaatggatttaggttacgtgaaccatagggtgacactttaatgtgtcattacacttccagtctagtatatggaggtaca

SEQ ID NO: 5391 - DNA, 1162 bp, Homo sapiens
aacagaacacctttaaaatatatgtatgtgtacatatgtgtgtgtagatatatagagagagagatacggagagacagacagacagagagagagacagagagagagatgctttcccaagaggaaatgcatatgtaccttgatttaagcaaaactgataacagaaaattgaacttaatgaaagaaaaaagtctggatatggttactcactttacatagagtaagatttttaaaactaattttgcttagtagttaattttacaaaaatgaagagaaacaccctttaagtgtactcgtaatttaaaacacctttgaaatgtaattgtccaaatgtaatgctgctatgtatattatttgggttccagatttttccctttaaaattctcaaaacactcagtgtccttacaactgcagctaaaatggttaatcattctggcaagaaggtgacagtgtgtatattggaaaggcagacattcacatttgaaaatattttgcattattgttagctaaaatcaacctctccttgaatgtagatacaatatatggttttgcagtcaattctgaatggaaaaaaagaatcaagtctgaaatttatgtgaaatgtggcttcagatcatttgaacgatatgtagaaatctagatgaacatatcattagaggtgaaagcaaaatttgaaagcctaatgagatgaagcaacattatctctctctaatctgccaacaatattccctagattgtgttgccactgtattgattctgagtaatttggcttgtttatgcgtgatttaaatgcatgtggctgaatgcagtaatttttcaagttattgagtagtagagaattcaccactattcactgtctcccagagatgaacatataaaagaaaaaaaattctacttcatatatgtaagaataaagcaactaaatgatacaaaagtaaaaacttccaccagaatcagagatattccgacaagtgaattgtgagtctaacacgggaggacaaagctaggctcttgcaaggacagagcacacgtggatcatgctgtatgagctcactttgtgtccctggaattagtgtttttttgtgtgtgatctaactggcaagtttaatgaatagccaaaatctatgttattcttgaggctcctaaaattatgtgtgaaccccaa

SEQ ID NO: 5392 - DNA, 1214 bp, Homo sapiens
ttttaagtgtcttgctgaattctaagtttttccaggctaatgaataagtaatgtggatgtggaatcagatttttgcttgagtctggtggtgactcaatataatacacacagaaaagtatcagttcttctgtttcaagcaagcatactatctctggtggccttcctatttttgaagttgctgttaggatactttaatccttaacatgaatcagtataaaagaaagcatgtgggtggttgtgtttgggtgtcctttccatccacttggtgcttttattttctgtggttgttttattccacagcttagcaacagcagatttccaggagaagtcttagttcttcatctctctctccttcctctggtctggttggttggtaacagtgagagtaaatgaaatgctttttgtttttctgtcttcccaccacagtgtctttggtttacttttaggaccctcattttcaatctctgagccagaagacctgcctttaaatcacagcatttcaattcctccctcctatctaggcattcctttatgtttctacagtactctgcatgcatccctgttataaaatgtatcacattgttttggaattttccaaagttgagctctctttctaaataaactgtacttcttgaggccatggaccatatttttatcatttatacatttctgttacgtaacacaatgcttggcaatggtggttgggtgactggatggaagaatgaatgaagtaggcttgaagagagctgtacttatgatcctattatatatgatttctcttcattttgtccacgttaatgatttctagatatcttggtcacttgaactttagtaatatgaatcatgctgtgtattcaaactttttagcagagaaataataaaattccttttgtaaaccaaagattgtacaaccatctgtgttttgttttgttttgggtttttcttttctttctttctttttttttttttttttccccaaaataggttcaaaaaacaaacaaggctaacttgcacctaagattgaggagttttgatgcagtagagtagtaaactcctgtattttccagcttgctattgtaaattaaaatacctatttttgaaattttaaaatatttatacattgatttcaatagaagtataaaagagggagaggtagttcttttaagataataaggaagatgtgttatggctcaattcttgattattattgcgac

SEQ ID NO: 5393 - DNA, 1151 bp, Homo sapiens
tccctcttccctgctaccatttctaaaatcttttcccaccccatgtgattctgatgtgtccacatccaaagcccccactccttcccctgttgttctgtcttttttttttttttttttttttttttttttgctaaaactgttatgaacgatgactctcttctttttggttcacaagtcataggtatgcaggcctacattgctgctattcttctttcccatgaaaaagcctgtgttacactaggagcaaataaggttaatatgcaaagtaatgtggagacagagcttgctgatagagagagaaagaactgatgctattatttaagtccctagatccactcaaggtagtagggttgttgtcagggttaaatgagttaataatgggagtgctgcagccactgccgctgattccagatctcattgccacacgccccgacgactgcctgatgtgcattcctgattccttttggttccaagtccaatgtggcaactctcaaggatcagctgcttcataatcttctaaaggaagaacagaccgcccagaataagattacagttgttggggttggtgctgttggcatggcctgtgccatcaatatcttaatgaaggacttggcagatgaacttgatcttgttgatgtcatcgaagacaaattgaagggagagatgatggatctccaacatggcagccttttccttagaacaccaaagattgtctctggcaaagactataatggaactgcaaactccaaactggtaattatcatggctgggacatgtcagcaagaggaagaaagccgtctcaatttggtccagcgtaacgtgaacatctttaagttcatcattcttaatgttgtaaaatacagcccgaactgcaagttgcttattgtttcaaatccagtggatatcttgacctacgtggcttggaagataagtggttttcccaaaaaccatgttattggaagtggttgcaatctggattcagcccaattccgttacctgatgggggaaaggctgggagttcacccattaagctgtcatgggtgggtccttggggaacatggagattccagtgcacctgtatggagtggaaagaatgttgctggtgtctccctgaagactccgcacccagatttagagactgataaacataa

SEQ ID NO: 5394 - DNA, 1297 bp, Homo sapiens
ttttttttggatacagagtttcattctgtcacccagactggagtgcagtggcatgatcttagctcactgcaacctccacctcccgggttcaagcgattctcctgcctcactcagcctcctgagtagctgggattacagacgtgcaccaccacgcctggctaatttttgtatttttagtagagatggggtttcaccatggtggccaggctggtctcaaactcctggcctcaagtgatctgctcacctctgcctcccaaagtgctgggattacaggcatccgccaccatacccagctaattttttgtatatttagtaaagacagggtttcactatgttggtcagccaggtcttgaactcctcaccttgtgatccgccttccttagcctcccaaagaatgcgtcatttttttaaagcagtgtgaacgatggggattggattggggcagtgagaccagttcactgtaaaattcattcagaattttagtactaactttactggacttggcatggatttgagtagtcagtaaagaagacaaggtctttgtttccattgaacttacatttttttttagacaaaaaataaatatttaaaataagagggtttaaatggggagttaatgagttggcaacagactaggctacaaaaggcctttctaaggagttggcatgagactggaaggacaaggatcttatagattttttaagtggtgtagacgagagatgggatttaagagcactttaagaggttaagttgatggttgatgagaagtggatggtaaagggggcgggggagggaactagaatctaaggtggctctaaggtctttacttgaataagctagttattgggagtgcagaggatgttggtttggaatcataggcatgagtaaggggaaggtgaagcacctgtgggaactggagtgaagagatatatatattgttctggcaccaaagagggagaagatgtaagttacagatgcagtctctggcatgaagatagggtaatagatgaggtcaaaggagaacggtttattgagaggatgcagaaaccagaatcctgaaggaatataatggagagggggaaaggttgctctgtgaaattatggctgagaatgaactgtcaagagaaaatctaagagggtatcaagctaaacaagggaagggggaatgtccagaatgaagaagtggtcagtaatgtcctgatttagagagggtaccagtaagatacttgccacataggctgctctaggatactttcaggtgaactccatttagttgaatggtaaggacagaaactag

SEQ ID NO: 5395 - DNA, 1209 bp, Homo sapiens
ctgttagctttaaaggcaaatcagagctaatttaacagggttattaggcagtagacattaattcaagggggaaatcgtaacgtaataggaaactttaaaatctttgaactttggaaagagtctttaagtctctatttttaaggtagcgtttacagatgctataggtttattttttactggaattgatatttccttaaccaaaaaggaaagtagaaattctctgagcaataagaatgattgatggatgaaaatacataaggaaagttttaataagtgatctgatattcctatacagtaaaataagtgctttttataaggactagttggtacctaatttttggttttatgatatcagatatgcaaactgtgtatattgtggagaaggtgagaagaggaagtctagctagttccctccatgtgtttatatggtccctgaagctctgctgcctctggtgggtatgtgggcagagaactgatgtgaagcaaatttttcaaaaattgcagctgaatgttgacgtatgttactgccaagtgcatgggatcactcaggaggctaccgttaatttcccgaagaatgttcctatgtacctataatttaatggccttagaaatactatataatctggttgattttggacttgaagtttggtgtctgtcataattttggtagtcttgtttacctgggatgaggagaaacaaaactattgctattctgattagaattatgtattcctaagagtggctgcaatggcaatatttggtttaaagttgcttagctactgtataaactttcacacaatgtctttaatagctctattgagatggaatttacatacaaagaagttcacctgcttaaagtgattttcaatagattttagtatatttagtagattttagtatattgactatcataaccttttgatgatcactttcccctctccaaccgtaaacaaccactagtctactgtctgtatagacttaccagttctggacattttatttgaatggtgtcatacaatatttcataataagtttttaaaaaaatacaactttggatccagaattggtttggccttcatcataattagagttaggttcaagtgtattctatatataacaatataatttttaagaagtgataagtttctgattccatgggatactttaaagaaactcttcagtaaatttaatagaggacaaaagtatctt

SEQ ID NO: 5396 - DNA, 1187 bp, Homo sapiens
catgttgtagtttgctccctaatgctcacaagtccgtgccagacggaaattcgcagaggccgctgcagtcccgcagaggccactcaggggagggacgcgggcggaacagtcgcgctcagtcctcccaggccgccccaggccccaggtcccctggtgcctcgtgccggctcctggctcgcctcccttctgctctgcccagcccaccccgccgcccccctgctcacacatgcggcctctcccccgcgccccagcctctggagtcgcttcggggccatctagtcatacgctgtccatcagatgtgtttacttttttcctgacagccgacacatctggagcacatattcaggttattccagtgccactagacacattccacaagatcatttcagcggttgttatggcgatcttcctccctccagtgattttcaagttgcatgacagaaatagctggagctaaccagggggacaaaagtcaacgggatcaggaagggcttctttcacagaatgaactaattagtgaccctgctttcttcacagggcaatgagcatatggtttaataaagtgagtctgtgacactttttttttctctgtaggcaaagctgtcactggctgaaaactttcctgtttttactggtgggaccgtagtctgctgtctttcaacagagtttacttcacaagtagaaaatgtttgctcctgagagttaagcttcagaacgtattcttggcttcatactacctaactatagcaggtcctgtaacttaaagagacagtattaattttatattcatttcatgggaagggtttatgcttactcaagactaagcattttcagttagggttttgtaagtattatgaattgatacctggaagttcaggtaaatataatgtgttgtttgctgtggtttttctataaaatataatcagtatttctcactggattagttacaaatttatttgaacctgtgatttttttttgggcacagttatagaatattttggtattaaaagatttgattaagctactccatttttatcacattttaagtagcatgcagatgtctggttatgtctgtcaatttttttcctgaggtactttttacattttgtgtaggattttggatgactttatagtgtgaacatatcattgcagacatggaaatttagacctgagatcatttagtgtt

SEQ ID NO: 5397 - DNA, 1225 bp, Homo sapiens
agcaattggatatttctacgcaaaaaatataggaacctatacctagactttacactttatacaaaaattaatttgaggtggctcacatataaatgtagaatattaaatcataaaactttcagaaagaaatataagagaaaatcttgaagtcttagagctgagtgaagagtttttagacatgataccaaaagcatgatccataaaagaaaacaacagtaaattagacttcattaaaattaagaacttttgctcctcaaaagacactatatagaagaggaaaagacaagccacagagtgagaggaatatttaaaaaccatgtgtctgacaaaagtctcatagcttgaatatgtaaagaacactcaaaacttaacaggaagaaattaaacaatccagttacaaaataggcagaagatatgagcaaacattttaccaaaaaaggatatacggatggcaaataagcacatataaagattttcaacttcactattaggaaacagctaaagtaaaaattagtgaaaataccaagtgctgaccaagggacagggaaactggatctctcatatattgttcatgtgaatataaaattctatattacagcactctgaaaaagtttgtcagtttcttaaaaactaaacttaccatacaacccagctatcacacccttagacacatcccacagacatgaaaatatatgtttaccaaaaaaacttgtacatgaatgatcatagaacctttgtttgtaatagctgaaaactgggaacaaccaaaattctcttcaatagctgaacagctaaacaaactgtggtacatctgtaacacaggaaacttctcagcaataaaaaggagctaactattgacgtatacaatgtcctagctttctgacctgaaatttctcatcttggattgtgaactaggctttctttcttgccttctgcattctgtgttgctatttaagtggaatttcaaggtcacaagggattgtcagttctacattttgctggccactttgttggtcacttttgtatggtctctgaatttctgctttcacttcatttttgacctctgacatttcccttgtattttttgccatgttagaaatacactttaagtgtgtttgtttcatagcatgagagttttcttgagtttgtattcagtaatagtactggaaacagaagcccacttctttgtaatttaattttagctactgttaatttgataccaaat

SEQ ID NO: 5398 - DNA, 1156 bp, Homo sapiens
tgtatcttctataggtattttcttcgtgatcaccatggagcttacataaaatatattgtttataacaatcttttaagctcataacaacataacttcaatcacatacaaaatattcatacgtttacttctcacatgtaatttggtgaaacaaattacatctttttatattatgtattcattatcatatttttagttatgttttttaatacctattattgtaatttctatgccagaataaaaagtgattacacaccactgtttacctttaccagtgacctttatactttcacatgcttttaagtattgctgtttagcatctttttgtttcaacttgaagaactcagtttagtatttcttctaagaaaggtctagtggtgatgaagtccctctacttttgtttgtctgggaaagtctctttcactttcatttttgaagacagttttgccagacataatattcttggttggcacgtttttatcttttaaaggtggtgtacacttctttaagtttatttcttaaggatgttttgtatatttacagagttgtgcaattatcaccacacactaattgtagagtacttctaaagaacctcatgcccatttacagaaactcctttcccatccctggctctagtcaaccactgaatccaatttctgtctatggattttgccttttctggacattttatataagtagaatcatactgtatatggtcttttattattagcttcttccactcagcaatatgctttcaaggttcatccatattgtaacatatgttagtattttattcctttttattaatgaatgataatccactgcatggatacaccacagttttttctccattcataagttgatggacccataggttgtttcccctttgggctactatgaataatgcttctatcaattaatgtacaagttttttatgtgaacttatgttttcagttcttttttttttttttgagacggagtctcgctccgtcgcccaggctggagttcagtggtgtgatctcggctcacttcaagctccgtctcccaggttcacgccattctcctgcctcagcctctcgaatagctgggattacaggcgcctgccactacgcccggctcattttttttttttttttttgtattttattttagtagagaa

SEQ ID NO: 5399 - DNA, 1196 bp, Homo sapiens
cttaaattgaagctatgccacaggatagaaaatgaattacaacttaaatacatgttggaagtgtaacactgtttttcaaggtttaaaaaaattcctaatgccttttagccttctttaatatttttaggtaaggaaagtatgtttggattttttcctctttgtaggtatatgagattgaaatgtgaagtatttggacaacaaacgtcaagcaatgggaagccattttgatttcttgagtaatcttgtaagcattaagtgaatgacaaagtagtagtgtaacttatttcttatgttataacttcagtcaattaatataaggatagtttttgttgtatgttcactaaatggttaatataatagccattgaatatactaatctttcatcttagagaactatacaacttttattgtttcttaatggaacattctggctaaccagaaaaagtgagaaaagtagtaccttgggatgtgtagtcaagatgacaaattttaagactggaaaagctctaaacaggcttaatgattcttcaggtagaatgatcctgagaagtgatgtttgatggaataaagtgcatgtgatgattaagtgaagactggggcagaatgatttaaaaaaaggaaaaagatggaagatgagtagacacttgcaaggaacactgtcaaactataaatccattcagtgggttgtataacatttatatttagtctaatttagactttgataatttaatgctacttttatattttaacaaaaatataaattaaaattttcattagtctgttttgttgttgggtttttttgtgaggtactccctgttgggggaaaggaacaaggaacaaccatcagaatcccccagtccctacagaatagcctcacagtaacttgagaaaactgaacttggggttaaataacttgtcacacttgcagtctcctgcctcactccttcaggtgccctgcctagaaaaagacttgtgtctagcatccaagtgaacacatactattgccctctgtgaaccaggaggaatggaacaggcaatggaagggtgatagtacctacaataccctttgtagaccccatctcactaccatcaaaatcttgtccactagcccccaaaaaactggcaaggaaagaaggtggaggggaaatttatggaagtagatggcttaatagttatttcttttatcttgggctgcc

SEQ ID NO: 5400 - DNA, 1189 bp, Homo sapiens
gtgaaactgtaacatgtttgctatagagtaaaatttagcatatgagaaattgattttggatatgaagtatcaagagaatcttaaaaataagtctgctgggccaggtgtggtggctcacacctgtaatcctaggactttgggaggccaaggtgggcggatcacctgaggtcgggagtttgagaccagcctgactcacatggagaaagcccatctctactaaaaagacaaaattactcaggtgttgtggcgcatgcctgtaattccagctactcaggaggctgaggcaggagaatcgcttgaacctgggaggcggaggtcgtggtgagccaagatcgcgccattgcactctagcctgggcaacaagagcgaaactccgtctcaaaaaaaaaaaaaataaaataaaggatctgctacaaagaaactgtgatttggaacctgtgacattgtaataatgcagttctagttaattgaatctgtttttaacctgtgttcaagttgtggagtattcattaagtcacttaactctttcaaatcaaaatattgttgactcagtatgtggtaagtaaagtcttcataattgggaggctgatacacaaattgggctgaaatactgctctacttgtcaccatgcctccctagaataaactgccttttgatgaccgggacgaattgagtgaaatcgtaacggacagatacggggcagacagattttagaatagactcgtaaagggaatggaattcttttctccttataacttggatttgttgtcttttttccttttagccctgcctctttcttgtcgcagtcagtttcatcatcagatagaaacagtgttacagtacttgaaaaggtatattttaaaataagtctcaattaattctggaccatactaaattataaaatattatttatttttgttgataccacagttaaatttaatttctaatttcacattttctactatttgtacattttgtaccatatctacttatattccttattgctaagtgggaatattggaattagttaattctgccagtgacatacaatttcacaatagtattaacaaccttttataggttcatgataaccagtgaactgctaatgaagacagcttcaggatcagccatgattattaagggtttaacattacatatctgtcttcttcaggacacaaagatgggaact

SEQ ID NO: 5401 - DNA, 1189 bp, Homo sapiens; identical to SEQ ID NO: 5400

SEQ ID NO: 5402 - DNA, 1213 bp, Homo sapiens
ctggtgaatacggaattgaagtaactcttggggacaatatataatgaattatgattcatattgcattaccttgaaatatgaagtgccatttgaatgtcccagggcttattaatattgaagattttcaacccctgaactgcttttctgcctctgtggaaaactactttgggattcttcagtatttgtagtagtttgatagaaataatgaggaaccatattcattctaggcattgtttatatttgaagttactgagtttgaggaatggcaaattaaatttgcctaacccccaaaacaaatgaaatatctcaattataaaagcaacatggccgggcacggtggctcaggcctgtaatcccagcactttgggaggctgagcaaggtgggtggatcacttgaggccaggagttcgagaccagcctggccaacacggtgagaccctgtctttactaaaaatacaaaaattagccaggcgcaccactgtagtcccagctactcaggctgaggcaggagaatcgcttgaactgaggcagaggctacagtgagtggagatcacgccactgcaactccagcttgggtgacagagtgagaccgtctcaaaaaaaaaaaaaaaaaaaaaagagagcaacatatttgtgtaagtttgtatatgtgtagggctgtgtaggtatgtgtatatacagccatattctaagtgtatatttattaaaatagattgcatgttgcaatacggttttctgaaaggggtctcattgactattaaataaatgactactactaaacttgtctgtagtcattaatcttaaaattacctgaaaatctgatgacagctgccttccctaactttaatgtattaggttggcacaaaattaattgtagtttttgccactattaatggcaaaaaccgcaattatttttgtaccaacataatacacctttcatattatgtattatcttgcttaatgggttttatcttgattatccagttacttccatcctcttcccaatgttaatttgcaatagttttaaaatgggaacaaatgaatcaatcatcagatagttaaaatgaaattaaatcagctgcctaataatttatggaattcattggaatgtgcttaaaatgctaaagtgtatgtcattgaacatgaaatcttttttcaggcacatacattgttggtattgatgactttttaaaacctgtgggataaacttgca

SEQ ID NO: 5403 - DNA, 1217 bp, Homo sapiens
tacccctgaattggcaggaattgtcaaaggaaatagagatgcaagcttacatcaaatttaaaagtatggcaggatgattatgtagataatgtgttaagtggttttcacagacaaattaactatgcacagttatatattaacataatgccactgtattttagtaaaactggaaggtagtaaaagttagcctggttatttttcaggacttggtttcccttatatttttataatatttaaccaatcttctagatttctgtggaggggcaaaaagcattttagaatagttctgatttgattttaaaggcctcattataggttttcatagatgctgttaagcttacgtttatttctgatgtttttaaagtagatgtggattctaacaaaacaaatattgaaatgattgagtcctttgaatttttaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggttagtctaagatgatttgagggggtgggaggagttcgacctggctttggatttgcgtctttaacccagaaaggccttaactgtttgctgttttgttttgtttaggaggctaaggagaagcgccaggaacaaattgcgaagagacgcagactttcctctctgcgagcttctacttctaagtctgaatccagtcagaaataagattttttgagtaacaaataaataagatcagactctgatctctgttgacttttcattgctgatagaaaactacataaatgaagagagggaaagttaggtcatagaaaatggggatatgtatatatggtattccaatggtggataaagtcagacctattgtgtgtggtagtggaagacaaggtcagtgtacaggggttcctttcaggggatgggtggcacaggaagggattctgagcataagacacctgcctcttcagaatggcatggaacttaggggaaatgatgaggactattaatcttttttatatagtttatttttgaggaatatagctctttaaagcactatacacaatttaatacatgaaaattgaccttgtgaagatgaacatgtcttttttaaaaggtaacttttaaggcatagttttagtggataccta

SEQ ID NO: 5404 - DNA, 2537 bp, Homo sapiens
gactaccaccactggcacaacctcagacccacacccaaccgactttacctcccaggccctgattaatctcgcccggaagtaccgcccacccatgctcacttccgctatcccgtacttctgctcatctcgcgagaactgaaagcgcctatgtgacctgcgctaagcggaagttggccctcttttccgtggcgcctcggaggcgttcagctgcttcaagatgaaggtaggtgatggtggcgagtgttagactgggtttggggaacgtgaatcgagtcccagaacgcggcattgcctcagttccagcactccaggatcctggctttaggtggagaagggtctcaagtaggagaaggctcgcctttctggggcatggagctttttggccgaacggatggcaggcgattgcggctggagccgcggcgggccgggagcgccatggtggcgtccccgcgcccagccgggacggatgcggcgtgttgcccagtttgcggcaggcctgtggtgcggctcttgaccccggctttcttgcttcgggagggtgaacggctgcggagtgccctcgcccccagagtcattccgcggggcttgaggggaaaacgtcctgctgagtgcggcgcttcttgactgctactctgctttcacgtgcttttagtgagtacagtcggcatcttatatttcctgcttgtgtggaggcaacatgaaaggctttttgcagtggaattaactttgtagatggctctacaattacctgtatagatagtttcgtaaactatttccccccttttaatccttagctgaacatctccttcccagccactggctgccagaaactcattgaagtggacgatgaacgcaaacttcgtactttctatgagaagcgtatggccacagaagttgctgctgacgctctgggtgaagaatggaaggtaaaagttgacaaattgttgcaggtatttaagtcagagacggtaaacgccattggtaactggtatttggaatggggttcagactccgggttctggcttctgacctttggtaagttgcttccgaatgccactttataaagttagaggtattaccttggagggggggacgtagagtaagccataaaatatacgtaaagtttacatcaacataattcttgccctgcatcatgcatttggcaatatgtcacatagctgtcctcataatccccaaagtgccaaaaagggttgtatctgatttgtttgttgctgtttgatattttatcttcttagtgctgttatctctaataaaacatcggttagaaatgcgacttgaaagacatttgataattgaacttgacaagttgggaatatagacaaaactcactgaacagagaaaacgtgcttaagttcaaattggttttcataattatactttctcatataggtgtgttcacagaggtcacaatcctgtactgtataattttggaatagaaatagtaaatgtgtcattcattgtatgctcttgcagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggtgagggttacttgtgttcaattttcgttgaaattgatttaaagccagttgtccaaatgcttattcatttgcagtatccagacttacagaccaatggatttgtttctctaccatcaattcaacattaaacattctgatttaggattcttaaggaagttgttgaattaaaatctcttcaactgtttcttctaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaggagggattatgcaattagggcttgcttaattttggtaatttgtctatcattttgtgtgcatatcagaagataaatatgtgcctttggaaggccttagcactattcacttggagtttttacagaaaatatttgggggtggccagcatacccagttggtgttaatccttgcttattatatccagtgccttgtagagtgcagtaatttcgttgaaaatctgcttgtgaatctttgatgtatacattatccaaaaataacctgactttaaggtcattgctatctggtttaggagtcacatgtttgagaattctgggactattagcaccacacactttgtaattttatatcagatgttctaaattattaatattttttaagagatgaggtcacactgttgcccaggctggtcttgaacccttgagctcaagtgatgctcccactttggcttcccaaagtgctgggattatgggcgtgagccaccacacccagc

SEQ ID NO: 5405 - DNA, 1211 bp, Homo sapiens
tagttcatttttagcctgcagaatcgcctcttctatttgaccaccttgaagttggtcttctgattttttatttttatttaattaattaattaattaatttttgagacagagtctcactctgttgcccaggctgaagtgcagtagcatgatctcggctcactgcaacctccacctcctgggttcaagcgattctcctgcctcagcctcccaagtagccaggactacaggcatgcaccaccatgcccggctaatttttgtatttttagtagagacagggtttcggcatgttggccaggctggtctcaaactcctgacctcaggtgatccgcctgccttggcctcccaatgtgctgggattacaggagtgagccactgcgcccggctggtcttctaattttttaacatctggttctgctttaaccatagccagtgtctcatttgtaatctgttctgtatactttctatatgctacatttttagggatttgctcaagaacataaaaaaatctttgtatacaatattcttagcctctcctgtggactctcgcatacagccaatcccacaaggccagtggtctctcttcagcacacccgtcatgactctggctaattgagaaaaaaaaaaaaagatttgtgtgtgtgtgtgtgtgtgtgtgtgtgtgtgtgtgtgtgcgtgcgcgtgtgtgtgtagagataagggctccatatgttgcccaggctggtcttgaattcctggccttgagtgatcctcctgcctcagcctcccaaagcatttgtccattttaaaatcgggttttttaatatatattcaggagactaaactcttattagatacgtgatgtgcaaatattttctcccattctgtagacttttcgctttcttaataatgttacagtttttaattttaaagcccaatttatataatttaaaaattgttgtagatcatgcttttggtttcatttaaaaatacgttgccaaatccagtgtcataaagtttacccctatgttttaaaatctaatcttaaagacttaccctatgttatggtcttagtttttatatttaggttattgatccgttttgagtttattcttaaataattgtgtgaggttgggactccagcttaattattttgcagatagatgtccagttgttccagcactatttgttgaagagactattcatccctcatcgaatggtcttgacactcttgt

SEQ ID NO: 5406 - DNA, 1187 bp, Homo sapiens
aaatgtttgttcatgtcttccacttatttttctatttacttattagaggtcttttaatatcctggagataggagttcattgttgtttctatttactattgacatattttcctagttttctcagttagtggcttttttactttatggtatcttttgataaacaaattcttaatgtgatcagatttttaaaatagttagttctttttaatgtcccatttagtatattctcctataccaaggtcatatagatattctcctgaattttctgaaaagttttagaagttttgtctaacattgaaatattttcaaatatctggaattgattttatgtatgtatgaggtaagagtctaatttaaatgttttcctatataggaaaccagctccagcatgttttattgcgttgtctatgcttttatcaatgatccgccatgtcaagcatcagcttttaaaatatttatgagtctgtttggaagggtgtacatttctgttccattgatcagtttgttgatctctgtagcaatactacaatgttgtaattactatcatttcataaagaggttggctatataatgtaacaagttctagtagatcatttttttcttcatatacattttagactcagtgtaagttctctgaaaaactgttgagatttgaattgaaattacattgaatctgtggttgaagaatattctcatctatgaacctagtttctcaatgagtttatttaaatgttatttaatgtctttaaagtatctgtgtagttttatgctttatttattcctagctactttatattttgttttgctattattaatattaaatgtttcctgtttgttcctgatgtgtaaatatgcagtctaccttaggatattgatatgacttctaacatcttactaaacttattaattctttacagatccttttgtatttctgtgtggacaattaaatgtgaataatgacacatacctgtcttatttccaattttcctatccttttccccccagtgcattttgcagtcctgagttagtaggaataccagtaaaaactgattacaaagggactgattctaataatttgctatttagaaggttgtctccatgggactttggtagctactctttttcaagttaaggaatttatctcctagtcatgtttgtaaggaattttgtttgttttcattttttgaa

SEQ ID NO: 5407 - DNA, 1201 bp, Homo sapiens
gttagctattattattactactaatattattagtaggaactatttgagttagtcgttgttgttgttataaaccatgctgggttggtaacagagattgttaccaacaattgttggtgtttctttgtagagaaagcaaagcctgatgtcatttttatctttgtgtccagtgttttggctcacacaaattatagctacttggcttttctcattctgatgttgccaaggaatcttataatttaatcagtgatttgagtggcctgtgccttgtcaaatgaaggcactattcctaatgcctcattttattattattgttatttttgttaatatctttgaggcagggcgtgatggctaatgcctgtaaccccagcactttggcaggcccgggtgtgtggattgcttgagcccaggagttcgggacccacctgggcaacatggtgaaaccccctctctacaaaaaatactaaaattagccgggtatggagatgcatggctgtagtcctagctacttgggaggcaaaagtgggaggatcagctgagccgggggaggtcgaggatgcagtgatggtgccactgcactctagcctggctgacacagtgagaccctgtttggaaaaaaaaaaaaaatctttgagcaaaatatgtgttttggtaagtttgagaatattcaaattcccaacaaatattgcccatcagtctttcaaaggcattcaggtgagtagtttattctttttgcagctccttgctgcctttttatcagcctgctgcccagagcccgcagaagagattacacctgggacaggggatgacttttcttcaatcttactcttaacagggccattccaaatggattttagaacaatttcacataattagggtaagcaggttttacccttggtgtttccaataattaattattacaattaaaatccatttactgtatgtactccaatgggatgtcaaatgtaatctgtatttagcacccccctggaaaacttaaaatattttcatttaccattgttcagactccaaatgctgatggcttttcagagaacaaaaatgtcttccttgcggaggaggttaatctcagcctgtaccagttagatactacgagagccatcataaacgcaatgtcagagaactggagaagatagagccaactgatgagatagatgctttttcctgttcctgttagacatatgct

SEQ ID NO: 5408 - DNA, 1195 bp, Homo sapiens
catcatcttctgaaagacatgggactgagcatgttgtgtgttatctcttggttataaccaaccactcccaaatctctcagctcttgtctagagtcttcatagtgatatagtgctagaaaggctctcttgagggtttatgtagtccagtcttctgctgcttgactgatgagtgattaatatcctctagcaaaaatctatcttacttttaaaggtctatatgtttgagttcctatatccactctacttttgttaaacctgttttagtcactattatagattagtgccattctttacagttaatgaaaatcaatattgttcacaatttctttttcagacctgttttgacaaagaagtactatcagatgtttatcttattgttactacttaatgtgtctgcacatttttattaaatgctttttaaaataaagattctcaattattttctacctgtaaaagatgtcttacaaccacccagtatttatttaaatgtatttttctgtggtttattttttattgatatataattcacataacataaaccttttatttttaaacacctacttcctcctctaaaagcaaagcttactagcattttcacaggtcctccctcaggctatggggccaggatttggtagctggtgctgagagaaaacgcttgattgcatccttgccctgggactgtgccagtggcagctgtcactcaatgggacaatttctcctgctgctctaaccttaggcaaacaaacaaacaaacaaataaacaaacaaacttaagagcctaaacctggacataacagttcaagtaacctaggattgcttttctgtttcattgtttactcttacatgtctctgttatgttgttgcttttactcaacttgaggttcatggtaatttccaaattatattcatttacataagttttatttttctctccggaagatgacagcaatactatttacctgtattttgcaacttcaggcactgtgctaggtgttttatagatattataacctaagcaggaaagtagtcatttcttaaattttacaaacgagtaaagagaggcttagaaaaattgcataatggctgatagctggcatggctatcctgaagtcctggccctttaaattttatggtgtttgtcattagtctaaaaaccttggccatggttgttaatgaatttcttcttcatgggaag

SEQ ID NO: 5409 - DNA, 1177 bp, Homo sapiens
aaaagaatggtaagataatagtgtgtattcagttaaattgaaaagataaaacataaaatataagaataaatatgcttgcatgatatatacagaaacataattccttaataatcttaatattggaagagacttttaaaacttattcattctacaaaaaatgacatgataagtgattaagcttttgaacattacttaattctaccttcctcaattacttgacatttttacttatgatgtttattatttaaatagtccattggaaagaagtttattgacagaagtgctaaaaaggtaattacttcctccacttataaggaatttgcaggcatgtaagcaacatcacaaaaaaaggtaaacagtataatcttactcttctaagattcaaattatatttatatactaacattataattaaagaagtattctacagtcttgaagtttaacctttaagagtcaaataaggtcaaggaaagaaatgtatctaaactagcaaaggtcccaaccagacaatctttctatagtgatatatcactctagccttattccaatccagcttgagcatctgatctgtagtgattccttgaataacaacagctagcatttattgaagactaactataacattctgttaagcactttgtagaaaatcatgattatcaccacatttcaaacggaaaactgaagcttgtactgaatttcggactgtatcaaagcaatctaacactaaaacccatgtacttgccacttagccccacaaagacagggatgacatctcatagacctttgtgtccctcgttcccagcacactgtaaatgcttttagagtataaattatgtctaatttccttgtctcttcaaattctataagcaaatggatcttataataatgttgcaattatttgattctatgaaaaagtattaaaagactactatctgccaataaagttactccaaaatatattctgatcaagttaacttagaatcagaaaaattagcccatccaataaaggttactaggatgccaaaaacataaacatcatcagaatctgaggtataaatttcctagtatgtagaaaataaggtcagcaatacaggaggttcaagtatggaaagacacaggaaatactgcagactagaataagataaagtcaaatatcacatcacttgaggggtttgat

SEQ ID NO: 5410 - DNA, 1207 bp, Homo sapiens
gtggtcagtattggtgaatgttacatgtgagcttgagaagaatttgtgttctgctgccgttgcataaaatagcctgtagatgtcagttatatccagttgattgatggtgtttttgagttcaactgtgtctttactgcttttctgcttgttggatctgtccatttctgagagagaagtgttgaagtctctggctatacgagtggattaatctgtttcttcttgcagttctatcaggttttgccttatatattttgatgctttgttattaggtgcatgcactctaaggattgttatgtcttcttcgagaattgacccatttattatataatgtccctctttattcttgacagctttccttgttgtcaagtctgctctgtctgaaattaatataggtcttcctgctttcttttgattaatgttagcatagtgtctttctctatccatttacgttttatctgtatgtgtctttacattaaagtagatttcttgtagacaacatgtagttgggtcttggtttttgatctactttgacaatcttaatttgcttccaaaatgattattgatatattttgattaatatcttctatatttgttactgttttttttttctgtttgttgctcatgttctttattctgcttttgtattctttttttgtccttacggtttcaactgaacattttgtatgattttttctcttttgttagcatatcagttatgtttctctttttactttttaaatgattgccacacagtatgcaatatatatttacaactatgtctacttgcaaacaacactataccacttcacaggtagtgcaaatactttataataacaaataatcctaatttttttctctcattccttgtatcattgctgtcattcatttcacttatacataagcatatataatcaaatacatgactactattattatttttaacaagctgttatctgttagatcaattaagaataggaaaataaaagttttatttcatgttcacttatccctcctctgatgccttcctttctttatctagatctgagcttctgatctctataatttgcttactccctaaaaaaactttaaacatttcctgcaagggaaatgtacgggtaacagattttctcaaattttgcttgtctgagcaaggctttatttctcctttatttttgaaggatcattttgtggggtacagaattctagg

SEQ ID NO: 5411 - DNA, 1198 bp, Homo sapiens
gctatattaagagaaagaaggagaggataaaaatgagtaagaaaagctgctgtgtgtcaagttgtaaggtatgcaggctgaagtggtttgctagaagccagttcaacataccggtgcttcagaaaagccaaagattgttctattctgctgggcttattgacataactgtcttagttatgtctttacaacaaatcaataattttaaattggccaaagatgacacagaagagatcctaggaaatgtaatgttaatagatgaaataaaaatttaggaagaaacaacttactaagcttggatttttaagttatgaaaaggcataatgacccatactacattgataagaagaattcagaaacagctctagagtcagaaggaaggaaagaaactgttggcctaacacaacaaacagacctgcatttacaagactctgtgaaggaacacaagttgctttttgacttcacctgccctcctatattagctctttctcttcttctggttaataccaaagttctctgttgaaatttttttccttttgaacagggagagtccggtagtgaaaggcaatgcgctgttagctctaagcagccttgctgtcgtcgtatctagacatgaagccagcctctcctcagactctgacgggctcctggaggttagttggggtgatttaaacaattggctttgattatgtctttttaagcctggctttaggtagcctggccctgggcttacaaggttagattctgtgattatggcaccaagttatagtacttgatgggcctttatactgtgagcctcagtgtcttcctaactttgctgcttttctgttttcctttctccatcacagttaagtggtcatttctatttgaaggtgccaattttatgccataggggttatctttttgtgattacatcaatggtaaccaatcttacaaggttaactaggcttactgaaagtgaacaatgccgtcaaaatgataaataagcagtgtttattgactgaaaaaaatgtactttgcattttaattgtatatgtcaatgacaaagtgcctattcatttttgcaaggcagttatttcttaattaaacatgtggtgagctggccactgttcatttctaatgtactttcttggataattcatatctgtctaaataaaaaggcatggatttattcttgttttaagtctcattatctggtagc

SEQ ID NO: 5412 - DNA, 1158 bp, Homo sapiens
ttatgatgatgttctaagctgtgaatactattcaccaacccttgaccagtggaccccaattgccgccatgttaagaggccaaagtgatgttggagttgccgtctttgaaaataaaatctatgttgttggtggatattcttggaataatcgttgtatggtagaaattgtccagaaatatgacccagaaaaagatgagtggcataaagtttttgatcttccagagtcacttggtggcattcgagcctgtacactcacagtttttccacctgaagaaaaccctgggtcaccttctagagaatcacctctttcagcaccttcagatcattcttaggtctaaggtgtaacacctttgcagtacgtcatgggtgatctaatacttccccttcagttgtatcttcttacagtgattggtacagttattagatataaaggtaactgatgttattcgtcttgtatggcttttagtatgtttatcaagtggctaacaaatgcattctgaaaatgtatttaacatagctgttttaacaaatgaaaaaaagacgtagaaaaatgtttagatgtctttttgtgatgttatataaaattgtagatgactgtggtaaatgtgtaattatgtccattatgcttcaaagttgagttttcatctttgactccaaaatgtcagagggaggccgctctaaactaaaaataacgaaaggttgccaagtattaatactagttacctccctcttttcgtagtttttgtcatgtctgtcaacttactcgattgtgtggttgcattcagaatatttgaagtttcttacgtagacagaaataataaaaatattaactaggaaaaaacagtatagcaccaagccagtatttggtatctctctctagagcgagcaagagagggagagaggaggaaaaaatacacataatacaaacatacatgcatgcacacatacatacatatgtatacacacacataatttgaaaactgattggcacttcaacgatgctgaaattgtttttaaattgaagtttctttcttccacaaagcagccgtttctattcaaatggaaattcagtaccagagaataaatgtctatgtagtcatactgaatttagatagataagggctacagcatactaaatcgacaaccaaatttgtcatgt

SEQ ID NO: 5413 - DNA, 1282 bp, Homo sapiens
atgcattgaatctataaattaccttgggcagtaaggccattttcacaatattgattctcctatccatgagcatggaatgttcttccatttgtttgtgtcctcttttatttcgttgagcagtggtttgtagttctcttttgtaagttggattcctaggtattttattctctttgaagcaattgtgaatgggagttcactcatgatttggctctctgtctgttattggtgtataagaatgcttgtgatttttgcacattgattttgtatcctgagactttgctgaagtcgcttgtcagcttaaggagattttgggctgagacgatggggttttctaaatatacaatcatgtcatctgcaaacagggacaatttgacttcctcttttcctaattgaataccctttatttctttctcctgcctgattgccctgaccagaacttccaacaccatgttgaataggagtggtaagagagggcatccctgtcttgtgccagttttcaaagggaatgcttccagtttttgcccattcagtgtgatattggctgtgggtttgtcataaataggtctttgtgcctgtagtcccagctactcaggaggctgaggctggaggatcgcttgagtccaggagttctgggctgtagtgtgctatgcgtatcgggtgtccgcactaagtttggcatcaatatggtgacctcctgggagcggggaccaccaggttgcctaaggaggggtgaactggcccaggtcggaaacggagcaggtcgaaactcccatgctgatcacatgctttttctttcaaaattgggatccttcaggttgagccagccagagaagatagcgaggtgtaaatctctccaaaaaagaaaccttacaaattaaaaaaaaaaaacaaaaacaaatagcaaagcagaagttattaagttatatatctatatataaaaaatatttttaaaaggtaaatcatttgtctcatgacctagaatgaaactagcacaataattacaaataattttgtttgtctatatacaaaattttagattggtgccattttatgaacaatactgcacttttatagttattttgtgcaattttatagtaatagatatttctaggttctctggtgttcttgtacgtgttgatttcttgttctacaaactacgtatttgtaaaagtggggtagagattttaatttgtatgtatatataaaagtctctattctccacccctcggcattcctgaacctgcctctctgaggataaagcaattcattttctcccaccctt

SEQ ID NO: 5414 - DNA, 1099 bp, Homo sapiens
tgaatatcactgcctcctttcttcctttcagaatatggcccagttttctgttttattaccaagacattaaagtagcatggctgcccaggagaaaagaagacattctaattccagtcattttgggaattcctgcttaacttgaaaaaaatatgggaaagacatgcagctttcatgcccttgcctatcaaagagtatgttgtaagaaagacaagacattgtgtgtattagagactcctgaatgatttagacaacttcaaaatacagaagaaaagcaaatgactagtaaacatgtgggaaaaaatattacattttaagggggaaaaaaaaacccaccattctcttctccccctattaaatttgcaacaataaagggtggagggtaatctctactttcctatactgccaaagaatgtgaggaagaaatgggactctttggttatttattgatgcgactgtaaattggtacagtatttctggagggcaatttggtaaaatgcatcaaaagacttaaaaatacggacgtactttgtgctgggaactctacatctagcaatttctctttaaaaccatatcagagatgcatacaaagaattatatataaagaagggtgtttaataatgatagttataataataaataattgaaacaatctgaatcccttgcaattggaggtaaattatgtcttagttataattagattgtgaatcagccaactgaaaatcctttttgcatatttcaatgtcctaaaaagacacggttgctctatatatgaagtgaaaaaaggatatggtagcattttatagtactagttttgctttaaaatgctatgtaaatatacaaaaaaactagaaagaaatatatataaccttgttattgtatttgggggagggatactgggataatttttattttctttgaatctttctgtgtcttcacatttttctacagtgaatttaatcaaatagtaaagttgttgtaaaaataaaagtggatttagaaagatccagttcttgaaaacactgtttctggtaatgaagcagaatttaagttggtaatattaaggtgaatgtcatttaagggagttacatctttattctgc

SEQ ID NO: 5415 - DNA, 1227 bp, Homo sapiens
tgtgcagttgtcaaaaagaatagatatctgtttatgcaccagtatggaacaatgttcatgacaaaaggggaaatcaaaaatacatagagtaaaataagtttgtggtgatgtatagataggatgtttatacttcatatttccagaaaggttctggaaagaaacttattgatggcttctgagggatgaatcaagagacttaaactgtctacttcatacctttctatagtggttgaatttttcaccacaggcaactgttcctttaattgatatattttaaggaatggatactagaggagacctagcttcatagcagtttatgtaacatgagataaaatatatgattcttggcattaacttctgataggttgtgcttggggcactatatccagttctgggcacaatgctttcaggaggatgactatctaaaaagcaccaagagaagagtgaagggactgaaaaaaccatgccacatatgtaatacttaaatgggttaagtatatctaactacttaggagaaagccttcaatgagaactttgtttaggggctgtcattctcttacagacatgtgcctccctcactgttctgtaagcttttgtaaaggcaggagttgtttttttaactcatcagtttaggagcctcttttccttgtatttagcacaaactcaacaaatatttgtgtaaataaaaatctgattacgtttctttcctacttaaaacccttcatcagctctcccaaacacctccccatgttcactttcagcaggtgactttagttccctcttcacagacagaactgaagcatcagcagaacactttcaagacccccctctgctgctctctcccaaactgttttccctcctgttaccatctgtgatagtgcttctcaaacgggagcacgcatcgtcatcacctggagggcttattaaaacaggttgcatggcaccaccccagagtttccgattcaggatatctggagcatggcctgataatttgcatttccaacaagttcccagatgatgctggtcccactttgagaactactgtcatagatgtttctccctgatcattgtcttatgcaccagaccccatacctcacacctagtaaggacatcagtctagtaactacccatttcataatcatttttctccttattattgaatcactttttcagcacacaaatatactttatttctcccattaaaattcttgaccccaattctatgtg

SEQ ID NO: 5416 - DNA, 1153 bp, Homo sapiens
ttctgtatcccgggttcttgccttgatgtactggaagaatcacacgtggacttggagaattagtgcaaggttttattaagtagaagtagctctcagcagatgggggagccagaaaggagaatggttttccccttgggtcaggccactcggcagcctgggcggcctgggctgtcctccgactgccctggccaaactccaaggcgttctgctggtcagtggcctgccagtgtgctggtgcctgctgatgtgctcctctcaacatccagctgcctgtgtgttcctctgctgatgtggtcctctccacgttcagccgcctgtgtatctgcctgcgagggtgtcaggcacaggattagaggtatggcaggccagggtggtcttgggaaatgcaacatttgcgcaggaaaacaaaaatgcctgtcctcgcccaggtcattggggtggagccctagccagggaccacgacctcctcctctacccagcatttcccttccccacttccgtatcatttaaagggaccatgctcttcccttcccagcactcccatatcaatagtatcatcaaaaaccacttctctgctggtcgtactctgttgaacacagacactgtataagtcactttctaccaccaatccagacaggcctcagtcattgttgaacagcatgaacaaattatcatgactcactaaaaagaaaaatatatcagccagtatgaaacagagaaaacagggcaaaaagagatttatctgactcatgagattgttttagttgttgttgctgattagtaaggttttttaacaccaaatttttcagcatataattgtctcgatctacttagaacatcattaaagtcaacataatttgtccagggattgtaattttatggtggaaaatgtccaaaattgcttatagctattatcattaagtttttacctactcattattccttagtgaatatgaaatgggagaagtgttctcttatccttctcacagggtatgtgacggggtgtggctcacttctttggtatcccgctgctcaaacctctagggggagcatttttggggctccaactccatggcagtgtctagagttgtttacagctcctaaagccccagtgggcgtgtgttacagtgtgctcttttagttttgccatctg

SEQ ID NO: 5417 - DNA, 1199 bp, Homo sapiens
tcatactgcagtacatttttttcttttagttctgttctatgctttaaataaaaatacaattaggtccatatggcaatataattttgactccttttaaaactgtagcttatatcataagtctatttgatgttgttttgaagttgtcatgtacattttgtcatacaagtttttaatgactgtttttatggggttgtgccccaagttacttattcattcccatgttatcagatattttgttctttagctttttttttttttttttttacattataactaatgaggcaatgtgtcttgagtattttgaattaactctctagaatcgattcttggggaggttatttactttgaagtgatggacagagtgtaggagatttatgagtgaactcttgtctgatttggaaatatagagttgtttaggctaggtattaccaacccaaagttgacacttgagtcacctaagttcttctctactccagagacttggccctgcctggcctgatcccaggaaaagagattttagggattacagaaatgggaacaagttgtgggtctgagcacagcatgcaaattaattcaacacagcccctgggacaggcccatgatcagtgagctgaaactcccccttcaagtgctttcatgattagactccagcctaggaagcttgtctattagttgtgtaatcttgaaaaaatctctgacacttttccctctgactcagtttccccatctggcacccaatcttttacagtgttatgaaaaatagggaaaatgtagaaaggaagaacatggcacccaatccttaatggacactcagtgaaagctggctatcatcatcatttttggggttgttgtgttctacaaatgtattttcccaggagttttttttactctgtctcctctttccttcatatacccccagcctgtggctggggtcttgcttcaaccaccatgcacctttctgaaacccaagttttactccctgataaaggtattgacctcttgttggtctcatcctccagacctacctatacttaagaaaatgacatctctttaaactggtccccagttcacttgttttccctaacattttaattcacaagattaatcacttcccttacaggccagtcttactgcagagttgatttttataattttgggcctgttggtctggttgtacttttctctttctgctggtctgc

SEQ ID NO: 5418 - DNA, 1129 bp, Homo sapiens
gggctagagacagcggccgagaggacgagccgggcagccccagggccctgagggcccgacttgagaagctggaagccatgtaccgccgggccctgctgcagctgcacctcgagcagcggggaccacgtccgagcggggacaaggaggagcagcctctacaggaacccgactccggcctccgctcccgggactcggagccctctgggccctggctgtagccgaggccgcagccggtgagaggcggagcctcgagcgggcccctcctcctccgttcccagctacccccgacctcgcgcacgccctggcccgctccctgcccgcggataccttggactacggtgccttcccgcccccaccagtggacacttccgggtggcgcttggccatccgcttggtggaggtcgagtgggtgcaagggccctcaggacctcccacatgtacagttcccctgcctcttgccccggctagtttccctggagagaggcctagccaacaacgaagggacggattttaaaacagcgagaactgggtgccaagaaacacttcatattccctgaacttttctggatgttgtgcgaacctgttgtatttttttttttcctgtattttggttctgagggatgagtaatgtgtttttagttggttgagtttatccattcttcaatcccctaaagccttcagctattctttcatatgtggccaacattttaagtacagtgtttgcttttataagtcggtgttacttggatgtcctataaaatacccactttttataaagatgatatttataacctaggaactcatgcctgtcttggctgcagtccctgtacatctaatatatactgatttgtttgcccccagagaatttttaaggtatctgcctatatcgtgatcttttgaaatggtaaataaatctggtgcattaaaaattatctgaaaggttgcggcgagtattatttgaagtgtgttacatttttatatttttaaaaagatacctttatgaatatactaatttaaatctggttttagttgtccttagtaaactatcatgttcttttagcttcatgtaacagtgatcttttaaaataatctaaagattaggtagtctaaaagttattttaatctttaa

SEQ ID NO: 5419 - DNA, 1123 bp, Homo sapiens
caattacacaaagaattgccactacactagtaattgttgtcttgaaacagtaactaagcaaataatacgtgaaataatgatttgtcatattcagccacctacaggtacactttgaatgaattgtgtacattgattttttaaaacctgagaagggggttcaatgagtgcaactcaaaagaacactggatgccctcgagaggggcccgtcagtgacagcagagaccagcatgaagctgaaaaccccataatgatcaccatgacagtagaggccacgagcatcagacggaacttgatagaaccacccaaaccagggaccaggatcccttccactggcatctcagcagtcccatgaagggaccttcctgtccctcgtctctgtcccagagcatgcgagccagcatcgcaaagccaggccagacctctcctcctcccttccaagcagcctggatcagagcttgtctgtgctgagggcaagaggaaattagcttgtatttagatctatgaacagggctggaagctgtagtgccatagcaggggagagaggtggaagtagatgtggtagctaaagcagcttctattccaaaccatggagcggcaaggctagactgaagtcccagtaaaggagcaggaccctgactgcagtctgagcatggtaaagacatttctgaaacaaccttgtgatgggacctgcagtttggcatctgtggtttggccagtggtgttcctcttcatatggaagggcagtatagaaaactgacctagcccgccagggttcaatcctggctagttacacattcttggacaggtttctcaacctctctgagcctcaggttcctcatgaggagatggagactataataatatcaaactcagaggactgttgcaaaaattaatttagtcaaaatgcttagaattgtgcctggcacgcagcaacactgtgttacgaatgactattatcattgttacctagagtggtggctttcataactaaaaacatatgatggtttctagagtggacctagacaaagatgacaaacttctcaaatcaacagaatacaaataggtctctgcaggagaaaaaaaaaaacactcaaatcactaaagcaataaatgatcagtttgc

SEQ ID NO: 5420 - DNA, 1121 bp, Homo sapiens
aggaagtgaaaatagatgagtttgtttagtctttatctgggagtcttacctctttatgtacacttatcttcttcaactagactgcaaactctttgatttagctgagtcagggatataattctttttatccctctcagcaggtaatttattgctttccacatagtaaatcataatctgctggttgaacttgttaagtaaggcagtgatgctaagtgattgatacatgtcacaaactggtaatcattttaatcccagtgcaattattaatgtactgtgttcattgatatatataattatatataacattatatattatataatattactctagccatttatatatttctgtattaggtggggtttttttgtttatttgttttagcttatcagttatcattagtgttagtatattttatgcgtggctcaagacaattcttcttcttcagtgtggcccagggaaggcaaaagatttgacacccctgttctagctatgtagaaacacatgctgtactatactactgggctctaagtcaatgcttcataatgtgaaaaagtcctcagtatatttaggtcttcttaataataaatttcattatcttaattgcatgtatgtttcgtttaaccagggatttcttagggtaacagtcactaatgtgtagaagtgaagatggagattgagaaaaaacccagtcatgattatttattgccctttcttttttccttgttctctatgttaacgtattcttatcaaagaaacactaaacaaacttctctttatctcatgtaattctctatagtagttcatatgaattatgtaaggttcaattttaaaacaatagattcttaagatagtatatactctaaagtttgtctagacactaaatgaaaatgagtgctttgacagtttatgtcctaggctaagtcagggtacgaatatgtatctattaattatcttgtctttccagtccaaacaggagctttacagaaatgcactgtatgagtggccattccaattttgtatcttgtgtatgcatcataccctcaagtgacatctaccctcatggcctaattgccaccggtggaaatgaccacaatatatgcattttctcactggacagtcc

SEQ ID NO: 5421 - DNA, 1173 bp, Homo sapiens
tgaattatacatgatacatacctaacaggtgtgcttatgtttattttctgaatattcatattttagctgaattctgtgcttttcagggcattaaagaatatatcttttcatatttctagatattaatgcctgcgaaacatgccttctaattatatgctgccttgatacttgttatggaatttggttattcttattgtcacataacatcacttctgccaatctttatttcattcaaagttccatttagtagacttagaattgtgaattttgtttacttgaaatagaggaagttaaaaaaatacactgagaacattttattaggtctttattcccaccttcttatttccatttattctattctacttaacagtgaatgagttcagtgtaatttcacttgcagtttttctgactgaggcatattctgacaggatcctgttttttgaatgtgtgttttaattgggcttccatgtggtgatagatgcaggactccctgcgagtccctttctggcttctataattctcagcacagatggtttttattacactacttcttcctcccacccttcaccaccccgacaataaatactgatacagccccctaaggtattcattcatgtcttaggcctccaaacagaccagacagcatctcatgattggggagagtgacagtgggaggacaggatcattacaagacagttgagcagacctagccaccacccttgggagtttgaaacagatagtgtgagacaaaaatgaatcagttttcactgtagctgaatttcaattctagtgctccttgaggtttatttcaggttttgttttgttttgaattccccagtgcagcgaatgagatggaaaagaatatataaattaacttcgaaagactctcagggatatatgcatttcaggaggatggatggagaaaatggaagaagctttggactgtcaggggaattcatttatctaatggtcaatggggaaacatttaccctgagaaaagttgtgagacctgactttaggtactttgcatcctacatgctgtgtctctctttattcccagccatatgtatgattctattagggccctcctagtttaattgtctggaagatgtaatgatttcatgagacacctcaatattttattgattcaacaattatttatttatcactctt

SEQ ID NO: 5422 - DNA, 1216 bp, Homo sapiens
tatatatagtatatatatgctatatatagtgtatatatagtgtgtatatatacactatgcgtatatatagtgtgtatatatatattatatacatatatatatatatatactatatatagtgtgtgtctatatgtgtgtatatatgtatgtatatatgtacatatacatatatacacatatatacatatatatgtgtgtatatatatgcatacatatatatttgtatatatacacacatatgtgtgtatatatatactatacatatatgtgtatatatactgtatatgtatatagtatatatacatatatgtgtatatatactatacatatatatgtatatatacatatatactatacatatatgtgtatatatactatatatacacatatgtgtgtgtatatatataacatatatatatacacagacactatatattagggaaataacagtgtgtcaatatgtagatgctcagttgctagatttgaagttgaaaggataaggaataatgtgcaatggactcattttaatttaatttaattttctagtcttgacatgtgactcttgggagttgcttccaaagcagaaaatcagttcaaagggatctgtggacttggatatgctccatggggatgaaaggcatgtgaaggaagaaaagacatgatcataacagacagatgagaactgacataactgcccatgagtctcatgtgcagcttaaatgaaatgacgtgccataaattaaaccctgtgattcctgtaaaaaatctgacatattaagtctgactgaattgaaaaaaaatggatcaaagaaggcatatttctatggcagagagggatgcatgaacttcaggtttttattcttaaattgtgctgttataatattgataataaagatatctgtttccttattagcctaccaaggcctgtaggcctgtgattggagtcttaggggccaaaaatgggtcagagagttgagcataatgggcaagtctgtagtaatttgcatcattgctcaacagccatctacccctctgattgagagaattatagttccccatctcatcagcattcactttagccatgtagcttgttggggctactgaaatatatgtggcctgatattgccacttgtaggaataagctttgagagccatcatctgggtatagccttgttcttttccctctgccatgggaacagtggtgcataagatgggg

SEQ ID NO: 5423 - DNA, 1178 bp, Homo sapiens
tggcttccctagggctggaggacccacttccaagctgggtcactcatatactggctgttactggctgggagctctgctgggacctctccttcatgtggctaagttgggcttcttacagcatggcagctggatcctttgaacaggagcacccccagaggataggccacaatgtgtaagcagttattaaggttctgcttgtattgtacttggtagtgtcccattggcaaaagccagtcactcagccaagtccagtcaatgtggaaggggactatggaagggtaggaattctgaaaggggagaatcaattaggtctactaaagtaattggctaccacagagagaaaggctaagtatacattttctaaaaaattttgcgttctttttttttctttaatcatgtatgctatatcctctctctctaaaatatccaagaagtcatacaggtgaaaagtaaggtctcttgtgaatcaaagccctttggagggtggttaaaatttttgttacaggcctcataatttaggagcaatattattctatgaaagcagaagttttactgtggttaaacgtatggtgaagacagttgttgaaatagtattattttcacatagacagctggagctttgcttgtgaaaagaatgacaaagtaggagtgtctcggggttgtctgaatggtgtaaatgtgtagacattcaaatttgttgtcaagagggaccaaaccatgctcaggaaaatgccactggacgtccagtctgaagtgcagtaagaaagacaagtgggagaaagagcagcaatgcaatattggaaagactagcagtaaggagactgcaggttcaggagagtgggctcagcactgaggctgtgaaaggtgagcgtgtcctgcagctgtcctcagtagactgaaagctccttaaggggaagggctgtgtctggcttgttgactcaacatggaccccactgcgtgacacagagaaggcactcttaagtgtttgatgaatggatacatttaaagaaacgcagaattggaaaccattccctctctttaagattctggtgccataaaataattagagtaaccttttaaaaaatatggcacttcgggcgggcgcggtggctcatgcctgtaatcccagcactttgggaggccgaggcgggtggatcacaaggtcaggagttcgagac

SEQ ID NO: 5424 - DNA, 1279 bp, Homo sapiens
ctgggcaacggcgcgggggcgcacgggtcgggaggagctgcgccgaaaggccttgtgggtgttggtgctagcgcggcttcccggcgctcgtggaatcttctggagcccttttctccactcagcgagcctgagagtgcggaagtctccggctggtggggcatggcccaggagcactgcaagtcctagggttcccaaacctgtggggtggccgcctgggcccgcgagggcgggaagggctcgagtacagtgacccagcgggagctgtgtgtgaacgggaaagctcttggaacagtcttgcccccccccccccccctcttacgggcgcctcttctctttttgggaacgtggcgagcaaaaaatgcttgagccaggtgggtctagtccccagaccaatagcataggccttgggtcttgctgtttttcacgcgtggtccaaggcggcataattaatcaaattgtgaagttgttaaggctttttgtgcaagtccaggcccctagacacatgttatctgccctggacctcgctgattcgtgcagattgagctcagtgtgtctgggactgagctaaacagtgagacgtttggaccgtctttgatgtacagagggccgtggactcctctggtcaggttttcacccagtttggctacagagtagccgcaagagtgtctgactaaaacaatttgtttaattatttgacctcacttttaaatcctacgggtcagggaacctggatgtacaatctgcaacgtaagacctcggacttgaaaatggtaccacgggggcttaatgggaattggggtccgcttctttatccagggacacagcaggtatgtcagtatctagcaccaagaaagatggagtttgccacgctcggtggctcacgtgtgtaatcccagcactttgggacgccagcgtgggctgattgcgtgagctcagaagtttgataccagcccaagcaacatggtgaaaccccgtctcgatttaaaacaaaaacagaactggagatgcagagttgaaaagccccagttagactttagtgagaagccaaacaagtcaacagactgccagagaaaccatgaggtagaagtcagtaggggagagcctcctatattaacctgatagatcagagagaatttctttgggaaagtggcaattgagctgagttttgaaaatgggaggagagcagtggacaaagcacaggggaaggctatactaaggtgtggaagaatatgatgtttttaggaaattgcaactaattggatatagccatagctaaggg

SEQ ID NO: 5425 - DNA, 1565 bp, Homo sapiens
ttaggctgttgcaggatgggttttggtattaaaaagtcagtttgctggatagaacaatggttgttaaagtgcagttttatttaatacaatcatttttaataaagcctgacttctggtcataatccttgaactctagttcagagtgtgctatgcactgtgcctttttagagcctgttctaacctgagattggcagattcacctaaatattacgtgtttacatgtgtttttctggggaaaatgggtccatgatactctaagggagctaatgatgaaatcagattgaacagtgaaagtttcttttgaaggtaaactttcctgagaatggctttctctctcctgataaactgtctttgctggaaaaactcctacccgagaggaaggaagtggaagagactgatgagatggaccaagtagaactggtggactttgatccaaatcaggaaagacggcgccactacaatggagaagcatatgaggatgatgaacatcatcccagaggtggtgttcagtgtcagacctcttaatgggccagtgaataacactcactgctggcatttaatgtgcagtagtgaatgagtgaaggactgtaatcataatatgctcactacttgctcttgtttttgttttaataaactatagtagtgttttaaaaagttaaatgaagaataaacgcaaatataaaagctctgattttgccctgtatgtatgatgacttcagtgtgcaagatgaagtttaatacctgtaaaaactacaaagaagttcccctagcatttctaggccaaaccttgtaattgacttcagctatgtacgtggacaagcttagactgaaatgctaggtatatgtattggcttcagtgtatgacccttcattgttaagctatgaaagtaaaactctgtatttaactggcaatgaggaaaaaaaaattttgtagagaagtgttggtctgtatagttctttatattaagtgggattcattgtaatgcctctgcatttattctgttgcctcagctgttacttgaagatggcgtaatatataatttatcctgtggtatcagtgataaaaatgatacctttctgtaggaggggtttatcataatatgctgcttcttgaaggcttgcacttccagaattgtgtttccttctgctgtgccattcatatatatatacatatatatatataatcttgaccagtcctggtcatttgctcccctccttgtctgtggaccatgataagcccaagtagtgacttcagagctgggtaacagaaattaaagtgaaaagacctttacgtggagaatttgcatgcgtaatataggaaggtgttctttaggtatgttacaggattactttaaaccatttgactttcgctccaaagttatgttggtagtatagcaaattatgatgaatagctttaattgtatgtttaaaagtctcatatgttcacatgcttaaatctgggtatcagaatttaagcaattcttgaaatgtattgtctccttaatatactaattacaaagcatctccaatgtgtgtcactacaggcttttttttcccagatcatc

SEQ ID NO: 5426 - DNA, 1173 bp, Homo sapiens
acctttttacaagtgttttatgtaaaacctgacataaagtatgaaacctgtgcttcttgggttgaagtgaggatgggaaatccagatgtcaactcctccaccactactaccagcttagcttgtctatctcctgtaacatcaccagaggacccgcaggagcctcacagtgaatggtgttcagccacggccttatggaccagatagtgttctcttaatttagaggttgcttcactctgatgctgttcttggaatgtgctgcagaggcactatgagatattaatagtttaacaaggcttttttaatttcttcctatggtaaagctcttaggcgggtcttagagctgctgtatgaactatactcatttctgcataggtctgatcagtactctatttggcctcccagattacaggcatgagcgactgtgccaggcccgcattttgtattttcttatagattatttgtgacattttaagaacccatacatgttactaacgttttgtttttgaaattttctcttcaagtatgctattgcggcagcacctcccgagatgtgttatgtggaaccgatgtaggaaagtctgatggatttggggatttcagctgtttaaagatatgtggcaagtaaggttttacgttttcttcagttgaactaaagctgcactttatgcaacaattatgtaatagtgtgttttcttaacagggacttgaaatgcggtaaccatacatgttcgcaagtgtgccaccctcagccctgccagcaatgcccacggctcccccagctggtgcgctgttgcccctgtggccaaactcctctcagccaattgctagaacttggaagtagtagtcggaaaacatgcatggaccctgtgccttcatgtggaaaagtgtgcggcaagcctctgccttgtggttccttaggtaactagtaagcgtaaagttggctttaaaaatattattgtaaatggttggcagcagtgagtgtttaagcaatgtagaagtaagtgctagttacaatatcagaggtttctaaatattatgatcatatttatgtaggtacgttttctttcctcctcaacatatacttgtgaaaacccatacatttgcccaaatgatctctctgattcaggtattttattgttaactctggacaactgtggtgagttactgttccat

SEQ ID NO: 5427 - DNA, 1102 bp, Homo sapiens
ttatctattcttattctggcagttatccctgtgcttcacacatgcaaacaacaaagcatgacattccgcccactaagtcaatacctgttctgattcttaagtcgccgacctattggcccttacatgaatcggaggacagccagttgacgaggtgattctggctataattgatccactgctttaaactcccttgatattaacagtgtatttcccctcctaaaaagtcaaagtttacttcaaaattgtacccagtgggttgaaagcatttggtgtagtacagggtatctgtcagatgctttcaggcaggtactgaagtttggagagctgagtcataagtaatattgattatttaaggccaattataaatctgtcttaaaaaaagacttaccgtaaaccatttctgtgtcaacctcccttcaggaaacaagtttcagccactaaggccgaagcagaaaaggatggagtgaaggtccccacaaccctggcggaatactgcatcaaaactaaagtgccttccaatgacaacagctcagatttgctttacgacgacttgtatgatgacgacattgatgatgaagatgaggaggaggaagatgccgactgttatgatgatgatgattctgggaatgaggagtcgtgacgtgctccttcagtgcccctgtactgccctgccatctcaggccaaagggaggggagcaagtggggacctggccatggcccctcagcaaaaacctattcacagcgggtggggaaacacacacagctcctgctgactccccttatggatctcagtttgctcctttttatggacctttaatggagagagagtaaccctccacagaatgtctgaattcttgcattctttacccttccatcactatattgattctttttttaaaaaatatgaacccaaactcccgcctcacttcgtctctacagaatgttcacagcaaaacacgtttggtctgtttttagattcttgaagaattcaatagtctttcaagatgtttaatgtgtttaaagctgggaacctgttgggagttcacaagtgctgcatatactgggtagcaaaagaaaatggaaaaaaacccacaaaacaaac

SEQ ID NO: 5428 - DNA, 1100 bp, Homo sapiens
ccttgtcttcacaaattcgcaacacaacaatcagatggcaccagggactggcagctccactgccgtcaactcctgttctcctcagagcctggtaactcacttttatttcagtgtgggattttaagaaatatacccattagcaaatgtattctagaatatgatacatgctttataattactttctaaatataaaaatatctacagtaaggccgggcatgatggctcatgcctgtaatcccagcactttgggagctggggcatgaggattacttgaacccaggagtttgaaaccagactgggcaaaactctgtctctacgaaaaaagcaaactaacaaaaattagctgagtgtggtgttgtgtgcctgtagtctcagttacttgggaggctgaggttggagggtcacttgtgcccaggagtttgaggttgcagtgagccatgatcatgcctctgtactccaggctgggtgacagagcgagaccctgtctctaaaacaaaacatcaaaaaattctacagtagatcttagtccagaaaacaatgatgtggtaatttccaagcacatatctgatgattccatgtggaatttaactacctgagtttcctggacaaagataaaaatttttttatggtttgtcaaattctttgaactgatgatcactcttgagattgaaagtacccctttcttctgaatgatgttttccttgtgttttgtttcatattatgtctctatagttagtatattcaatttcttgttttccaattaaatgcgaaagtttatcagaattgacttgctataaaatcatgtaaaaacagtctgagtctgcctaggcgcttacattttttgcttttttttccccctaagaccgtaaaataagctacattttcttaaaatgccaaatgattaacagaggcccttatagtttggatgtgtttttattgaaacagtgtcatttagtactgtatgactgacttccaatgtgtgttaagctcccatccagaaggaacttcagaaactgttagtgaaggctgtgaagataggcttatggaagtataagcttagatcatagcttatacaagaatgttgctttagaatggtgaac

SEQ ID NO: 5429 - DNA, 1100 bp, Homo sapiens; identical to SEQ ID NO: 5428

SEQ ID NO: 5430 - DNA, 1174 bp, Homo sapiens
gccctggtttgagtgtttcactgtgttgtttaccattagtctcatcattttcctgatttgaagtcattcttgtaggcctttcaatctaaaattaccttcacttgcagccgggcgccatggcttatacttgtaatcccaacactttgggaggtcaaggtgggtgcatcacttgaggccaggaattggagattatcctgggcaacatggcaaaaccctgtttctactaaaaatacaaaaattagctcggtgtggtggcgcatgctggtgcgtgcctggaggcccagctactcaggaggctgaggcgagatgatcgcttgaacccaggaggcacagattgcagtgagccgagatcacgtcactgcactccttcctgggcaacagcgccagaccctgtctcaaaaaaaaaaaaaaaaaaattgcattcacttgaaaattacttgtcatggtcacttgtatatttcattttctttagaatagctgttatgcgaagtgtaagagactactgatgactacaaatgatcaggaagtcagtgttttgggtttagtagtatgtagaataagattaaatttttcaactttccatacagctttctgaaacaaaggtcttcactgcctcatctgctccagcagagaatcacatcttacctgggcaaaggtaaatactttttgccatcttatatttgttattcaaagcattacagaaatcttttgcctcaggaaaagtattttcatttttgggtctctttctattttttccctttttatccaaggctaacttttattttaccactacttggtaaatctgacagagcttcaatcattttctaattgatgtatccactgatgaatttgttagcagttgttgcagacatcatgttaaactttttttttttttttttctattttgagacgtagttttgctcttgttgcccaggctagagtgcagtggcgctatctcggctcactgcaacctccgcctctcgggttcaagtgattctcctgcctcaagcctcccaggtagctgggattacaggcatgcgcccccacgcccagctaattttgtatttttagtagagacagtttttccatgttggtcaggctggtctcgaattcccaacctcaggtgatccgcccacctcagcctccgaaagtgctgggattacagatgtgagcc

SEQ ID NO: 5431 - DNA, 1200 bp, Homo sapiens
tactgactccagaacttaaagcagcagacttgatatgagcaagagtaatgttgaactttgctggagacctattaggaagccatgtagtagagctaatattttattaaaaggatgcttctctaaatttgataattcagtaatccacctgaaatagggtccaagacagatttgccttaaaatgaaatttgttgttttgaagactatatcggaagaaatcaaaccattgttaaatgtctatatttgtgctacatccatacttttcttactcatggcagaattgcttggatgtgacctatattgaagcaaaatccatttgaaacactgatttgaggttatgtagatagtgactactagtcaagttgcatttgtaaacattatttcaaagagaaggggagaaaagaaatattactgattttaccgagaatagattaagaacgtcatgtttcttgggttgtaaactaaattgctagtgaggcgtatgtatcttttttccccgcatagtacacaaaaaggaatcatttggactgagactgtatttgactttgtggtataaactttgattgctgttgtttcccaacaggggcttggaagaattctgtggaagagtggacaacagaagactggactgaagatgtaagtgtttgctgtcagatgagacctttctttttttttttttttgaaatggaatttcacttttgttgcccaggctggaatgcaatggcgtgatcttggctcattgcaacctctgcctcccagattcaagcagttcttctgcctcagcctcccaaatagctgggattacagatgtgcgccaccatgcctggctaattttgtattttttttttagtagagacgatgtttcaccattttggtcagggtggtctcaaactcctgacctcaggtgatacacccgcctcaacctcccaaagtgctgggattataggcgtgagacactgcgcctggccgatacctgtctttctttcggtgtttggtggggactttggtgcttggaagaaagagcctgagacatcttatctcatcttggcttcttttctggcatgtatcgtagccagggtttttgagggttggcttttttagcagatgcttcttaaaaggaacttagattttcagatttttaagaatatttgtttttgtgcttaaaaatgaccaattgtcaagatgattgggagattggaaaaa

SEQ ID NO: 5432 - DNA, 1082 bp, Homo sapiens
ttgttgataagagagttatgagtccaggactcagccttataggctcagaaacccaactgttgacagtataataaccacaaatctattcctgatatgagggaccctcaaattaaccaaactagaaagacttgtgtatactcagaaggctaatttataaattttctaaaaactggtacctgttgaacagattagaatactctctttgatgagtgagaagggagcttggtaaacatgggcgtgagaatgagaataattgaagtgatttgagtgtccaagagccatcaaggataagattcataacttgatttgcagtgacctgtaagagtatggatttcaattacatttcactatccttgggcagtaacgcagcatatacatagctttgacagtgaccatcttctctgtgatgaatactttcattcttttcatatgtttaaaccctcaattttacattggtccacagaactggcatcaaatactcacaacatagctcaggatctgtcaaacaaaagttcttatggactcaaaggtatgaatacttaattttttaatttttaaaattaagaatcttataaattgcttgcaatatctttcattttttatcaaagctagctaataaaaatttatcagataaatgtttgtaaactatacctatttatttggtaatcagatttgcagtttgctaatggaaatgttttattgattgactttcaaggtgccacagaattttcatcattattttccatgttcctaagtggccttaacatacattcgttagaggactaacaccaagttaaattgaacataaaacattcatctccaatatattgttttaagctgaaaataaggattgttgaagtttttccgttatattttgtggtgtaggtctaatgaccaaattaaaattttaatattccaaaatatgattaggacctgagcctttgccttctgtatttaatgtctggaattttttatagtctgtgtgggtatggctagttcctgcaacaacgtggcacttgcttctcacatgggagtttcccctgtaatttcctgacttaccactctatcatgttgcatctctg

SEQ ID NO: 5433 - DNA, 1187 bp, Homo sapiens
tgagctagagtctcactctgttgcccaggctgcagtgcagtggcttgatctcggctaacggcaactgtgcctcctgggttcaagtgattctcctgcctcagcctccagagtagctgggactacacttgtacatcaccacacccggctaattttagtagttttagtagagaggggtttcaccatgttggccaggttagtcagttttgaattcctgacctcaggtgatctgcccacctcagcttcccaaactgcccggattataggtgtgagcccctgggcctgaccgtgaacctcaatttaaaaaaaaaaaaaatacattgtgagatttacggaaaagttgcaatgggaatatgaataattactgaatacccttttttcagattccccagattttaacatttctgtcacatctactttatcctgttctcttcctttccctacagtttattcccagaaacgtttgacaagtagttgtgaataaggttcttcttcacttaatacctcagtgttttttaaaaaacaaggatctttttacataattacagtacaattataaaaaatcagaacatctacagaccatacttatattttttcaatggtcctcataatgcctttttttttttttgagacagttttactttgatgcccaggctgtagtgcagtggtgcgatctcagctcactgcaacctccgcctcctgggttcaagtgattctcctgcctcagcctcccgagtagctgggattataggcatgcgccaccatgcctggcaaatttttatattttcagtagaaacgaggtttcgccatgttggccaggctgctctcgaactcctgaccttaggtgatccgcctgccttgacctcccaaagtgctgggattacaagcatgagccactgggcccagctgtaatgtcctttttagctaattagattgtggaatatacattgtattcagatgtcaactctcttgtgaatttatgtgaaaattccacaaaattatgtgaacattccacaattatgaagtgattataagaatatttgaaaattatgatataaaatgtcttagaaaaggtatacttcctgatcaactgaaaaaaatatgtaaagttaatgcaaaactgttgaacattaatgagtacaggcttagtagactgttaatgtttatctttggtggtgggcataaataat

SEQ ID NO: 5434 - DNA, 1171 bp, Homo sapiens
gcctcggcctcgtgaattgctgggattacaggcgtgagccaccgcacccggccacacaattgtttctttaagatttattatttacagctgacttttgcttttaggcatagcctgtttcttgacacattttaaattgggctattggcaggtaaaatcttggctgggtgcaatgttgttttggggttcaaatagcaactgcaagtagtaagaggcagatagcacttcatgtacagtgactacatgtagtgataaaatggttgctggttaaaattggtggtacttgagatttttgtttagaattgctaagctcgtaaaccatagacttagattgcagtagtcgaattggtttaacagataccagcaaaatgtaaaatcctcaagggctacttcttgagaatttgtattccagagagcttttatcttttattgtaagtgtccttgttttctctgaagtacatgcttatcttttactatgattgttttgcttaccatccctactttcttgcagattttctattttgtacatacattattttgtatatactgtatatgatgacttcagtgagcagtgaccattgtcgaggtgctcgggaaaaaccacagatttcagcagcacaatcaacgcaaccacagaaacaagtggtacaggtaagtttttgtggaactctttttttttttttccttttttttcttttattattatacttgaagttttagggtatgtggaactcttgtttgccttgtttagaattaaggaaattaagggagagcatatgatttaatgttttcctttgtaggaaactttaggattttggaccctttgtttaaacagtaggtgatggccgggtgcggtggctcacgcctgtaatcccagcactttgggaggccgaggtgggtggatcacttgaggtcaggagtttgagactagcctggccaacattgtgaaaccctgcctctattaagaaaatacaaaaattagctgggcgtggtggtgtgcgcctgtaatcctagcttctcgggaggctaaggcaggagaatcgcttgaactcaggaggcagaggttgcagtgagcccagatcacgccactgccctccagcctgggtgacaaagcgagactccttcctaaaaaaaaaaataaaataaataaaaaataaaaagtaggtaatgaaga

SEQ ID NO: 5435 - DNA, 1221 bp, Homo sapiens
acggaaagcggactaagctggcttgaaggactaataccattggatgccgcccgccatgtggcggagcgtggtgcctgctgggaggtgtagtcctggcggggggtggggttccgctcccacgttcctgggctcgctctgcgccctgccccctgcgcgggaaaacgccaacggctagcagcgagagcctcggcaaggcggaaggtgcgcccacttttagtctttttcagtgcggttttacttttgccctcccaagccccttctgggtgaaaagactagaatctactgaacgcctactccaagtcagccgtttatttctgttatatcatataatcaactccttgagtccaggattttccctatttaaggatttaaaaaaagaaccttagagttgtttgttgaccgaagagacccaggttttctgtctttagaaaattaatgacctcctctcaataggatctgacctgttgtcaactccaagaattacgaataaataagatgatggtttataattgtagcatggtgttttaaagtattttccatttactggcctgtttggatgtgagggcgttctggctatcttgtcaccccatagatcgccagggctgattcggctgatctggctgtctaggcgggtggccccttcctcccgcacctctccatgtgcgtccctcccgaagctgcatattcggtcgaaaaggaggagcatcccccatagaagaggacaagtcaaggatataggagtagctgcacgcccgtgttaacaagctctcaaggtcctctaaacaagctctcaaggtctacttactggcctgttttatcccaagctagttacatacaaggactttgcagtcccggcatgccttatctcaattggagctttcctctgtaataacacttcaccggcttgtgaaaattaaatgagattatgtaaaatgcctgcttgacacataataaaccctcagtaagtatcagtaatcattttcacactctacccatcgggcccaaaaggtctaagtaaggtagaaaggggaaattagcttatactgaactttgtacagggcactatgctaattactaatttgctagttattaagtaaaacaattgacatcttaaacagccctatctagttcaaataaagcctttgttattcatctgaattaaagaatgctgccgggcgtggtggctcacacctgtaatctcagcactttgggagccggagg

SEQ ID NO: 5436 - DNA, 1220 bp, Homo sapiens
tggaggaattacttttcagacattgacttcttccccaatgctgtttacacccactgctacgactcgtctggaacgaaactctttgtggcaggaggtcccctcccttcagggctccatggaaactatgctgggctctggagttaatgacaactccccaaatgcagagatttacactaacttccattctcagtttccttgtttcttttgattttttttttcctaattgtgtgaggctcttgtgttttagtgggaacaccaaagtttgcctatagtttaggcacttaataggaagaagctctgtacagaaatctgaaagttgttttgctttttgttttcccctttggtaatcaaaattttactatcttttattatttctggcttttcaaccaaacattgttgctaatccctatttttctttaagtgacacacattctcctgtctctggcttcttcaggctgaaatgacatagctcacccttacttcactcttgagaggtagggctcctttataattacatggttgctctcagactttctgtgaaagtttgggagctgtgtgtgtctgtgtgtgtgtgagagagagatcttgtctgcgtgtgtgtgtgtgatcttgtgtgcctgtaggtactgtgtgtcactgaaattacctggagtgaggattacttgtaattaaaatatttataaaagaaacaactttattcacagagtccagctttgggactagtctgtatcttgttttttaagtctaacaacactgataataggaagtaaaaacagaaaggaaaagaaattaccactgggaaaatctttttagttagattgtaggcttcctggggcctcccatgccaggactgcaaagtgatccagccctacctgtcttcccacctgtgtgtcccccgtgtgggaagttggtgtcacttccccttcccaccctcacatctgcttagccagtagccacacccctaaaacatcagactcaccatccaggtgcagctccagaggctacaaaaggcttcatgggacttgaatccccatcctagcttctctctccttcccctcaagacctgatctggttttaaggggcctggagctgggagtctcaagtctgctaagattcacatccatagcccccatggctttgaggagaatcctctctgccattcttccaatctccccagtgggttttgctattattttctaaattgggttaagtctaagaag

SEQ ID NO: 5437 - DNA, 1162 bp, Homo sapiens
aagtcacagaaaaattagctgggattggtggttcatgcctgtagtcccaggtacacgagaggctgaggtaggaggatcacctgagctcaggaagtcgaggctgcagtgagctgagatcatgcccctgcactccagcctgggcaacagagcaagatcctacctcaaaagaaataatctcgggcgggtgctgtgggtcatgcctgtaatcctggcacttggggaggcccaggcaggtggatcacctgaggtcaggatttcaagaccagtctggccaacacggtgaaaccccgtctctactaaaaagacaaaaattagctgggcgtggtggcaggtgcctgtaatcccagctactcaggaggctgaggcaggagaattgcttgaacctgggaggcggtggtggcagtaagcctagatcatgccactgcactccagcctggctgacagaacgcatctctgtctcaaaaaaagaaaaacaaacaaacaaacacattcagttctcacacttgaattaggtaggtaggttgtgttatgcgtgctttttatgtattgaggaaacaggatcacagaggttgtgtaacttaactaaggttacaactaggtagactgaatttgaactgaaatctgtccaacctcaatgcctatgctgcattcttttatgccattttgcccctcttaggtggtcacaggaccattccaattcctataaggtataagcactagttttaaagtaataccattgtgaactgcttgttctcattgaaataatagtgtaactggaatgataaatagttcattaaaattttagtcacattatgtcatcagaattctaggaggaaatgaatacctgattattttgtacttcacaaaataaactggataaactggataaatgactgaaagtttcttttttatattgctgagtcagattggatccggttcattaagggccaaaatttgtatttggcagtaatcctcatgtgttctcagaatgcttgattggtcattatcagttgcttaatgcttaccaaacacttccagtgttttgagtcactgaattggctcatggtaattgttaatcttgtggttactgagtcaagagccagcagtgtgtgttttggctgcttcacttcctcctcaacacttgatattgtcagattttaaa

SEQ ID NO: 5438 - DNA, 1202 bp, Homo sapiens
tttggcatttttagtagagatggggtttcaccatgttgcacaggctggtctcaatctcctggactcaagcaatcctctcaccttgacctcccgaagtgctgggattacaggcatgagccaccatgtccggccataatattctttttttttttttttttttttttgagacggagttttgctcttgtcgcccacgctggagtgcaatggctcgatctgggttcactgcaacctctgcttcccaggttcatgtgattctcctgcctcaacctcctgagtggctgggattacaggctcctgccaccatgcccacctaatttttgtatttttagtagagacggggtttcaccatgttgtccaagctagtctcgaattcctgacctcaagtgatccaccagccttggcctcccaaagtgctgggattagaggcatgatgcactgcgtcccgctcagttttttaaagcatacaattcattgtttctcagtcttttggctaagatcaaatgtagtatcttttttttttttaagaccagtggttcagaatagaaagtgtagtatcttttctcagcagtttaacatgttctattcaaggacaacctattaaatggatttttggaacagggagatggagtaggagcttgctctgtccgctccatgcattgacttggtagtgcaagacctccaggaatggtgcatcctccctgagggattttttttttaagtatacaattcagtgattttttaaaagtatattcatgaagttatgcaaccattgtcactatctaattgcagaaaactttcatcaccccaaaatgaaactccattagcagttactccctatttctcctgcccccagtgcctggcaaccactaatttctatctctgtggatttgccaattctgtccgtatcatataaacagaattatacaatatgcaaccttttgtctggcttctttcacttagtttattttcagagttcattcatgttgcagcatgtatcaggacttcattcctttttgtggctgaataatattacattgtatggatacctcattttatttatccattcatcagttgatagacatttgggttgtttccacttttggtcattatgaataatgttgctgtgaacattcatgtacaaaggtttttgtgtggacaagtgtgttccattttcttgggtgtatgcctaggagtgaaatcgc

SEQ ID NO: 5439 - DNA, 1369 bp, Homo sapiens
agacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttccatctttttgtgtgtctgagcagccggaaaaagcctctgacccctggggacctcaggaagatctctctcttgctgtgtgattcatggtagattttttttttttttttttaagagatggggtctcctctgttgcccaggctggagtgcagtggcacagtgacatgatcatagctccctgcagccttgaactcatggtcccaaacaattttcctgccttagccttatgagtagctgggaccttatgagtagcaaatgccaccatgcctggttagctttttaaattttttttagaaatggggtcttgctatgttgccccggctgatctccagctcctggcctcaagtgatccttcctcagtctccagagtagctgagataacagaaacaagccaccatgcctgacaagacagtggcttttgactagtagggactatatacttgagtgtgccttagaatcacctaagacactctttgagtcagtaactcagactactgagctccattgccagagatcaacatgttcaataagatttcttccaacaca

SEQ ID NO: 5440 - DNA, 1164 bp, Homo sapiens
gctgaccatcatccccatgttaccaccttttcctatgcatctcacaggccccattcttgggaatctcccctgcccactctcagccctacctctcagtctgcatagagatggctattctgctggctccgattctcatgactctcccctccattcaggggcctagtcttgcattcctgttctcttgggttttcttaccagtgacacctcagccttctgaggacttatttcttggtaggagctgctgcttttctgggcatgttccatgtgttgactccctacatactccaggactagcttaggtcccaacccaatagttcccagccttctgaggacccatgactcctctttccagggtttgaacatcctcatccctgtgttagaccggatccgatatgtgcagagtctcaaggaaattgtcatcaacgtgcctgagcagtcggctgtgactctcggtgaggggttcagggtgacatgggtgctctgaggctattaggatgtggttgctgtagatccagagcttagtagaaagaactggttgggacctagaggcctgactttccccgttttctctcctggttctacagacaatgtaactctgcaaatcgatggagtcctttacctgcgcatcatggacccttacaaggtacctgtcccctactttatccagccttttgagttgccctcttcactaaaatcttgtgcccaagcttcttacactatccgtgtccatctcaggcaagctacggtgtggaggaccctgagtatgccgtcacccagctagctcaaacaaccatgagatcagagctcggcaaactctctctggacaaagtcttccgggtaagcagatctgagccagagttagggtttgaagacacaaacctgacactcttaatcttttctgaaggtcaagatcagtcccaggcccttctcagtgtaggcccttgataggtaggttgaggctgtggggcttacacctctttttccaggaacgggagtccctgaatgccagcattgtggatgccatcaaccaagctgctgactgctggggtatccgctgcctccgttatgagatcaaggatatccatgtgccaccccgggtgaaagagtctatgcagatgcaggtgggggccaaggaggggtgggaaaagggcctcagggtgctcc

SEQ ID NO: 5441 - DNA, 1359 bp, Homo sapiens
atctgaggtaggcattcgggtaaggccctgcgagggaggaataggcactggggtaagccctgcaaggaagtagtaggggtgtggcagggtagaagagggtaagaaaagcagcctagccaggcttacctcctgtgaatacagctggaccttgaagctgcagacagtctgaaggagctgcaggtgaaactgaatacggttctggatgagctcagcatggtgtttggaaacaggtcagtgaccccacaatacaaggccctcagagccagatgtggtccctagccaatcccagagcccttgccccacacctctccatatagctgcaggtgtgtggatcttccctgtactcctgctgactgtccctgctggaaatgcaccatgagcatatgggaatgggaccaaatagctggtgccgctccagggacagtgtgtgtttggggagggaaaggctacactgcgggcacatgtgtagtttccaggtacggattgatgagtgtgttcgacaaatggccgacatcctgggccaggttcggggcacagggaatgcatctccagacgccagggcctcagcggctcaggatgcagatagcgtactccggcctctcatggacttcctggatggcaagtgagtacagcattcaggactatcctgtggggatgagcaaagcagatgctatcgggcaagggagccccttggggagaggggttctcaaactctcaccctggtctcacctgttgcctggacttgcagcctcaccctctttgccactgtgtgtgagaagacggttctgaagcgtgtactgaaggagctctggcgcgtggtgatgaacacaatggagaggatgattgttctgcccccactcactgaccagacggtaaggacacctccttccacttcctcctgctgtctcccttcccctcactccctgcttcctgatggagttggggtcctctgcttttgactgattccctctctgcccagggcacccagctgatcttcactgctgccaaggagctgagccatctttccaaactcaaggtactctgggtgtggggtcctcctggcaggtgtggtccttctgaagtcatggagagagggtggctgcggggaaggaaattggagctttggagactgaagaggaaaaggaggagatgaatatgcactgggggctggcaggtgggtgcaagactttcatgactgctgtgagctgtcctgatgctgctgatttctctgaacaggatcacatggtacgagaggaaacacggaatctcactccaaagcagtgtgcagtccttgacctcgccctggacaccatcaaggtggaggccccccctttttcagacagtcttaaccaccacact

SEQ ID NO: 5442 - DNA, 1077 bp, Homo sapiens
tcagatgaatccccaaggaaccctggatgctccggctcaggggaccagcactgccgctgcagtagcacatccagtcagtccgaggcagctgaccagtccatgggctatgtgagcgactcctcctgcaacagttcagatggtgtgctggtcaccttcagcaccctctacaacaagatgcatggcaccccccgtgccaatctcaactctgccccacagtcctgcagcgactcttccttctgcagccactcagaccctggcgccttctatctggatctgcagccctccccatttgagtctaagatgtcttatgagtcccatcaccctgaaagtggaggaagggaagggggctatggttgccctcatgcctcttctcctgagcttgatgccaactgcaactcctaccgcccacactgtgagccgtgcccagcagtggctgacctcacagcctgcttccaaagccaggcccgtcttgttgtggccacacaaaattactataaacttgtcacctgtgacctatcttcccaatcatccccaagccctgctggctcttccatcactagctgctctgaggaacacaccaagataagtcccccaccaggccctggcccagacccaggccccagccagccctctgagtattacctattccagaagccagaagtccagccagaggaacaagaagcagtgagttcctccacccaagcagcagctgctgtgggccccactgtgcttgagggacaagtatacacgaatacttcaccccccaacctcagcactggacgtcagcgctcccgcagctatgatcgcagcctgcagcgcagccctcctgtccgcctgggctcgctggaacgtatgttgagttgcccagtgcgcttgagtgagggccctgcagccatggccgggcctggctccccacccaggagggtcacctcctttgccgagctggccaagggccggaagaaaactggaggctctggctcgcccccacttcgtgtgagtgttggggactcctcccaggagttctcacccatccaagaagcccagcaagatcggggggccccactggatgagggcact

SEQ ID NO: 5443 - DNA, 1386 bp, Homo sapiens
ggctgcgttccctgcggagggaggatacaggcgagtcagccgagctggggcctgggacccgtgcgcagtcccagccctcctccagcagccctagctggtacctgggtgtgcccggaggtcgggattggcgcggtctcctaggaccccggacagcgcagacacaagcagcagccccaccacacccaagagcgaaactgcgcccgccattgccggcccacgggtggagggatcgggcgggcggtgccgaagcggtccggcattggccggccgccccaacgcgcacgcgcacgcgagcaggccggccggctccggggaggccacgcccactccccgtagggcggggccagaccatatttgcataagatagtgtcattctagctttcctgtatttgttcatttcgtgtctattagctattctgctagccacaatgcctctgaaagcctatagtcttagaaagttatgcccgaaaacggtttttttaatctcacgccaccaactttctcaccctaatcataaaacacaatttctttagggctataaaatactactctgtgaagctgaggacgtggttcgtgctgaaggcctgtatcctaggctacacactgaggactctgttcctcccctttccgcctaggggaaagtccccggacctcgggcagagagtgccacgtgcatacgcacgtagacattccccgcttcccactccaaagtccgccaagaagcgtatcccgctgagcggcgtggcgcgggggcgtcatccgtcagctccctctagttacgcaggcagtgcgtgtccgcgcaccaaccacacggggctcattctcagcgcggctgttttttgttcccgagaccacggctcactgcagcctcgacctccccgggctcacgcgatgcctcacctcaggctcccaagtagttgggaccgcaggcgcacgccatcatgcctggctaatttttgtattttttgtagagacggattttcacctgttgcccaggctggtctcgaacgcctggtgtcaagcgatcagtccacctcgccctcccaaagtgctgggattacaggcgtgacaccgcgcccggtcaacgcggctgcttttcatgcgcgggcagctttacgctgttcttggccttgctatgaagtccttgtgctcattactccaaatatggagcattcctgaaacagcctcctcttctacctccctctccctttggcaaacgccatagtagccaccattcactgtgtagctggtacacaacatatggactctgcttgggctagaatcctgcctcctgtactcaagagcggtgaccttgtgaaacttagttctctctccgtgccttcctttccactctgaggaatgaagataagcacttacttcaagagc

SEQ ID NO: 5444 - DNA, 2201 bp, Homo sapiens
cagttattctctgaagccttctaccaaatcccctctgcctgagcccaagctctttctattcagactgaccacctagcctctccccaaatcctgtaagtcccaggaaggagacctggacttcacttcctataccccctatgactgcatcccaagtcctgagagcctctctgtcacttctaggcgctagatggggccttcacagaggagaaccgtgcccagtgccgagcagcaacagcccctctgctggaggctgtggacaatctgagtgcctttgcgtccaaccctgagttctccagcattcctgcccagatcagccctgaggtgaggcgatgtgaagggggaactgatgggccagcttatcacctcatcttccagggactcctgagacttaccttcctgcctcccctctccccagggtcgggctgccatggagcccattgtgatctctgccaagacaatgttagagagtgccgggggactcatccagacagcccgggccctcgcagtcaatccccgggaccccccgagctggtcggtgctggccggccactcccgtactgtctcagactccatcaagaagctaattacaagcatgaggtattgagggatggggaaccagtgtggctggggggcatacattgtggcagaatggaggatgggcacttgagtgcaatgagatgggatggtgttgggaggatacaggggaaggataggctggccttgcagtaggggatgttcttggtgttggagcccatgatgtgtctgcagggacaaggctccagggcagctggagtgtgaaacggccattgcagctctgaacagttgtctacgggacctagaccaggcttccctcgctgcagtcagccagcagcttgctccccgtgagggaatctctcaagaggtgagagggagagggttatatggaaagatgtgtctaggaagagaaatatcagactcaaagaagctgggggatcaaggagtggcttcttagggacatcaaaggctgggatgtgcgaaggagggttagggtatttggtatggacagaagagcagttctttgtagccagagggtcctattgcaggtcaccatcagggctaatgtccacttcctccccaggccttgcacactcagatgctcactgcagtccaagagatctcccatctcattgagccgctggccaatgctgcccgggctgaagcctcccagctgggacacaaggtacctatggagactcatgggaagtcccagggagtagggtgagagagaggggacctgacccctagtccaaccccttgcctcaggtgtcccagatggcgcagtactttgagccgctcaccctggctgcagtgggtgctgcctccaagaccctgagccacccgcagcagatggcactcctggaccagactaaaacattggcagagtctgccctgcagttgctatacactgccaaggaggctggtggtaacccaaaggtattgagggttgggagggaggagctgttactagcaggaggctggagaaacaggaacaacagagctcctctcctctccccacagcaagcagctcacacccaggaagccctggaggaggctgtgcagatgatgaccgaggccgtagaggacctgacaacaaccctcaacgaggcagccagtgctgctggggtcgtgggtggcatggtggactccatcacccaggccatcaaccaggttagagtcttggggtgcctttggacactgaggctaccctgggccagagcctccaagcacagtggcagagaccctaacagtctttccctttccctatcctcccccctcagctagatgaaggaccaatgggtgaaccagaaggttccttcgtggattaccaaacaactatggtgcggacagccaaggccattgcagtgaccgttcaggagatggtgagtttgggcgagtcccagaggactgccctcggagagctgactttggatataacttcactcgttccattatcaccaggttaccaagtcaaacaccagcccagaggagctgggccctcttgctaaccagctgaccagtgactatggccgtctggcctcggaggccaagcctgcagcggtggctgctgaaaatgaagaggtaaacgtggaggcaactctgccctgccccctgccccttgttcctgatgtgtcagtgtctagggctgtcccacccccaccctc

SEQ ID NO: 5445 - DNA, 1175 bp, Homo sapiens
gcaccaccacgcctggctaatttttgtatttttagtagagatggggtttcgccatgttgcccaggctggtcttgaactcctgacctcaggtgatccacctgcctcagcctcccaacgtgctaggattataggtgggagccatcgcacccagcccaaaacatttatttaaattgccacctgtccccaagtaccttctcaggttccttctcctcaccttctcctttctcaagcccaattcttcccccttcatccttagatggagaagtgtacccaggacctgggcaacagcaccaaagccgtgagctcagccatcgcccagctactgggagaggttgcccagggcaatgagaattatgcaggtatgtgggcagagagccaggcatggggcatattgtgagggaggtaggaaaatgggagctggatgagggatgggactgacagacgaaaccactggaatcagggcctggcaatgaaagcaccttcccttccctctttctcctcatctcccaaggtattgcagctcgggatgtggcaggtgggctgcggtcactggcccaggccgctaggggagtcgctgcactgacgtcagatcctgcagtgcaggccattgtacttgatacggccagtgatgtgctggacaaggccagcagcctcattgaggaggcgaaaaaggcagctggccatccaggggaccctgagagccagcagcggcttgcccaggtcagatactgggaaagggccactccctctcccccaggttccttcataaggcccaccctgattgaggccaaagcttctgagcctcgtccacactcacagagtgatgtcttcttgggtctgctcttgacagcccctctgtggattccacccttatgttctcttagtcttttttttttttttttttttgagacagagttttgctcttactgcccaggctggagtgcaatggcgcaatttcggctcagtgcagtctccgcctcctgggttcaagtgattctcctgcctcagactccctagtagctgggactacaggcatgcgccaccacacccagctaatttttgaattttgttttagtagagacagggcttcaccatgttggccaggatggtctcgatctcttgacctcgtgatctgcccccctcggcctcccatagtgctgggattacaggcgtga

SEQ ID NO: 5446 - DNA, 1166 bp, Homo sapiens
ccaagtcccctcctctcccacagatgatgaaccatggctccgcgtcaatgcatatttaatccatgatactgctgattggaaggacctgaacctgaagtttgtgctgcaggtttatcgggactattacctcacgggtgatcaaaacttcctgaaggacatgtggcctgtgtgtctagtaagggatgcacatgcagtggccagtgtgccaggggtatggttggtgtctgggaagagcctagctggttgttgcctttcctcggtacctaggtcttcaacatcttggtccctctctaggctgtgatggaatctgaaatgaagtttgacaaggaccatgatggactcattgaaaatggaggctatgcagaccagacctatgatggatgggtgaccacaggccccaggttagcgggtaggggtttccaggaggcctgaggtgagaaactgggcaacaagggattgtagggctcaagaaagaatgactcattgtctattacacggcatgggagcagctggagctgccagtctgacccccaaacccatgtccctgatcagtgcttactgtggagggctgtggctggcagctgtggctgtgatggtccagatggctgctctgtgtggggcacaggacatccaggataagttttcttctatcctcagccggggccaagaagcctatgagagactgctgtggaatggtgagttcggggagcctaagtagtcttaaggcagctgagaggacaccaggagccttatttttctcttcctcgactccaggccgctattacaactatgacagcagctctcggcctcagtctcgtagtgttatgtctgaccagtgtgctggacagtggttcctgaaggcctgtggcctaggagaaggagacactgaggtgagagaggaggaggagcagccagagagaaaaatgggttttccctggaggtgggaagtaagtatatgagaccatgttcctgcccttgcccctccaggtgtttcctacccaacatgtggtccgtgctctccaaactatctttgagctgaacgtccaggcctttgcaggaggggccatgggggctgtgaatgggatgcagccccatggtgtccctgataaatccagtgtgcagtctgatgaagtctgggtgggtgtggtctacgggctggcagctac

SEQ ID NO: 5447 - DNA, 1192 bp, Homo sapiens
taggcgggtgggagggaggcgactgaagactcagtactgcccagggggaggacatcgctctgggccctagaccccagcccctgtgcgacgggttcttctccctgggcacccccgcggagttcccaaactggcctccgctccccctttcctcaaagttccacgtcccagcccaagatcaccgccgctagtcacctcgcatagtcgacactagggatcggcacccctaggcctcatctgcccgcccctcagggacctggctaggtacgcggcggcggcggcggcggcggcgtccgctgggcggtagaggcgggacttcccttcggtcccccaccctccgcggagtcccttccggccggaagcgcccggcaggccagaccggaaagggctcgggtcatcccggcgcccagggtcaccttcccacgggctggcacctgggcgcgggcgctgccccggagccggccggcgggacctggcgcccaatcctgggggacccggtgccgtggcccaggggccgggccgaggtcccgggggcggtgccttgcgggcccgtcccggggcggtgcctggtgggctggccccgcggctcctcccctctctgcgggcccagtcgccctttggccgggcgagctaatcgtcggctcaatgacgacgaggcccgacccttcccgtccaggacctacagagacaaccgaaggagagcccaaggcggcttctttgctgtcgccgcccccactgaagcaagagctccccggctccactgaaacaccagctcatttaagctttccccaacgcccggccctccgggacgatacctaacaacgaccggcgcccgcatctggaataggctggcgagatacttagtatccgagggctcgggacttggcgccatcgaggtcatggggacccaggatccagggaacatgggaaccggcgtcccagcctcggagcagataagctgtgccaaagaggatccacaagtttattgccctgaagagactggcggcaccaaggatgtgcaggttacagactgtaagagtcccgaagacagccgacccccaaaagagacggactgctgcaatccggaggactctgggcagctgatggtttcctatgagggtaaagctatgggctaccaggtgcctccctttggctggcgcatctgtctggctcatgagtttacagagaagaggaa

SEQ ID NO: 5448 - DNA, 1199 bp, Homo sapiens
tttgttcttattaataaaagcagtgtgtagctggctaaggacttgttttattaatgctccacaggagcagagacagacagagagacatagtgagccttgaaccaaacacctgtattccaacattttacacagcggtctgggcaccctgtgcctaggagagccagctacgtgtctacctgagtctgacctgggccaggggctgttatcttgggaaagccagaatgtcattaagaaagggacaaataggcagttgcttgtgtagcaaggcagccaccaggttgctcaaagggggttctgcataaaccaacatattttgttgttgcttccagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgtattatgtgaagcttctttattgacctcaagatgtgttgtagtttggagtgaggttggaaggaatttccaggaggaatttccttgaaatttctagggctgaggaggcacagccactgggcacacagccctgccttgaactaagatagcaccgggatctagagtgggatcctgtggacattttcatttgagaagggagtttagtggctgaaggttaaccccctcattatctacctaagacacagctgtgaatcctctcaccaacctagtcgttttctcccagatgggctcttgcttgccagtgtccctcagtttagggtcttggatagtatatttcggcaggagtctgtggggcacgtagactctagtaagaccttgactcctttggatccggccagtaagcctgagtcaggacgg

SEQ ID NO: 5449 - DNA, 1180 bp, Homo sapiens
tgggaggccgagatgggcggatcacctgaggtcaggagttcaagaccagcctggccaacatggtgaaaccccatctctactaaaatacaaaaattagccgggcgtggtggcatgtgcctgtagtcccagctactcgggaggctgaggcaggagaattgcttgaacccgggaggcggaggttgcagtgagccgagatcatgccactgcactccaccctgggtgacagagcgagactccgtctacacacacacacacacacacacacacatccttcctcctctaaccccaaactaagatcacagaaggtgatccagtcagagaacagagggaaatcttaccaggaagggcttaagtacacttttttttaaaacagctttattgtttttaaagcctacaatttgataagccttgacatatgtatacctgtgaaagcatcaccacaatcaagacactggacatatctatcactcccccatctcagatatcccccctaatcctggataccatttgttgaaagatgttattactctagctgaacttacaagagactttagaccagggatctaaattacagtggccttagtgaccttgtccttatcttcttaggacagctgagaagccactgggacttagagcctttaaaaggagattaactgtcccaaaaggatctttgctactgaccagcagacacttcttccttcagtagcctttcatactgtgttgagtaacaccctagggtgtccattaaagttttgagttttacctagagcccagagccatgaatcaggattctgtctacatgattcgtgttttcattggtgtcaaaatacaaaagccaaagttctggctatgaattgttaacttggaagaaatactaactgccaccacttattaagtgcctactgtgtgccaggctctgaactaggtgcttcatatacattatcctaaattatctcaacatatgaggtaggtgttttaatttttattttatagaacttggtgtgtttgactgttaagctatggggctagagagagggtttgatcccaggtccctctgtgcttttgctgctgagccacacaacctctcatttcaaaaacactttcaaaatgctaacatattctaattcactctaggccaccaaaaactttaatactaatatctgatttgtaaatgacttaa

SEQ ID NO: 5450 - DNA, 1090 bp, Homo sapiens
caggaggtagagacggccagattacttgagcccaagagtttgagaccagcctaggcaacatggtgagacctcatctctactgaaaaaggaggataatccaactctcttctacttcacattaatatccttttaatgagcatggtcagatactttggaaagttgtggagataacttcagaaactaaatctgaataaaaacctatgtgtaaacgatcatatagatggctgttagcaaagtggtacttttgtaaactttacagttgacatactatagtatatactacatatatacttatatactacatataatacatagaattatacataatatactatagtatgtcaactatagtatagtatatttgacacgtttaaaatgtacagtttcataggttttaagatacatatatacacaggaagccatcatcacaatcaagatagtgaacataacctaaatctccagaagtccctcatgttcctttgtgatcttgtctcctgccccttcataccgtccatccccagggaaccattgcattctgtcatgagagattagttttgcactttctaaaattttgcataagtggaatcatacagtagggacccttcaggagtggaggagggctggcttatttcagtcagcataattgagattcatccataaagtagcaagtatcaatactttttattatatattgattgtggttatcccacagtttatccattcacttattgatggacatttgaattccagtttttagaaattacaaagctgctaagaacattttagtacaactcttggtatggatagatgctttcttcttgagtaaatacctcggagtggaatggctgaattgtaatggatatgtgtgtttatctttcgaaggaaacaacagttccaggccaggtgcgatggctcatgcctgtcatctcaacactttgggaggctgaggtggttggaccacctgaggtcaggagttcaagaccagcctggccaacatggcaaaactctgtctctactaaaaaatacaggccgggtactgtggctcatgcctgtaatgccagcactttgggaggctggggcaggcaaatca

SEQ ID NO: 5451 - DNA, 1099 bp, Homo sapiens
gtgtatgatttgagttgaaactatttcaggcaggtatttgaggagattttctttatcaaaatgcttcaaatcacaaatcaacaaaattaatttttgttctcaaatatataggatactttattctaagtgagactatataagatatttaatctctaattagtagatttggtcatttcggatgatatgattgttttatttataaaacaaatatttggagattgttttccaatacatcaggttattccttgatatttagcagaagtttttgccatagtgcttaatgaaaacagctcaaactgttaaaatacatttttggtataagtatatttggtatgttctatgctttaattattaatttgtaattttattttaacaaattactttgtgtagtttttttttagaagcagatcagctcagtgtaagaaacttagaatattgttttgtagctttctttgttatttcgttgtccttcctttttatttgtagtttgcaagggtagatgagatttttttttcagtttcacttgtccagatgatatttaatgtagaatgaataaactcagaagagcagcctttacctaaggaagaaggtatgactacttcaaattgtttcatcacttagtttgacttcagagatttttgctctgtgatttgcactgacttcaaaactttttgcatgtatctcaaaagtgggtgagaacatttatagcagcattattcataataaccaaacttggaaataaacgctatatccatcagttgataaattgacatacaaaatgtggtatattcttaaaatggaatattattcagtcataaaaaggaatgaagtacagattcatgctttaacatacctgagctttgaaaacacgttagtgaaagaaatgagacaccaaaggccacaaaatatgtgattccatttacgtgaaatgtccaaatgggcaaatccatacagacaggaagtagattagtagctgacaggaaggagctgggagaatgtgggaatggaaaggtactgtaatggatgtgggatatatggaagatgttctggattatggttgcacaactttgtgaatgtactagaaaatacttgcacattt

SEQ ID NO: 5452 - DNA, 1196 bp, Homo sapiens
agccccacatgagctgtctcgtagggccaagacagcacttttgtatgggggtctgtttcagaggcacagatggctccaaacacgtcttctgcatctgtaaaagataacaggtgtacatttaaagaaaggaattcatacatatttaatgatttagcttaagcaactgggcaaatattcattttcttaaggtggtaatacataattaactgataataaaattaattgggtaaaacagtctaaaaataatgcagtacttattacatgagggaatataactgcattgaaagaggtttaattgttccagagactgatgagtccccaaaagcagcaaagggaagaggtttttccacctttggaataagggctctgagtgggcgcttcctgttcaccctgtgggaatagggtgggaatggagggtggagaggaagatggtttcttgcaatttaacagcttcacaacgggtttagagagcatcccaatgtctactcccaaccctaaccacacatcttcacccctgccaggtcaaaaaatacagaaaagaaagaatctaccacagatacccttttattagatcagaagagagaaagcttgtagacgcctcgtgaactcaccccttccactgcgaagtgccagaccctgggctggacaccgtgggagaggccagctgggcaagtctgtccttcggggaggtctggggtgtttggggaagggagatagggacacacaatcctcacaacaactgcaaaaagaagtgtgagcacgtgggggcagagggagcgtcagtcagacgggaggtgatcgggactggagagagatgtcccagaggaggtggcttgggcaggtgggctttgactggcgtctatgggagaggagcccgtaggaagaagagagagcaggacagctgggattgagttgggctgaagccggaccggggagggtgtggcaagagatgaggctgaaccggtgggctggaggagggggtcccaggaaaagcagctctggtcccaccgtcagccctgccttttattattaatctctcttgtgaattcaggtgggaaaaggcctgctgagagtagtgccagaattcacaggagaaagattctgtaatttctttgagctctgtgactctggacaaagtattcagtattaatgcagttgaccatgacgtcttctgtgtgcgcgactgacagaccaaa

SEQ ID NO: 5453 - DNA, 1177 bp, Homo sapiens
tggatgaaatcaagaagcggtaactgcagcttgggatctggagggggcctagagagaggggtggctatgagagaaagaagagctgttgatttgtttttactgcatatccctcggccattcagggagaatgtgaggtggctgatgatagaatctgtccacatgtgcacaggtcagttacaataaaccccagcagtcagaaacagtgggtaacttctgtgtaggtggcaccctttcacattcattatcttttttgatccccacaacaataccttgaagtagcaaaggcaggtgttattctttctgtttcagatgaggaaattcagaaaggttaagttacttgttcagtccctgaaccctgatcttccatcttcatatccttccaaagtgggagataatctaaataggaatgaggactgcccgtttttgagtgctcatttatagttctgagcttcctggcaggcagatcaaagagggagcaaagtaactccatggaaatgtcccagcagtagacattggtaaatatggttgaggctgatgttaccaccagatgtctgattcgtagtgggatccgagttggctacaccccagatgtcctgacagataccaccgccgaactcgcagtctccctgctacttaccacctgccgccggttgccggaggccatcgaggaagtgaagaagtaagtgaacgcagaccaggtgcggtggctcacggctgtaatcccagcactttgggaggccaaagtgagcggatcatgaggttaggagttcgagaccagtctggccaacatagtgaaaccccgtctctagtaaaaatacaaaaaaaattagctgggtgtggtggtgggtccctgtaatcccagctacttgggaggctgaggcaggagaatcatgtgaacccaggagacagaggttgcagtgagctgagatcacaccattgcactccagcccaggtgacggtgtgagactctgtctcaaaaaaaaaaagaaaaataagtgaacgcctggcaggaacgttggctctgctcagcactggatcctgatcactgtgccagtccagcccacgcatagtccctgaccccaggtgtgccccattgagtgaggactcagctaaaataaagcacaaagcagagctgcaataagggcagaaagggaagtggtgagagaagaggatgagg

SEQ ID NO: 5454 - DNA, 1122 bp, Homo sapiens
tttttttaatttgtgatcaacttcactgttcattcatgtggagtgcttctgaaatgtttaagaatagcttggattttttgttttgtttttgaaacagggtttgctgtgtcacccaggttgaagtgcaatggcacaatcatagcccactggagccttgatctcctgggttcaagcgatcttctggcttcagctgcccaagtagctgggactacaggtgtgcatcatcatgctcatctaattctttgtggaggtggggtctcactttgttccccaggctggtcttgaacccccaggctcaattgatcctccctcctcagcctcccaaagtgctgcgattacaggcatgagcttctgcgcccagccagcttggtattttcctcatttctctggagatacacattatgaaattttatgcatgccactaattctttgtgatagtctgtatgtaaatacatttaaaaatgtgtactggattttaaaggatttctaagcagaaataaactttagcctaggcagacaaatggacacaaatttcaaatctataattttgaaaatctagaaggtaatttacttggtcatcttcaggaatatatctggtggtcacatgttcacatgataagtcatgaataaccaaaactgctcagaagatttaccttctaatagcaactgtaagaacaacactgaaggggttttgaatagtagttaacagcaagtatttcatgagtacttgttttatatcagtaagtgaaaggtatctaattcttgcaacaatcctgtgaggtcgttttatcccatttcgtggagagactctatggcagagacttaaatcctctagctattgtcccattactcacaagtggcaagctgggaagtgtgtctgaattctaagaatgctattttcccgcttaaacctattttaagtgtgtctaaactgaaaacaactaaagtttggcccaattttgagcatttgatggagtacaagaaaagcaatatgaactcaacactagaaatgttttccaaacacaggagtcaaaatggaaaagaaaacataattctaggacactagccatctctacagtgaataatatttatggagttataatataaatgcagtttacagct

SEQ ID NO: 5455 - DNA, 1133 bp, Homo sapiens
gtagctgggactacaggtatgcgccaccacacctggctaatttttgtattttcagtagagaagggtttcaccatgttggccaggctggtcgtgaactcctgacctcaggtgatctgcccacttcggtctaccaaagtgttggcattacggcgtgagcacctggccacgcagctgcaatcttaggcccatcattccactgagttccgaagaatatagccttttcctgaagaaactcctttcttcaatgcttcaggccagttgtgagtctctaagtaagtggacaggatatcaaacactgttagagagtaaacagaaaacacagtgaccacagagggaaaaaaagaacgagtaaatgaaaaggatgttctgtaatatttcgttcaacaaacctattctgcaccatatgtggtactaaggtcttgcggggagaggcaaggacacaggctctgcttgctctcaaggacctcagcctaccctgaaagatacaggcctatgaatggatagggtgcaacagaaaggaacacagtaaaatgggaaacagaagggctctgctgtggcctgggatggggaagggccaagatgctcctgaactgaaccctgaagatcaaacaggaattcagtggtgagaggttaaaagctgggcattctagatgaaggggacaattttttttttttttttttttttttttttttttttttttgaggcggagttgcactcttgttgctcaggctggagtgcaatggcacgatctcagctcaccgcaacctgcacctcccagattcaagcaattctcttgcctcagcctccagattagctgggattacaggcgcctgccactatgccctgctaatttttgtatttttagtagagacggtgtttctccatgttggtcaggctggtctcgacctcccgacctcaggtgatctgcccacctcagcctcccaaagtgctgggattacaggtgtgagccaccgtgcccagcttttttttttgtttttgagacagagtatcactgtcacccaggctggagtgcagtggtgtgatctcggctcactgcaacctccacttcccaggttcaagtggttctcatgcctcagcctctggaataattggtattacaggcgtgcaccac

SEQ ID NO: 5456 - DNA, 1230 bp, Homo sapiens
ttaaggggagtctcaaggatggcagtcgattaagcagcgtcttgcagcggggagaaatgcaaagtgtagttggggttcggtctccgaaaactttgctgtgtgacctggggaagcccctgcccctctctgggtatctctgtttccgctcccaaaccagtgccttaggagcctagatctgagcaacgtggacactgggcttgcggagacccgagggagggagcgctgaagcggtgcgggctgccgggggtagaggggcggggaccgggaaagaccgggcggggcgagggaggagcggccttggccggcgacaggacgtaggcagcgccccaggcgcaggcggagcctcattggccgctgagccccgggctgcgcggaggcgggacctgcggccagccctgggcggccatgtggacagagctgggagggccggaaccagaacccaagcgtgatcctgaaccggagcccgagcctgctgcaggtaactaacgctggtctcccctcggctccctcgggaagccgcagctcctggctccgcgtgggggctttcctctctgggccgcggcgtccgcatctgggggctggcctttccgccgttgcactgtaggactctctccacgtcccctaatcccatcccccgcctctgggtgacgctacaggagccccgaggacacagacgcccccagaccttaccacgttagctcgacctcaacactcctgcccactcggcccacttcaacagagggcccctgaccatagcccagaggcttggacaagcccaaaggttgcgccctttcccccgcagaaggggtgaggtgggcgccgctgcagttcccgcggatagagaaggtccggtccttcccgctgtgggtgaactgtaaaaaattgcctgtattcaggaggatatgcaaagctaggtttgtggaagtctggggtgaggctcctatactttcttgctgtgtgtcctcggtgagtccctgaacctctctgatgcccagccttcttccagaatgggggtcatcatcaaccctgaccacccagggactgcagagaggcttggcaaatttcccgtgagaagacagcctgcaaactgtaaagcatgatgctctgtgagctgtgatcttcctatcagcaagtggaggccccagcaagaaccccatataggccccaagagtaggaacggccttggtgtggctgcaaaggtttgccagccttggcctatgaccacctctc

SEQ ID NO: 5457 - DNA, 1277 bp, Homo sapiens
ttacattttggagtccttgttggaagtgaactttccgcctgtaagcctgccattccatgtctaatatattgggatggcatcaccttctgtactatgcagcagaaggagactggcctgggattctggaaacatgagatccatttgcatattaatccccggctcgctgtgtgaccctgagcaagtctccttcactttctgtgcctcagtgtccttatttgagtaaaaagggaataaaactagatgagtggttttcaaactttaaaacactggaagctctctttgaaaacaaaagatgagaattgaaatggatggcactggaagctgttcttgtctactggggtttggagctgccaggggacctgctcacatccactcctcactcagcccctcccgcccctcccttctccacgcactgtgactgacttccatgtgtgaaggcctgcagttaattctcctgtgtcttgaatggttgggagatgagttggtcagacccttagtgaaatgatgtgggaaggaacaggaatgctgtggctctgaagaaggtagtagaacatcccacacctgctaataagcacattttgcaaactcagttgactcacctcagatttgcctagtgaaaactgaagggctggatgtagacccagagagcagggtggacagagcccatgctggaagtactgagcatcaggactgtatggggctggctttagcatcatcattctgtgcaaagacaaataattaatgtcacactgtctgaaattttcaccaaaaccaaaaaggcgcattaacatgattgttccaacctcatggtttttcaagtgtgagcgcccagagacctcttcagaggctaagagagcatgcgctgccacagctgttagcatttggagacgtaattacaatgcccccactccccgcaccaaacctgggtttttctaccgtttttgtagatgtcatgatgtcacgacccctgcaccctgaaaaaaataaatgtttttaaggacagtctttgtggtgtctttgttgtaggaatgctgtataggtgggtgcaggtcccactggtattcctttatcatccctcatgcctcctgtccttccttctgcatgcccacttcagctacttagtctagatcctccttacctcccacgcctggttgcgatcgcagccccaccgttcaccttgcccgaaatttttaaccagccctaatcatcttacactactgcccttgactatgtgtgtcctgccgtgtacgcattctagtacttaattcacttgctga

SEQ ID NO: 5458 - DNA, 1179 bp, Homo sapiens
agccatctgtggattttccaatggttgaaaagatcttattaagctggagtctgctgctttgaaacgtccaccttttggtcttaaaagtacttcttgggactccacagggcccttcactctccactggcaccatttcctgctggggagagattcgaagtgaaggatcatttcccccaccttccatgtaacacatagttgattgtaacggagcaggcttacgttctctaattctttctctccttttcttcctagggtcttagaaacattgatcatgggatgatggaaaagtcaaataacggatctttgtgcttcatgaagagttggaaaacctgtgtgtgtagatgaccccttttgtgtgtttttaaaaattagatgcaaactagatctgtatgcagatgtagtttttagcagggcaaacagtgagaaacggatttgcatgtggcttttttatacttttgaaatgaattgttccatgagaagtctttttgtaattattctcttccagggagatcacagaacggcatgtttgcaatttcgaaagggctcgtgtcagctgtgactctttacctcatttgtctatgacctattagtggtgctctgtgacttagtgtgtgttgtagaaggagggatgagggtcccagctgtcctctgcctgactgtaacttgctgtgtgacctgaacagatcccttcccctctctgggccctggtcccttcatctgtgagtatggcattttaactggatgttatcaatgtcccttttagccctgccatcctagattaagatggccttttgggaaaataacaggaagtgtggtcttagtgttctttctaaaatggtattccctcagaaacaaattccattgctttaccccaacgtgtggacagctggctgtagctcttctattcctaactttttccctttgaaggagatttagttttaggtgggatgctttaccagactcaggagcgccttggctgggtctttggagaccagagcatccatttgttagcctagcattctcttttttaaaattttattttgagacagggtctcgctctatcacccaggctggagtgcagtggcgtgatcatggctcactgcaacctccactttctgggctcgagtgatcgttccacctcagcctcctgagtagctgggaccacaggcatgccccacc

SEQ ID NO: 5459 - DNA, 1125 bp, Homo sapiens
gttttgcagaatgaaacctttgtttccagaagcactgctgactgtaagtggttgccgtttgtggcagtgagcattttgtccattctgaggttggattggtttctccttttggccttgccctgccctacagaccataaaggagaacagcaagaagcccccagcaaacatccacatatggccctggacatcagccacattctgaggaacatgtcatgttctgggagggctaaggcatcaagtaaggcctgtggggctggaggatccaaggcaaggtggggcaatccagagccatgggggcttcccatgggaattgggaggtcccaaggcagagtcagaggttccacaggaggagtcagagagtcaccaagggctctcctggcccagggagcagtcaacaccatggactgaacacttgctgggctccaacccttgggccaggctgcccatgtggggccaggaggcagctcagagtgggaggcagagagagaagtgtgctcagagggcacctgtatctggatgtaatgtggtcctgagactctggctgggaagtgcttccagggtatcatatgtgttatgcagctacttcctctccccagccttaccctgtaggaattctagtgactatgttgccaccatcttggagctccatgccctcatagtgtaatggcaccagcagatctgcctgtgcacagacttcctgtactacctcactcctgaggggagatgcttctgcgggcctgcgacctggtgctcaactttagacaccatcatcctggagcggcactgcaccctcactagccagggtgttgacgtcctcaaggccaaggccacattcaagactttggacttcattgatgcacttgtgccgagcaaggtgggcatctctgggatcttaattcaggaggtagaatgcagcttgagatcaagtgtctgatcaaagaacttgaacttgatctggagggctctggggagccatggaaggttctggataaaggagggacagtcagccacgttttagagatgactgtggaaggcttcctggaaggagtgaacaacagccaggagaccagggagggagcttgtcgggcaggtctggagatggcaagggagggatcctgcttggat

SEQ ID NO: 5460 - DNA, 1172 bp, Homo sapiens
atctggggtctggaggttggtggccatctgcgtgggggctccaagcccatattttccttccacatttccctagtagaggttttccaagaggatctgcctctgcatcaggcttctgcctggaaacagtgggagttgggggtggggggcaaatccttcaccaatggttaaacaccatctttttgatgctgaccttgtgagttctcatgagatctgcttgtataatagggcatggcacctctttcctctctctgtctttctcctactcctgccacgtgaatcatctcattgccccttgacattctggtatgattgggaggcttcctgagtcctcccagattcagaagccagtatgtttccttacagcctgcagaatcatgaggttctttatgatcatagagaaaattagtactgggaagtggatgtatgaaatgtcttcaaggccttttccctattgtcttgggagtcagtactcagcttcttttcattcaagtatctgagggcttcttgaattttctccctgaaaatggacttgtcttcctttaccacattgccaggctgtgacaaagatagctgataatgtagaagcaggttcagaagggggtggcagacagagatcaggagagtttggagggcttcgaagacaggaaaatgaagaaaagtttggatctttgtaaagaattgttaactacttgtgatcagaaggctgacaggaaaatggccagtgaaaaccagacttggaaggtctcagataaaaatgaggaacttcctgggaacagaagccaaggttacttttattttgctgtagcaaagaacatggctgcatggtgaccctgccctggagatctgtgaaactttaaacttgaggttgatgatgcagtgcatatctggtggaatgaacttctaggaagcaaagctcaagaggtgtcctgtctgcattgaacagcctgtgctctgatgtgtgactgagaaaatgacctctggatgggacttatattaaatgagtcccaactcttatgttaaatgagaaacaggactcaaaagtttggaaaatttgcagcctggccaagtggtcaaaaagaaaagctgattttcagggggaaaattcaggaaggcttcagaaacttgcatgaaaaggagcccagtgctaatagccaagacaatagggaaaagcc

SEQ ID NO: 5461 - DNA, 1165 bp, Homo sapiens
atgccaatatcacactattttcattactgtagccttataagctttggtattagattgtgctaatccttcaaaaatattcttatttttaaggattattttggctattttagactctttgcatttctactgaagttttaaaattagtgtgtaaattcctataaaacaatgcctaataatattttaattgggactgtattgaatctatatttagggataatcacattttaccatgtgaattttctaacccatattcatattacatctttccatttatttaagtcttctttaactttctgcagtgttttgagttttagtgtaccagactcttacatcatttgatagattaattcctaattcttctacatttttcatgatattattaatagtacttttattttaattttttattgttcattgctggtatatggaaatattagtttaatatgttgctttttttcttttttatgttgctaactcacttattatagccagcagtgtttttgtagatttcagtggactttctacatagacatgccgtctataaataaacccaatctacattttcctttcccgtctgtaattcttttgtttatgttttttgtctattttacttggtagaacgtctagtgaaatgttaaaacaaagtgctaagagttaatggactcatcttgttcctgaaatcgggggaaataaactgatttttcttcattaggtatgatgccagctattgtttttacatagatatcttttattaggatattcttgaatttcttctagacagtaataacttagatcttgtttcattgatccaatctgcttttaaattggtatatttagaccatttatatgtaatgtggttatgtgtgcatatatacatatttttttttctttttttttttttttttttttttttttgagacagagtctggctctgttgcccaggctggagtgcaatgcgatgatcttggctcactgcaacctctgcttcctgggttcaagccattctcctgcctcagccttctgagtagctggcattacaggtgcccgccaccatgcctggctaattttttgtatttttagtagagacagggtttcactatgttggccaggctggtctcgaactcctgacctcatgatctgcccacctcagtctcccaaagtgctg

SEQ ID NO: 5462 - DNA, 1117 bp, Homo sapiens
  misc_feature (1)..(263): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctgtgtgagggacaaactttcagaccacagcaggagtgttctggaatcctatgtgatggacaaacactcagaagacagctggactattttgcaatcctatgtgagagacaatcattcagaccctcgtagcagtgttctggagtcctgtgtgaggaacaagcattcagaccacagcaggagtattctggaatcccctctgaagaacaaacattcaggctatcgtagcagtgttctggaatcctgtgtgactgacaaacattgagaccccagcagcagtgttctggagtgttatgtgagggacaaacattcagacactagtagcagtgttctggaatcctgtgtgagggacaaacactcagaacccagcagcatttttctgggtccctatatgagggacaaacactcggaacacagcttcagtgttttgcaatcctatgtgagggacaaacattcagaccctcgtagaagtgttctggaatcctatgtgagggacaaactttccgacaattataacagtgttctgcaatcctactttaaggacaaatatgcagaccctcgtagcagtgttctggaatcctatgtgagggacacacattcagacaatcgtagcagttttctggaatcctatgtgagggacaaacattcagaccccaacacaagtgttctgcaatcctacgttaaggacaaatattcagaccctcgtagcagtgttctggaatcctatgtgagggacacacattcagacaatcctagcagttttctggaatcctatgtaagggaaaaacattgaatcaacagcgggagtgttctggaatcctatgttatggacaaacattcagacgctcattg

SEQ ID NO: 5463 - DNA, 1214 bp, Homo sapiens
tcttcccagatgtgaaaatagtttctacgcccacttcccttccaaataacttgaaaatataagaatcatttttccctgagctagtacctggaagagttctctcctaaaggagctagaatttgttctacagatgaaatgtttccatagtattaggtcatatgaaagcttaacctaatcttatgttcaggtatgattgtgttctttatggcaggctagctatcaaagtacacataaattccttttttaaaagctcagcagattccccatccagtgactaaaaacaagttacaaagtgtcaggcattgcgctaagtactgtacacagctaactcatttacttctcataatgacctaatttactcttcataaccacatcaggagagaacttatattgcagattggactttgaggttctcagaggttcctcagtggctacaaaacaggacaaaggggatttgcctcaggtctaggcacaggaatgggcccagacagttgctggtcctggagtctattctgtcctctgggcccagcagtagcttcccatccccactgccccatcttgactctcttgtttatgatgccttcatcctacttgggatgtctgtgtgtgtgtgtgtgtgtgtgtgtgtgtgtgtgttactgtttgtcttagtccattcagtgttgctataacagagtacctgaggctgggtaacttacaaagaaaagaagtttatttggctcacaattctggtggctggagagtttaagaccaggcagctgcatctggtaagggtctcatgctgcttccactcatagtggaaagtggaaagacagcgagtgtgtgcgaagagataacatggtgaaagaggaaaggagagaaaaaccaaggaagccagattctttttaacaatccactgtctaggaaactattccatccttgcaagagtgagaactcattcatcactgcaggaggacattcatctgttcataagagattcaccccccatgacccatgcacctcccaatactgccacattggggattaaatgtcaacatgaattttgtggggatgaaccacattcagaccatagtactgttgcaccgacatctctccattcttggccctgtggggtggcaaggactcagaatgagctggaatacagtgctgccataattagccatcaacagtgaacaagtctccaggttggtctgagcctcagcttctccagctac

SEQ ID NO: 5464 - DNA, 1197 bp, Homo sapiens
tcactagctactaaaggaagtccttcaggctaaaagcaaagtgtactagatagtaactcaaacttgtatgaagaaataaaaagtaccaataaagataactgtgtaggtaaatataaagaacagaataagtatatttttatttctcttatcttctgatttaaaagacaaccaactgcataaagcaataattataaaactgtgtcaatgggcttataacacaaaaaggtgccatattcatgatagaataatggaaggaagaaatgaagcatagtttttgtatgctatgaaattaagttaatatgaactagattatcttaagtcaagttattaattgagggccaggagtggtggctcatgcctgaatcccagcactttgggaggccgaggtgagaggatggcttgagcccaggagtttgagactagcctggacagcatgtgagaccccacttctttctaaaaaaaaaaaaaaaaaaaaaatcaattgttttgatcacctctcagtgttttggctaagatcaagtgtagtatctgttcttataagtttaatatctgatatgtcctctatctgaggatactatattaaatgggtttttggagcagggagatgggataggagcttactctgtccactccaggtattgcagtacctccaggaatggtgcaccctctttggggaataataacattttaaaaaattacttgtaaaaatattttttaaagatgttaattgaaatccctagggcaaccactaagaaaataacttagaaatatatagtaaaataaaacaagaattaaaatggtatattagaaaatatctatttaacatgaaaaacagtaatagaataaaggaacaaaaagaagatgtaatacatacagaaaacaaatgccaaaatgcaaacataaattctaccttattaataattatgttaattgtaaatcgtaattgttaacactctgatcaaatggtagagactggtagaatgaattgaaaaaatgatccaactatatgttgtctccaagagacacactttagattcaaatatacaaataagttgcaactgaaagattggaaaatgatataccattcatgcagttcccaaaaaagaactggagtggctacaataatatcagacaaaatagacatgagatgccacctcccacttgggatgactataataaaaaagagaaagtgagaaa

SEQ ID NO: 5465 - DNA, 1208 bp, Homo sapiens
ttaaattaatatatattatatattgagtatatatttaaatgaagacaatcaatagtcttaaaaatgtttcctgtctattttaaatctttaagcggtgtcagtagagtattaaataattgaggtagttaaaaaggacataaaattgaggagtcaatatggataagattatagaaatgacagggaaaaatacagaagtattgtagattaaatgtcaatattctgctgctgctttaatattctggagaatttggttacagatactgatttgttttaggagatttgttctaagaattttcctttgtaggatacatttggggatggctttgttttggcatggcaagtagctctaatgccactggaatacattcaggactttcaaatttgtctcagtttaatgttttttcagttgttgcacagtactttataactttttttttttttgaatgggtgaaaaatggctttgtgggctgacgtaggtcatggaaaattgaaagccaaagctctaagatatataagtttttcatctcttggtttagaagaaagtctcttagatttgagtagaggatatcagttttcacattagtttactaatttttttttgtatgtgtgttctttagactgagagatttctttgacaagctgtataagccacagaagttttatattctgatgaataagctggcctgtagtggtggaagcgatgatgaagatcttggctagcagagcacatggtctgtttttaccatttctagtttaagtaggctgcactataagtggctgaggatgtagttggctgctgctcacttagtctggcacagatcacagaatctcccttttcaaagttgagacacttgactttgtgctgaaaatgtctttttagctgtttaaattttcattctcttccctttacttcttgattattttttcaaggtctatgtacagacatggagcactcagaatctttctatgaccattacacgagatgagtatccgtccaaccctatggtgctccgaggtattaatcagaaggctgcctttccacagtaccagcctgtcgtcatgctggagaagggttataccatccactggaatgggccggcaccacggactacatttctatacctcgtcaacttcaacaagtatgtttctgttactgttatttcaaatagttgagcaagtagtaatttagtggagaaaaagaataactt

SEQ ID NO: 5466 - DNA, 1140 bp, Homo sapiens
tacatggagctatttgcaattgagataaatgtaaacaagcaaagatgtagcattaaatcttagttgcataaaattatctgtagtagatactgtactactgtaataattttgtagccacttcctgttgcttttgcagtaagctcagatgttaccagtatcttcttaaaataatcactctgcttttgtctgtcaagtaaattgcatatagcagtaaacagatttcatcaaatttaatgcaataccataaaccttaaataacaccatgggtcccatatgacgtgccactggtgatgctgcaggtgctcccaagaagcagagaaaaaagacattacaagaaaaagttgatttgtttgatatgtactgtagatagaggtctgcagttggaggttgccccccaaccccatttcagacagaggattcatcttgtaatcaaattatgtaaacttatagtattgataaatgcagtgcagtagtgtaaatgtattttccctttcctacgactttcttaatattttcttagctttattgtaagaatatagtacgtaatatattaacatacaacatatctgtcagttgtttatgttattggtacggctttcggtcagtagtaggctattagtagttaagtttttggtgaatcaaagttaggtgtgggttttcgactgcacagggggttggtgccccaacccaagtattgttcaagggtcagctgtacgtccagattttgcagggttcaattttactgcaaaatgtcttttagttaatacgtaggagatttagataaaaggtcataaagcaaggaatgtcttttgattaatattttctctttctaatgggtttcaattttgtgattcccacagattttgcttagatgacattctcattaaggtaaaaatggatatagctcatttgtattgaatagcaaaaatgttagttttataacccagtcttgttacgaatgaagcacctcagcacatagaaaacactagagttgaaaagctgaaagtcttttcagaaacttcttacttttagaaataacggggtgagattttttaatattgagatttagaactgatttttacaggtgaggatgtggatagacacaaagcggtaagcaacttgctcagggttacacaatcc

SEQ ID NO: 5467 - DNA, 1155 bp, Homo sapiens
tgcggggaagaaactcagactttctatttttgatattttgtgcattaatacattacaaacatgaagatgtttgtaaagttttgttttagtcattttctttgcagtcacatcattgtaccaccttcattattgtatagagctgcttcaattctgagtcctctggacttcccctgcctatctgtttgttgttgttgttgaagacagtaaaataagtgttttcaaatctatatgtctcctttttgttggataatgtttcttctttttaatggtaaatattcttgttcttcaacatttttctttggttcttttttccttttttaggaaaaacaaaacaacagacttcatccttaggttttctcaagatttaagtgaacacatttacacatatcaatttcttaaagaacacaaaatgtttcctccctagcaaaactatttaagagccaattaaactatgaaatagttataaaattatttttaatatttaaggccttgaaattatattccaaggcaaatctaaatgggtgtagttgtatatgcacgatgtaatttaatgctaaagagtacttacagcttgagggaaaagcataaagttttagttaaatagccttcatactgtggatttttcctcctactaactaatatgtgggaaattaagattacagatgctttgggccccctcaaacagtacattgctacagttcactgtagcaacagatttggtggtgatggggggatagaggtagaagcagatagaaggtaattttaaagttaatttattatgaatcattttcccctaatctgcataaatgaattagaactgattttaataaaaatattctgtgtaaaaagtactcagaaaaacatctaaagctgttggagaagagggactcatataaatagttggattgcgttttgctttttatttctttataaaaatatgtcaaaaacagtttttaattttagaaatcttatacttgaaagaaacctcaattatcagtggctttatgaagtaaagttaaaaacaaacataggaaatgtgaaaatatttgtgtttgttttgtctgactaacttgctgctaaatgctatctttaggtgtgtgaaagttctttgatatgttattgtccttttacatcttgttaaatagccattgcttt

SEQ ID NO: 5468 - DNA, 1256 bp, Homo sapiens
atcttatttaaatctctcataaaccccaagataagggagtagattgttcctgtttgatacaggaggaaactgaggcttatagcagtttggaaaataacttaaagtcacatacagtggcagaagccagatgaggaacttggtcagtcagtttcaaaacctgtgcttaaccactgtgctactttcacacagcacacagaaggaatctaatggcatgctatgattacagccgtttaatacggagacaagactcataatagttcataatagtcactgtgtcagggtggtgcaattttgtttcgttttcctctgttttccaaagctatccttgaggaaactttttcctagtgcaaagcttttcattgggatggtatgtttctttaaatggaaggagactaattttaccatttaaaaagtggtatttatttttaaaaacataaaagaaattccttttcaataataatgagatggggcatcgccgcggagcctcggttggcctcggatagccggtcccccgcctgtccccgccggcgggccgccccgccgtgcgccgggaccggggtccggggcggagtgcccttcctcctgggaaacggggtgcggccggaaaggcggccgccccctcgcccgtcacgcaacgcacgttcgtggggaacctggcgctaaaccattcgtagacgacctgcttctgggtcggggtttcctacttagcagagcagctcgttcgatgcgatctattgaaagtcagccctcgacacaagggtttgttaaaaaaaaaagaaaaaagaaaaaagaaaaaaagaaagggaaaaaaataataataacaaaagcaaataagtaataataataataataataatgagatgggaaatgtggccatgtgtttttcttgtgcttttgcacattctctctaggctttgtctgtggtcatggaataagaaaagccttttggttgccttgtttggaataggtgcggctttacttcattctccacctgagagggtagtttactgcatggggcattttgtttgctgggaaaagaatccatgtatgaatcataccacttaacatttccctgccagcgctgtgtgcatcttttgatgtgacatatttttgtttgtttgttcttttctattttcgttgttcttcttcttaaaaatgacaactaactttgtttaaaaaaaattgtgttaaacaatctcaaagttacagacactttgtaagaacagtacaaagaacatcccttgaaccagttgata

SEQ ID NO: 5469 - DNA, 1177 bp, Homo sapiens
aatgaaccagaaatgccatttgccaaacagttgtaactagaaatttgattctcacggtccattcttttctttgtccttaagatgacattgttagtgttcacgtcccatgttcagtgtccaaaccggcaatgtaaaaagtatcctgtgtggtttaacaggaaatctgtttatgtctctttatttgaaaccagttttactctcagtggttctttaagttcaatgaagtctgccaggaacattggttggtagtattattccgacacctttaatttccaaaatctgaagttcctgctagtttaccaccttcatgatcttcttgaactggtaactgattaggttgaacttatggaagatttgtggacttaactcaaaagtaacctctcagtgttctatagaacatgtatttgtgtaactgaacctaccaggagaaatgtttggaattctatatgtgcaatttttcaacaaatgcaaaaaaaatacagcacatgtattgacaagcttctgtcaagcagcttgagttgaaatttgatttaagaaaataaatcatgattgttcaaagctgctgggacgttagaattaggccatgatactggtctcattttaactacagtggtatttggcactagtgtaaacttccatataaatcactcttttggaacaacaaagggggagggagaaaaatcacggcctgttaaatgagtaccaaagccgcccaacagtaatgagatgttctcatccttgattctcccagcctcaaacaacacagcttactttttttttcccttgctcagaaagtacctgtaatttaacaaacagactgcctgtaggtatagtgcaattacaaatgctctaatcattgtacatacatctctcttgatattgcagcatccatactggctttgtaatcattaattttttggcagattgaatgtgctgtattgatatgtatctatgtaattgtattgtatgtctatagctaattcacgttttgaataatgttattttatttacttttttaagagaggagaatgtaaatttgtcagtttatttctgactagggatattttctttccatttagaaaagaagaaaaaaaaaaaaccttactgtcatacagagcggtactagcgtcgtgctgtataaaatcatttgcacattcctgagtagaggtatactgat

SEQ ID NO: 5470 - DNA, 1185 bp, Homo sapiens
actaaccaaggcacacagcttggtgagcagaatgctgactggttccaggccccaggttgatctccaccacatgtccctttgcacaaggcccaaaatgcacaaccacatagggaggccctgcatagacgtttgccttgacagtggactagttcatagatatttgtagccagttgaccaaatccttattttacctccccacttttcattcccaaggtaaaaaataaagttcatctattaaaaaactaattgtatgtgccccaccttaacagtattcttaaggagctctatttttttaaccacttttctctccctgtaaattatactacccacccttcctttttgatatctgctgtagcaaattgtaaggcagcactctgcccacaggacgtggtctttaaaggagtcatttcctcttccatctcctccaggccattcccatcgtgtttttcgtggcactggcaacaggaaggcacactgaatagcagtgctgaaaaggcactttgttgtttatgttattactgtgggtttgtctctgcctaataattagcgtttccggctttctgaatttatttgccaaaatatttgcaggactttcgtgaacaaataagggatgtgtttcttgacataactgaccactgccttgcaaggctgagcgagagatgtttctagacataatagaccactgccttgcaaggctgagcaaacttctggctgtcggagtttttttagatggatttgctcagggaaagattatcctagtaaggcaaacaccttctaaatcactaatctggcattgatgctatctcagcgaccacagttcaggaagttcgaagtattccagtgttcctttcaggacagggtaggtcattactgaggggtggcgagttcttgggtcccaggggcaaaagtctagtcctgtctgagttccctcccagtgaagttcgtgagcctcagcttcctcatctgtaatgtgagataatcatatttgtcttgtctggctcatagaattgtagttgagggttaaatgaaagaaaatatatgtagaagtgctttgctaactctaaaacattacaaaaatgttatttatattagactctaaggatactgttctctgagggaggattaaccaaggagagagccttgttcactatatttaggttaaaagggacgtgcttcactctctgc

SEQ ID NO: 5471 - DNA, 1189 bp, Homo sapiens
aatataaacattcctgtacctgtctttggtgaacataagtctgcatttctttggagtatgtatctagcatttggaattcctgagtcagaaagtatgcatataatcagttttagtacgtagatactgccaatgagttttccagagtgatcataccagtttacattcccacaagctgtaagagttctagttgctccacatccttgacaacagcatttggtattctttttgttttagttattctcatggctggtattactagttttggtttgtgtttgagactgggtctcagctatgttgcccaggctggtcaagaactcctgggctcaagcagtcctttcaccacagctgggattacaggggtgtaccacctcacccagtagtctttttaatttggctattctgatggctggatagtggtatcacattgttgtttgaatttgcatttctttgataactaagcatcctgagcacttttttatatgtttactggctatttggttatctcttataaaatacattaattttttaccctttttccattggcttgtctgatttctcattgttttgtaggagttccttttatattaaggacatacatctttgttgagtaaatggcttacagatgtctattttgtggctttttgttttcttaatggttctttcagtgaaagttctcaatggtaagatagcccagtttataattttttccccttctaataattgcttttttgtgtccttttaaagtaatctttgcctacttaaggtcatgtagataatttgctggattttcttcgaagttctttattgttttacattttacattcagatctaaaatccatttcaggtggattatagagtatggtataaggtaaaggccaagtttttatgttttttatctggatatctaattaacccaattcatttattgaaatgaccatcctttacccagagcaatacagtgtcacctttgtcacaaatcaagtgaatgtatatgtttgagtttgtttcgggactctccattctgttccattgatctattttgtatatctttgtgccactgctgtgctctattaatgactgagctttgcaatgttttaatattgggcagcagtagaagtcactcagtgttgtttttcttctttgggattgcacaagagctgaatttattcctgtgtacttttaaagaaga

SEQ ID NO: 5472 - DNA, 1227 bp, Homo sapiens
gtttttctttctacattttttttcttcttgttcatcttgagggatagaaaggaagttgctgtttttagagggctgccgtctttccaggaagtgtgctttatgagtcttgatgactgtaattaacacatgtgaagtctttcatagagagttataattatagaatctcagttaagaatgtgctttaaagtccaagcatgcaccccatacttgagtggcgtctgtgacatccccaatttgtcgttaagtctgttcccctctaaattcagtgatgagaacattatcccccaattaattccatcttcagtcatctgtttattagaaatctttcattgagctgaaatctgtcctgtaactagcttcagattctattcctggggaacacggagagactggaacccactggaacacatttgtttctcccagtaattgaagttggcctcatgacacccttggggatggctttcttccttttatgaaccatcgtgagttcttgccatcatttctcataaagcaggaatgaaatcttgttccttaatatcctgattgttctcatcttttaaaaattacctgtaatgaaacccagcacttgatgtgtgccttgatgaagtcagagtagataattctgtctttcctccctgacattcgtgtgactctagaaatctttgtctttttgtctaaataaattatcccaacaattacagcaattttagtgcaaagggcactcaataactttctctaccagtaccagttcatgtttgtttcatttttcttgatacagcattgcactgctagtcctgtttttgatctgtggtcatctgtgatgtgtacatagtcttctgcatttttccttttccctttatcatgtatttgcttggattttttttcaattctgagagtttttactgctattgaatttcatcctaattctgggaacatccttccaagatcagattcatttaaactttattcccaatttctagcatttgtaattctaccctgttcattctctaaaggaaagtagaggaacctgttacaataagatttgtagttagatcagggaaaaacaactatttttgttaatactgtcagtaaagatagggaagtttttagatttcaagacagattgccatagtctgtcattctgtatctccagttgattccaagtctttattactttgttgtttacttacttaatgggcatgaagccaataataggctacccacatt

SEQ ID NO: 5473 - DNA, 1199 bp, Homo sapiens
aacagttctccccttctaccatgtgaagagacagctagaaggtgctatctataaactggagagtgggccctcaagaatctgctggcaccctgaccttggactttccatcccctagaactgagaaataaatttctagttttataagccacccagtttatggtatttgttaaagtagcccaaatggactaagacatgtgctagtggatatagtttccaaagtgggcaactggtggtgcacatttgtggaacattgaggaatatcatggtacagtgatgcagtggcccctcaggaagctaatttctatttttagacatgtgggcataaaaatatgataggagttctgaaataaccaggaattcagatttcttatggtgagctatttcttccgtgatctttccctatacccatatgtcaaatcatgctaagggtgaggaaagaatgatgataaatatatcattgcaaattgagtgaagccaacatttttaaacaacattattattattttttttaagacctgctttgtgtgaggcaaagtgctagattttctgggagaaacagaaaaaggttaaggtgaggttgagaaatatatccaactaacaagaaaaaaaaaagacaagatttgggccctcagaaaacttgcattttggtctttcagatcacttttttaaatctagccatgcatgagttaatttttagaatcctgggttaaggaactcatgggtaaaataatgagatgggtgacaacatgggctgggcatgtagtgaggagaggcctggccatactcaggggtgttgttctcactccaggcccatgcctgacacatagtcccttatgagaaatccagccaaagctaatctctctgagtctcttcatcacaaaatatgtggaatagaaaatatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagagataccatttgacccagccatcccattactgggtatatacccaaaggattataaatcatgctgctataaagacacatgcacacgtatgtttattgcggcattattcacgatagcaaagacttggaac

SEQ ID NO: 5474 - DNA, 1216 bp, Homo sapiens
tatgaattataaagtgatccaataattttcttccaaagatgtgcaaagggactatgtagcagtttattacctgttgtgtaattagctccgggggttactcttctagaatctaaggtaggtgtcagtttctctagcttgaggtaaagcgtgtctgtaaactgtggcttacagtgagcttgacatctcaagtcctcaggactttcttgctttgtcccatcaaggaccctttccttagggaagataaattcattgtaaataaatgacttaatcataagtagaagaagggagaaatgtttaatcttggccttttggagtttataaatcaaagacacagtagagatcaagttccttcattaaagtgtagttccaaaaaggaagaatgtggttttggttttaaaaaatttttttatttttaatttttaagagtacatagtaggtgtatgtatttatggggtaaatgaactattttgataccggcatatagcatataataatcacattcgggtaaatggactacccatcaactcaagcatttccctttttttgtgtgggttagaaactttctagttatactcttttagttacttttaaatgtacaataaattattgttgactgtagtcactctgttatgctatcaaacactataccttattcattctgactatatttttgtttacagaagaatatgttttgttcactgctggtaccactagcacctaaaacaatgcctggaatatagtagaagaaatgaatgaatgaatgatggaacagctaaaggagtggtttaattttttcattttattgcatttcatgtagcatcacatattctgagtatcagccacctttatataagctgtcttcgtttctgagtgcttagggagggcctggctttatgctgagcaaaaaaggcctagataggcaatcagagagtgggagttcttatctcagtctgctacaggtccttgagctgctgattggcatttttaaaatttagaattggattcatactttgccagatgatttatttctaagatatctttcaactcttaacatcatatgatgtttaaatgaccagcttaaaaataaaattcatccctacttccattgctcggtactataggcatgccattttagtaagttaagttttaagataatttttataagaggaaatacagccaggtttttttttgtttttgtgtttgtatttttgtagaa

SEQ ID NO: 5475 - DNA, 1197 bp, Homo sapiens
tgttagtctgtctattgtcagtttatttcagagaaacttcagagggcagagggaaacttttcccttcaccctaacatggaacactgccatcaacaaaagcaaaaccaaagaaaaaaaaatttaagctgacaggatgataggaaccagaaagattaccttcaaataaatgacaatttagggcaggcacagtggctcacgcctataatcccaacactttgggaggctgaggcaggtggatcactcgaggtcaggagttcaagaccagcctggccaacatggagaaaccccatctctattaaaaatacaaaaattagctgggcatggtggcatgcacctgtaatcccacctacttgggaggctgagaggagaatcacttgagggtgcagtgagccaagattgtgccactgcactccagcctgggcaacagagcaagactctatctcaaaaaaaaaaaatgagaatttgactgagaactggctttttaactgcaacagtaaaatcaggagacagagggagaaatttcttaaagacattgagagaaaataattatcacctggaattctataccaccaggagtgggacttgtggcttaatttgatgcaacacagcaaaccttacctggcctagacatagacatgattgacagattgaatggcttgtgtgaatgatgttaatataaagacttttcagataaatgaagacagagttttctaaaagcagttgctagttaaaagaaattttaatggatcttcttcagatgaaagaaaaggttttacaaatggagagtctgagataaagaatataaaaagcataaaaagagcattgaaagtgctaactacatggataaattctaatcaaatgctgactacgtagcacagtaaaaatagtaatgtgtcatgagtttaaaaacacaacttttgtttctttttccctttcaagtaatggaagcatgaacatatccactattcagctttgttcctgcagatgaacaatgccatggtttgatgaacaaatgggaagaaacctgggcccctaaatgactgtatgaagacactttgcctcctgacccactcaccacagaactagtatataaaagagaaattgactttcaatatcttcaagtcattgtatttttgacattagagtgtacccacatctaaattacatgccctagcatttaattttgatcactcactt

SEQ ID NO: 5476 - DNA, 1314 bp, Homo sapiens
ctctgccactcgggttcaaatgattctcctgcctcagcctccccagtagttgggattacaggcatccgccaccacacctggcttattgttgtatttttagtagagacggggtttcaccatcttggccaggctggtcttgaactcctgacctcgtgatccacttgccttgggcccccaaagtgttgggattatgggggtgagccactgtgcctggccggaaatctttactttgttagtatctaaatattaccggagtatgtttggtctgacataagaatcccacctctgaagtcatcttctggtgactccattctagatttttaggggagtgggggaagcagggagaggggtgagagggtggcatcctccaccctgtagttagattccttcccctctgcttagcctctctcatcttcttttaattagtgccgtgcttaattacccgctgcacttgcttgtgtatgcatcattgcattccccccaccccccacccagaagcctgacacagctcttactctccaagtaatgatagtaattgctggtagggcagtcctgttcctcatccttctccaagcacatttcttatggcaggtgtctagttcctaattaagtgctaatgagcatgcctagtggaccgtgatgccactgcaagcttcttcagttttatgtctcactattgccaagctcttaaaaggtgacagagcaagaattagtgtctttgggatgacaggaaggtgattttatgcataaagaaattgttattatgatctcaaatggtgaatgagtagtttatactttccaagaatgctatgaatgctgcctgttctgacctcatccccttttccattttgcttctaattagaaccatgctctctttgaaaagaatgaaagtttataaagatggttggctggctcttagacatttttatttatttatttttaaatagagatggaatctccctatgttgcccaggctggtctcaaactcttgggctgcagtgatcttcctgccttggcctccaaagtgttgggattataggattatagtgagccactgtgcctgaccctaaacatttttagaaaagttggagtgcttgaaaattcattgtaaaatttccacagacactgatttctgccttaagatggtgttttctctaacttttgaggctgggaactgtgtttgggattccattaaaaatcagtgggctgggtagaaatgactgaagatctggcatgaagatttaatatgttcagtgcacgcaaagggataataaataaaatgagtaattgagtcccaaggaagtgagcacaaat

SEQ ID NO: 5477 - DNA, 1199 bp, Homo sapiens
ttctctagtaaagaaaggagttcaggacgggctcggtggctgacgcctgtaatcccaacactttgggaggctgaggcaggtggatcacgaagtcaggagatcaagaccatcctggctaacacagtgaaaccccgtctctactaaaaatacaaaaaattggctgggtgtgatggtcggtgcctgcagtcccagctactcgggaggctgaggcaggagaatcgtgtgaacccaggaggcggagcttgcagtgagccaagatggtgccaccattgcaccccagcctgggcgacagagcaagactctgcctcaaaaaaaaaaaaaaaaaagaaaagaaaagaaaggagttcaggattagaatttgccagccttccaagcaaagtgcaggtcccattaatgacggagaagtgtgtgccgtcttcccagcagaatgagacctggggaaaactgggtccttctcatctggtaggataagacatcatattgccaacagacaacatcagcagggcagcagcagtatcaagactacatgaataacctgtttcatcagaccctcccagggagatagcacttgggctcctacaggacccagttacatggggatgactgtgtccctgccctttggaaaatgcccagtcgtgccagggaaaggcttcccaggcaaaggcaacgtgctaatctttttaaaatatgtgactaaaagcaatctacacttttatatttcaagtatattgtcattttaaactgctgtattatcaaattgcctcagacagctttaaatccaagactctggctttcaaactctttggacagcaactcacaaaaaaataagtaaaataatttttatcataaactaatatacacaaacacacaaaactaatacaaaagttttgtgaaactttcctttcctttgttacatgtaatacatctaatattatctacttcagttagttttgttgtttcttaagtgcttttcacaattcccagaattattttatgatccaggacctgaagtttgaaaaacactattctaagattatagattccagctactctatccaggagttgggtatccaaattttttaaagctcattaaaatgcatcatcaaaaagccacatttgctgaagaatcctcaggccccatcaagagcattgtcttggagagtctcaccatgactcatcaaatgaatacccagctttcc

SEQ ID NO: 5478 - DNA, 1158 bp, Homo sapiens
cttcatttagaggagactgttctctcacctgggtcctggcttagagaatcctgaagctttagccttaaagtaggggtggagaaaatgaggagagttttatccatcagctacttccgttatagacttgtctgagatggaattgcaggttattttaaatgagacagatattgtataagcaccagaaatagaacaacggtgtctgttagatttgaggagggaaagtcttcttttagaatatgtagtgttattttgttttactttttatttttatctttttttttttttttcagatgaagtctcgctctgttgcccaggctggagtgcagtggtacaatctcagctcactgcaacctctgcctcttgggttcaagtgattctccagcttcagcctcccaagtagctgggactacaggcacatgccaccatgcccctctaatttttggatttttagtagagatggggtttcaccatgttggccaggctggtctcgaactcctgacctcaagtgatctacctgccttggcctcccaaagtgctgagattacagatgtgagccactgtgcctagttgttttctttcttttttttttttttaaaacgtgtgcattgtgcattgtttcccggtttatcgtactaaaagaagaaactattttgtgttctaataatttatcactgtgcaggtagtttggcttttggtaaaagacaacctctgtttccagtttgtaactgatgtatcattctccttgttttccctgcccttaatttaatgtggttacgcttctgttttctttccttaaattcacttgcagcttttctccccactctctctcttaatgtcacaagttttgcgtgaaccattccctttgcctctcccttgacttctgctctgcctgctacaatctttggggtttacagcccactaagcagtcccactggctatgctggagaaagcaagcatctttttcatgcctataggtggcatgtacagactgcaccctgcagaggagctgggaggcaaagcttatttcttggaagttttcagtcacttgcaaggagcagctatggacacagtgaagcgcagaggtccaaagagaaattctgtcattcaagaaggaatgaaataaaggcttattaagcaactatctgtttatctatatat

SEQ ID NO: 5479 - DNA, 1316 bp, Homo sapiens
ataaataaataggaaaataagaaagaaattcctccacaatctcaccactacatgaataaaactcttttcagtcatccctgtacttaccattgtccacattcttccgtcatttttatttttctgcaatcccaggatagacccagttttgattcctacctttgttcaataacactgtattataaatacatttccatgatggtcacagcctttaaaattgcaattattattgttgcttcaataacaggaaaagataaatgtagaaagtattttttattgaatatttcataaggccaaacagaaatggaaagtgctttcattatagtcaacaagccaaatctctggcttttctcttgcttcattgcctttccctgagaaaccacatcctgcacaaatccaactctgctcttactccacgcctgttcccgtgctgctgaaccaggctggaagaaaaacacagccacacatgcctgtctcactttcacttcctgaccactcaccccaagaaggctcataatgctgcgtagcaatcattctatatttctctaatctatttactctcccttctcttaggcgattctttgcattctttaacctccaaactctgacgctgcctcctccagcctctctctcaggggataactacatattctttcactgagaaatgagagacaatgaaaagagacttcacaaggccccggtgccacctctcatctacctccatttgttctgatatactctactttccctctagttattaagaatgaattgaacatgctgccctttcaggcctgtcctttctcggcactgattctatcctctcaccagctcaaggattttcctccagcaattccctaccatttccactatccccatctcttgaaacagtattcttttcctctttacttgactcttctcattagactacaaatgtgctgttaccacttgcctacacacacacacatgcgcatgcacacacacacacacacacacacacctcaaaaaacttcaccatctatctattgctccatttcttgtcttccttgtcaagcaaaattctgtgagtctagtggttctcaaagtgtggtataagtaccagcagcattagcatcatctgggagcttgtaagaaatacatattcttgggccttactccaaatttactgaatcaaaaattctgggtgtgggcccagcaatctgtgctttaacaagcctgcaggtgattgtgatctatactgaatgttgggaaccactgtttacgtatagttgttgactccaatttctcttctctcattctctttgaaacacactccagccaag

SEQ ID NO: 5480 - DNA, 1212 bp, Homo sapiens
agcttactatggttttgggggggaaactggcccctttcatagttcactttgattacatggcacttggcacaagtggctctattttggtttgttgtggtctgctggggcatagtgcaggaggctggtccaaaacagtggcctcctggccgggcgcggtggctcacgcttgtaatcccagcactttgggaagctgaggtgggcggatcacgaggtcaggagatcaagaccatcctggctaacacggtgaaaccccgtctctactaaaaaatacaaaaaaaaattagcggggcgtggtggcgggcgcctgtagtcccagctactcgggaggctgaggcaggagaatgggtgtgaacccgggaggcggagcttgcagtgaaccaagatcatgccactgcactccagcctgggcgacaaagcaagactccgtctcaaaaaaattaaaaaaacaaaacaaaacagtggcctcccataaactttgtttaatggcagttaataaagtaattaatgtaattcatgtgtatttcaatgccttttttttttctttttttggaaatatttttcgtagacgttggaacttgccaggaatccagcaatgatgcaggagatgatgaggaaccaggaccgagctttgagcaacctagaaagcatcccagggggatataatgctttaaggcgcatgtacacagatattcaggaaccaatgctgagtgctgcacaagagcaggtgatccactggctccaaggttcaggccaaggagtagcttctgttttaacacaaatatgtgtatgattgagggtagcttttatatgaggaatgtggttttcaatttttaaaaagttcagtggccgggtgcagtggctcacgcctgtaatcccagcactttgggaggccgaggcgggtggatcccgaggtcaggagatcaagaccatcctggctaatacggtgaaatcccgtctctactaaaaatacaaaaaattagctgggcgtggtggtgggcgcctgtagtcccagctactcgggaggctgaggcaggagaatggtgtgaacacaggaggcggagcttgcagtgagccgagatcgcgccactgcactccagcctgggtcacagagcgagactccgtctcaaaaaaaaaaaaaaaagtttcatatcttatttaaaacaaaagcttattctttgtgattttttatgtcttttattacagtttggtggt

SEQ ID NO: 5481 - DNA, 1206 bp, Homo sapiens
tttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgctagatttgatgtgtgcccgatttgaacaagggttgattgacacctgtaaaatttgttgaaacgttcctcttaaaaggaaatatagtaatcttatgtatttttttgtgtgaagtgtttttctagcatttataagtgaaagctggcaggggtggtagttgggctcataattaacgtggtaatttagcaaaatgagagcctagtcatccaattttttttttcttatagtcagccagagctttcctcattacctatgagaaattttgagtgagttacttggttcctttctctaaaatagctttagtttgatgtttgagaatatcggagataatgtaaaataactgcagagtatggttcccggctcatatttctgaagtactacttattaacctccagctgtccagaaagcttgaaaactgtttttgttttgttttgttttgttttttgagacagtgtcttgctgtttttcccaggctggagtgcagtggcataatcttg

SEQ ID NO: 5482 - DNA, 1185 bp, Homo sapiens
ataaaattttcccactttattttcttttgttcagttcctggcagtacagatctagaatgcagattagtgtggtcagccaagtttatcattcatacaatgctaatcagctttcttaaaaatgttttttcctgattataaaattaatggggattaagctgtatgtaattttatatgtgttctttttcccaacaaaatgtgaatgtatttctttgtcattaaataattcttaaaaatggtttctttaaagatttcatagcttttcatttcatggtggtagtgctatgtatttaactttttttcccattttgaacattttgtttttttcaaaatataaaaactcagtggtaaactctctgccacataaatctttgtctttatttattttgttacttattgatgcataaaagatgtacatagttttggggtatatgtgataatttaatatattcacttaatttgtaaagatcaaatcacagtaccggggatattatctccttaaatatatggcttttctttgtccttatttatgattatgtccttaattctggaaagtaaaagaagtggataatatggtatgaacataccttttttttttttttgagactgagtttcgttcttgttgcctatgctggagtgcagtggcgcaatctcggctcactgcaacctctgcttcctgggttcaaacgattctcctgcctcagcctcccgagtagctgggattacaggcatgtgctaccaagctcggctaatttttttgtatttttagtagagatggggtttctccatgttggtcaggctggtctggatctcctgacctcaggtgatccacccgccttggcctaccaaagtgctgggattaccagttttgaacatctttttttcttttcttttgagacaaagtttcgttcttgttgcccaggctgtagtgcaatggcacaatctcggctcactgcaacctctgcctccttggttcaaacgattcttctgtctcagcctccctagtagctgggattacaggcatgcgccaccaggctcagctaatttttttgtatttttagtagagacgggcttctccatgttggtcaggctggtcttgaactcctgacctcaggtgatccacctgcctcagcctcccaaagtgctggaattacagctgtgagccaccgcacccagcccgaacatatc

SEQ ID NO: 5483 - DNA, 1178 bp, Homo sapiens
tgacctcataaattttcttaaaacaatatgagatttgtgtgtgtgtgtgtaattttttttttttaagcacaccagctatcgttggtattagtgtattttatgtgtagcccaagacagttcttcctcttccagtgtggcccagggaaacaaaaagattagacaacccgatttacacatcttttgaaaaaattcccagcatatagcacagtatgtggcacatgactgtcattgaaacaaatagggggtcaattataaagggatgaagtgagtcattgaaatttataataaatagaaaacaggatgtttcattcaggctatcgcaacataagacattatttttaaaaactgagaacattagtaaaattcacctttacagtgctttccaaattttgaagcactttcttatatggtcccatgggtttgtcaacagctgggacagccttagagagatgttaaataagaaatctcatttactttttctctggtgattgaaatactttatataagtcacattctaccattggctatgcatattgtagaatgcttacctctgacctacttatagcacattttgtatcatagtggatgacgtagtagatgaaagtgatgacaacgatgatattgatgtagaagctgaaaacgaaactgagaatgaagatgacctagatcaaaattttaaggttagtataaatttctgtaattagttagctttataaatgatatactacagttgtaaaacaaaaattgggtaaataaatatatatgtaattttaggttttactttgtccacatctttttaccatgaatgactatgcaattaaaggggtagatgatattggtttaaatccactggtctgaaaaggaccttaaagtaacttattttcactctctctgaccagaaagattttatctaacctttctgccttagattttgaaatctacaaaattgaaggaaagtgatctgaaactctcttgtggcaacttatttcaaaatgcattattatcctttgtcagcagtcttttggggatacaaaaacagtaggaaaatattctataatggatttgtttttgtgagaattagtgtttgcataatgattcttaggtttcagttaattgaacaaggaagtgaaaaaagtattattgagaaaatataaaattattgtcatattacataagat

SEQ ID NO: 5484 - DNA, 1120 bp, Homo sapiens
ggcctatgtacaaatatttgtatgataaataggaacagggaagaaagaacataggtggaggataggtaggcttaaggatctggtgacaggaaagtgagtgtattcttgctggatttataccagttatgaagcagggcactaactgagaatggagtcggatgggaagaaggattatcagagttttgaggagagcagagtaagtgtaaaaagtctttgagagtggaaaggtgaactttccaggtgtgatgtaagattactgaacagggttgaagggatatttgtgatttgtggttttctgaaatagaatgtgtttctcacttaagtcagtagaatttaagctatagaacaatattaagctatattaagctatagaacagagtaaggaagtgcgacgtgtaaatgctttctgtttttaaaagagtagaattgttttttaaacagtgatcgttatagtattgaatttacaccattgatttagaatgtgccctaacattctacgttctttttagccttaccaataattctaggatcgtaggactcctggctcaactggagaagatcaatgctgagccttcagaatcagacactgcccgatatgttacatcaaaaattcttcatctggctcagagtcaaggtaaacattgatctcttctttgtttttgaaatgcttttttaattctttaaaagtggatgctaaaaatgttcaaacttctaataatggatgattttccacaaaaattgaactttcaggccgggtgtggtggctcacacctgtaatcccagcactttgggaggccaaggtgggcagatcatgaagtcagtagttttgagaccagcctggccaatatggtgaaaccccgtctctactaaaaaatacaaaaattagccgggtgtggtagcatgcacctataatcccagttactcgggaggctgaggcaggagaatcactggaacccaagaggtggaggttgcagtgagctgagatcgtgccactgcactccagcctgggcgacagcaagactccgtctcataaaaaaaaaaaaaaaaaaatcaaactttctcaaattgactcgagtggaaaactgaataactttggaggaaattgatcttcaaagcatgg

SEQ ID NO: 5485 - DNA, 1199 bp, Homo sapiens
gatgggggcctgtgcttaggaagagctctctgtatattgatgatctggtgagtaaataaggaaagctcttcaaacatcacatttcatggatatgtttaagattaaagtttaagagtgtgtgggtgaaatatttggtttaactggaattaaataactttactgtggttttcagcaagatgagtggtatttggagttttcctttgggactggaagaaaaaagcaaaaaaataaattttaatttgatttgcatagtgtggcctgatcgtttaagtgttgttagaaagagagatgactaaaattagttgagattattatattatggattaagtatattgaccttattttcattatgattttttggtaccattatgtgttatgagaaagaaatagaaaaagaggcctccctgtggttggcgaagggagtttttgatctttatttcgtgggcgtgatgatgaggggagggaggtggcttacttatttgtcactagcactttgatttgctcagtgtacatttttgtgtataacgttctccccactgtgcaaggcaaattgacaaattgtttattaaataatttgtgtgacctaggaattttaaagaaatgctctgaaaaactggaagtctgaagtttttaaaaatgaaatgtacagactcatctatcttgtataactgctattgtttttgccaaaaaatgagtgaatgattgttttttggaaaatttttcaagtcctgattttatgtctgccttggatgtagccacttcctgaaaacaagtcctaatgtaaaatggacatgtaggaagatgctgcttatatgacatcacgtgtcactgagggaagattgggagtggaggcaggagtttggtggcaggaaaatggaaatgggcagatatgtggcacaaatgcaaggtcattctaagcagtgaattactagtagaccagtatctaagatttaagactttacttggccaggcgaggtggctcacacctgtaatcccagcacttttgggaggctgaggtaggcaaatcacgaggtcaggagttcaagaccagcctggctaacatagtgaaaccctgtctctactaaaaatacaaaaaaaattatctaagatttaagactttaattggccaggcgcagtggcgcgcgcctgtagtcccagctatttgggaggctgaggcatgagaatcgcctgaacctggg

SEQ ID NO: 5486 - DNA, 1159 bp, Homo sapiens
caagggatcacgaggagcgccatcaccgtgcaaggtcgacagcttccgctcaaagccctgtggcccacgcttccggcctcgaccgactacgtcatcaccaaaccccgtgatacctcactccaccttcaggtcctccgtcccaacggttccgtgtcctggaactttccacgttcctgcgcacgcgctctgcggcccttaacgtcccgacttcgccctcctctggccacgcccctgcccgttaagggccctgccacccccgtgacgtacctatcttccctcgggcaacctcgcaacagatctctgattggctgacccaggaagcggactttgcgaggcggcggcgacgataggctggcagccggccgacttccgcagaaggtgattggtcggcgctgctgtccaatcggcggcgggctgtcggattcaaatccggatcgttgggactgcggtcgttagtctccggcgagttgttgcctgggctggacgtggttttgtctgctgcgcccgctcttcgcgctctcgtttcattttctgcagcgcgccagcaggatggcccacaagcagatctactactcggacaagtacttcgacgaacactacgagtaccggtgggcgcctttcttagaccccgagccggctccctcagccggggcccccgcgggcggggcgacccaggcatagtagggtcgggggtgggggccggggcctggggggcggagcccggggccggagggcgagggccggggtttggggtcgcggccacctggcgccccgcgcagtcggacatggttgggtgcctggccgcgccgggccggttgggcctttgttcggtgtgcgcggagggtgagggaagagtgcccaccgggccgcatttagtacctgggtaggaaccggcgcaacttgggggtcatggggtcctcggcgacgcggagtgaccatcccgtcacttttttctcggccgtggccgaagtaattaggccgttcagtagctggtctcagttccagttctttgaaccagtccaggaaaacccacctggtgccgtcctttttcctttagcaaccgtgacacactttccctgtcgctgacggggtgatgcagcttttactagtttgtggtttagaatggtcaaatggtcattttcatctgttaacacagagg

SEQ ID NO: 5487 - DNA, 1196 bp, Homo sapiens
tttgggaggccgaggcgggtggatcacttgaggtcaggagtttgagaccagcctggccaacctggtgaaaccccgtctctactaaaaatagaagaattagccagtcatggtggtgcgtgcttgtaatcacagctacctgggaggctgaggcaggagaattgcttgaacccagatggtggaaattgcagtgagccgagatcacaccaccgcactccagcagcctgggtgacagagcgagactccgtctcaaaaaaaaaaaaaaaaaaaagagggttcccaggctttgtaccacctttcttgtgtttctctgcagtgggacaaaagttgcggttagtgggtagcctgaacttagagctgaagaggtgttgtttcttctattcctatgaaaaaaatagatgagcttctgttcttgaaagagccgtttaagaaaacatctttccaaaattgataatgaaatcttgcatcacccaataaatctgaaatttttggtcttttgattcagagaatttggaggcattcccattttgtgaagtcattctttcaaaaagtagacttcatttaaggatatgcatgttatagtaaccttccttggaacttttttttttttttttttttttttgacacggagtctcactctgtcgccagactggagtgcaatggcacaatcttggctcatggtaccttttatgtatgctaaatgatgcttagagtatgaatgaaacaacagtaacaatgtaaatattaaactcagtgttgaacatggaagacatacttgcatatgaattggttaaaattgtgtggttaaccttatcattaaaagagtatttattctgataggtagaaatttaaaacataggttacagtgaaattgaagactgcccagatgaatgtgtaagactccccatgttttctactttggtaattgatgaaaatgttattcttgtaggccaaaacatttaatatatacttactctattatgcctgcctttttcactgtgactaataaaaaacaccagaaggatttataagacagtggatcaatttaaaaagaattcccagataactaatatgtgaaataaagcaaaatttagcaaaagggtgatgtgacatatttctgaaattcttttgagaagtaagcatttgttggtaatgaggatgtgattaatcctagaagatagaaagatagtggctgtagt

SEQ ID NO: 5488 - DNA, 1179 bp, Homo sapiens
agtgtatgtgtggtgtacgtgtgtgttatgtgtgtttatgtgtgttgggggcatctgtatatgtgttgtgtgtggcatgtgtgatgtttgtgtatgtgttgtatgtttgtgtatgtgttgtattgtgtctgtgtatgttgggttgtgtgtagtgtgtgatgtctgtgtatgtcgtgtatgtggtatgtgttgtgtctttgttgtgtgtggtatgtgttgtgtgttgggttgtgttgtcatctttgtgtgatgtgacatttgtatagtttttgtctctctgtgtgtgtggtatgtgttgtgtgtcttgtgtgtatggtgtgtgatggttgtgtatgtgttgtgtggtatgattgtatgtgtgtggtgtgtctggtgtgtggtattgtgtgtgctgaatttgtgtggtgtgtgatgtttgtgtatgtgttgtatgtggtgtttgtgttgagtggtgtttggtgtatatgtggtgtttgtgtatgtgttgtgtatggtatgtgttgtgtggtgtgtcttgcatgtgtgatatttgtgtggggggtgtgtgtgtgatatgtggtttgtggtgtatgagttttgtgtatgtgctgtgtgtggtatatgttgtatgtctgtgtggtgtgatgtttgcgtatatgttacgtttttgtgtgtggtatatgttgtgtggtatgtgttgtgtgtattgtatgttgtgtggcatgtgacatttgtgtatgtcttgtgtgtggtgtatgtgctgtgtgtgtggtgtgtgtgcgcacacgtgtgttctgcagctgtgcaccttggagccgtcccaggtagtaagccagaatggaggcaataatgagtgatgagcagtttgttttttccctttttggaggctttgcctcattaacttggaaccagaggttcctgaggccacgggtggcagagtcgaggaggcctccaaagccagcagtggagcgtaggagccagggcgctggggtggagatgggatctttacagcctggaagggacatcctgtgtgtcttgctgcctgccactgggtgccctcctatagtgttggtggctgctccaagcgccaaggcacccccaccatgggcctgaagcctgattccacttccttgctccacaaggctgggccaccctctgcctggtctctccaggctgtgactggatggcttttctccaggg

SEQ ID NO: 5489 - DNA, 1806 bp, Homo sapiens
gacatgagttctgtttgtagagcaaggacttaagatcaaggaggattttgcaaagcaaaaagagtgggatagaactttctgggtaaaatgaacagccttagcatggaaattatttcccagtactcattttcagtttgtggacaatcattcaatcctagacagttctactgtccttccttcctgaggtttaaagtaactaaaccctacacttttctgacaagattttagaatatctttcaattcataattactctttggtgcagagaagtaatgttttcctaaactctcttcagtttactcaaaaacataataaattaattgaggacttaatgtgccacgttggtgcttatcttgaaaatattgctgaaaatcagaaattcacattgccagtagggtctgggattttttctttttgtttttgtttaagtgatttaagaagtttatttcctcatagtaactttcttcccaagtgtgccagtgtttcattaattgttccttcctaggaggaagaaatagaatttctctacaatgagaacacggttagagaaagccccaacattacagaccggtggatcctgtccttcatgcagtctctcattggcttctttgagactgaaatggcaggtgagtctctcttggtctgtcctcccaggaataaggactattctctttgtaactgcccttttgatatttaatagtggaaatattgagagatacagaaaattaaataattgtttccttttacctctcatatagttttgttaaggcttgttaattgtcgtgatatctttgtttcaagaccctggggacttctggcctggtgtggtggctcacgcctgtaatccccagcattttgggagaccaaggcaggcaggtcaccttaggtcaggagttcgagaccagcctggccaacatggcgaaaccctgtctctactaaaaatatatttaaaaaaaaaaaaaaagttagctggccatggaggcgggcgcctgtaatcccagctattcaggagactgaggcaggagaattgcttgaacctgggaggcggaggctgcagtaagttgagattgcaccactgcctgggcaataagagcgaaactccatcttaaaaaaaaaaaaaaagccctggggaattctgtctttagggggtgtcctcgtggtctcaatgctccacagaagagctttagagctggatagccatgggttcagagcccaactctaccacttgttcccaatccagagagttgcctgaagtctgaccgtcaatttccttttttttttttatgggtacatagtagatgtatatatttatggggtacaggagatatttttatataggcatacagtgtgtaatagtcatatcagggtaaatgggatatccatcacctcaagcatttatcatatctttgtgttgcaaacatctcggttataccctttttcttgtttttaaatgtacaagaaattattgttgactgaaatcaccccattgtgccatcagatgccactcttattcagcctatcttgaccttcagtttctttatctgcagaatgcccagtagtgtttgtaaggcttaagtagagacgatttacataaagtagctggcagatgataggtactcaataaataatacttgttattaatgcatttataacttatttttagttctattttcattactaaatagtccccttcttttccagaaaaattagaaaagtcagaagagcaataatgaaatggacattttgctgttatttctattaactaacaacagtgagttcgttgggtaattttacagagattcaaaaag

SEQ ID NO: 5490 - DNA, 1165 bp, Homo sapiens
aaaaagaaaatcatcagtctctcaaagtaaacatgcatgctatataaattaactcagtatgctctgtttggctctaaggagctcctgctattgaactttgtttttgacaggtggtatgcattgggtcagtggcggaacttgaagaactgtcaggagcaaagatctcagatctccacagagagaggtcagtttctaaatgttcgattcacttcagttttacgattctcctattaagacctggtctctagcagattacagagccacacatggaagtgactagcttgctgaattactttgctgatgactcatgtcatattgcagtattgtggcctctgtccttgtgaaatgtgaggtgaatggtgcataacctttcagatggaggattcatggtgctctctgaaagcctttgagaattgctgatatttctgtttgcaaatgtgtataatatcttgtcagggttttgtgtttcctattagcaattaaactgcaagttctgttatgcttacagttaatagaaatgactacttttctgtttgttagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggtatgcctccttgttctttcatcacgtgttttattgattttattttatttagggagtattttactaagtcactgccatttatctactgggtgatggagagattgtggcaaataagacaggctacattcctgccctctcccctccaccaccaagcacggacattaaagtgccttttgagtaggactctcccactacaatagggctgtagttttacaatttcaatgatctcactggcattttggaatatatgtgttacactggatgttaaaatgataaaaaaagttatgtgttcttagcttacgtcagatcatttactcaaatgtttgagtatttgcataaaagacagtagtttgggtgctagaaatttgagggatagttggtaatgtgctcagatattgaggctagccttataaatcaacattctaaaaaa

SEQ ID NO: 5491 - DNA, 1186 bp, Homo sapiens
aacctaagtcagaggtctgagtgccccctcacttcaaatccttgtgtcaaattaattaggaaatactcaaatgtacacctggagacaaatacaatcaagagcagacttcacacgtactgtgctggtctacttgttatgctctggatggaatctggacttctgggaagaaagttcatgagcctagtattaatctttttgataggcagacatttagctatcacgctactacagtgatctaaccaaaatttgtatgtgaataagtgaggttcccaatgagtcacaagattttgactcataggtaattagagtcagatattgtgaaaggaactatcatacctgaagatgaattacacgtagactttctggtaaattaagaggcacggattccagggcattatggtccaagtagaggaaggtgaggttattcagtttctgtaaggaaaatttcatgtgagtgttattgaggttctgtacattctttcacaggattcaagcaatatatatgtgcatatgagtatatgtctatatatacagacttgcatattgatatgaatacatcaattatatcaattgttcgtatggtagtttcttgtttgggttttttttctgacttcacgtgtagtgtattttgatcctttatgatggccagtggagctctgccgcataccccacacttctgtccattcatctgatctctgaatatccggctctaatgccaacttctggtactctttgtgtttgtcttgataggaactaatgaggtgagtccctatgtgggattgaattttgaccctggtgctgccataacctctcctgtacctctggagtttcccatctcagttccaccaatttctagctaagtggttacttcttagaaatgtgtgtgcttgtatgtttttagtagagacgaggtttcaccatgttggctggtatggtatcgatttcctgacctcgtgatctgcccgcctcagcctcccaaagtgctgggattacaggtgtgagccaccatgcccggcctaaaaaaatacaaaaaattagacaggcgtggtggtgggcgcctgtagtcccagctactcgggaggctgaggcaggagaatgctgtgaacccaggaggcagagcttgcagtgagctgagatcgcaccactgtactacagcctgggcaacagagcgagactctgtctcaaa

SEQ ID NO: 5492 - DNA, 1103 bp, Homo sapiens
acctaagacaagctgtgggaaattccaagggtatctaaactgaaaaccatgagcatgagctcagggtaatgaatgccttcctcaagccacagtgtctaccacccaaatgtttaggaaatgcagggtgatcagtgctaagtcttggcaaatattgtgattgtttcttagtagaaacctacaatggtagtagcaaacatatggctgccatcctgggtccttggcctaagtacagatgtcactaactgacctattttttacattctgcatacagtatatcacctgaaggccaagaaaatgagcatggttttgtggagatcaccttccctgtattgccataacaacattcctactagtttgacaactagtaaccagagtggctccatgaagtagaatgatactctaggaagcgaccatgatgtaacttcagacttttggagagtctgtgaagttacatcatggtcgcttcctagagaatcattcagccattacaccagtattatgacaaaacttatcaaatctgactcccagccaacatggagtaatagggactacgtataccttcccacctgaaacaacttaaaaatagagcaacatatatctgaagcattttccaaacattaaacaaagagcagtccaggccagtgatccctgaaaggggatgcaaatcaaatgcccggagagacctgtgattgacctgcttactccctcaagggagttgcagtgaggggaacacaggcagagtccagcagtctccataagttgaaaagatacagctggaaatctgaggacaccaaagagactagtgttcctagggcagagtacagagaggtgagagctagcccagaggaacccttccagagatgtgaagtcttccactgagtactggatagcacatgtatgtaagtaaactattaatacttgagactgggaaaagaactaacctaaaggacaaaggggaaaacaaagcaaaacaaaacaaaaaaaacaggtctctggagcttaaaaaagaccaggaagagtttgtgttccaccagtcagagtggaaaaccttacaattcacagggcatctggtagagtactcagaagagcattagctcagtaga

SEQ ID NO: 5493 - DNA, 1125 bp, Homo sapiens
ctcttctcttgcccgggtttattgggcatctgtcatagaatgccgtggggccaagacatcatggagtatttttagtttccaaaactgctgtttccaaaactgggaggagcacacacagctggctcctcccagtacccacttccattgtcctgcctgtctggaggcactcccatgggatcactttgggctgcttcgggtcagctgtgagccatctctgcctcttcctcctccttcagccccagtaacgtttctgatgttcccatagcagagtcgtctcccaggagtatgctaggctatgacagagatggaaggcaggtggcctcagactcccatgtggtccccagcgtcccccaggtaagggcgacttgacgaccccctggctggttggcagggtttgctctgtgctgatgttcacatgaaacctcttcatctccgcttgtttcccaaggatgtacctgcttttgtgagacctgcacgtgtggagcccacagacagggatggtggagaagctggagaaagctcggcagagcccccgccgagtgacatgggcacagtggggggccaggctagccacccccagacactcggcgctcgagctttggggtcccctcggaaacgtccagagcagcaggatgtcagctcaccagccaagactgtgggccgtttctcggtggtcagcactcaggacgagtggaccctggcctccccccacagcctgagatactctgccccacccgacgtctacctggacgaggccccctccagccccgacgtgaagctggcagtgcggcgggcgcagacggcctcctccatcgaggtcggcgtgggcgagcccgtgtccagcgactctggggacgagggccctcgggcgagacccccggtgcagaagcaggcgtccctgcccgtgagtggcagcgtggctggcgacttcgtgaagaaggccaccgccttcctgcagaggccttctcgggccggctcgctgggccccgagacacccagcagggtgggcatgaaggtccccacgatcagcgtgacctccttccattcccagtcgtcctacatcagcagcgacaatgattcggagctcgaggatgctgacataaagaaggagctgcagagtctgcg

SEQ ID NO: 5494 - DNA, 1184 bp, Homo sapiens
tagagctgaagttggcctttgaaggtggattcaaggacttggtaactgcatttctgcttacagtttcagggagtcctgggctctaatctaaagattctacttgtgcaggccttcatctttgttggttggtgttgaaagaaagggagcgaatggtggctccaggccttctctctgggctgctttgtgcttcgcttgttatgggtgcaggtcctggccttggaattaatcgcaaacaagtcttggacttctcagaagtggtggaagactgtcagatgctcttttcacccaacacagtttaagcagctgagttgtatttcatccactgaaaggaaaatccagttcttgagcttcagaacgtgaacggcttaggaaagtcttagggccaagatcttacaagtggacaatcattgggcactgataagatcttagatggtagctccttgttgaatttctggctcctgcattcagattagcctggtactggttgctcaccatccactgttgacacttacgtttgttttctcaggtccgggcccaccagctggtcttgccaccttgcgacgtagtgatcaaagccgttgctgactatgtacgcaacattcaggacacctctgacttggatgccatagctaaagatgttttccagcattcacaggtaaaaaaaaaaacaaacaaaacaaaaaaacagattcatgggatatgacgttgcatagtggtgtggccaggtttggaagaaggggacttgagggtgcaagctgactggatgggtctgagagctcttgctcaggccactggaagaaagctgcaggttgcaaggccagaggctgaggtagcctggtcatgttccctgccagccaggaagtctcagccacttcacccagcttttccaggctgaataaaagggagattcagttagacggttggtgaggtctcctgctcataagttctcgatcttaacttaataggatctgtatttcagagttttcagaacatgaactgtatcaagtcagtcatatggcattataaatctctgatttgtctgttttcttcaggtgattgtcagggattttcttcttttttggggaagtaggtgtgccaacaagttggcatcagtagaataggcaaggctctgtgaaactcctgctgtgtctctagagagctgaaatgcagccaggcacggtggc

SEQ ID NO: 5495 - DNA, 1089 bp, Homo sapiens
aaaattagccaggcgtggtggtgggcgcctgtaatgccagctactcgggatgctgaggcaggagaatcgcttgaaaccgtaaggcagaggctgcagtgagcggagatcatgccaccgcactccagcctgggtgaaagagcgaaactccgtctcagaagaaaaagagagagctgaaaccctgggcaggaacatccccagtctgtcactgccatccgttcccttggtacagatggcttgagattcctctctgggcaggaccagagaccgagcagagtggaagtcagggaagtcctagagctagaacccagggccctgactaccactttggagttctgctcttgtgactacattgctttaaaagaattcacgtttggtttgattcttttgtagtaatctattgattttccctgaaagttttaatgtcattcaaaattcttctctaacttgaaaagctgtagaatattatacatgtgctgaattataaaaaacattgtgatacacatgaccagtggcacactaatttatgaaggttttcctgcctttatttcagtctagaacagatgacaaagttattcgatttaagagagcaattggatattattcagcgactagtaagcctatgtcatttcatccaccacattacttaggtaagtaaataaaagcctgtgatcaatattgaccatatgataatccaagtaggtttaaatattcaccatataatcttgtaggtttatgtttttgaaacatgattttctgtagttatgccagtaagtatagccaaacttcctgggcagactcagtagcaatccctgaaaatattgaggaggaagagaacttaacagccttcataggatgaagaagaatcagagggcattgtgcagatgaggcagcaggtcgaggggatgttgacgtcttggcagctctgagatatccgcttctaaatacagaattgcctgaggacgtagaagggcctccacaactgcaagtgatttcataaatgcagtgtatttgtagtctctcttttcttgacccctgcctttttttttttttaattcttttttgttgttgagcagagtattgcactgtcgc

SEQ ID NO: 5496 - DNA, 1614 bp, Homo sapiens
ctttggttctggtgtttattcaactaaagtgaaccacttgttacttataaaatgcatacccagatttccctattgggttgttacctcagtgcagttgatgagattttaacattctactgtgcaatatggattgtttttgttttatttccttgtcattgttttttccttaatttattgggaaatcaatcaagtgggaaaatgtgcatgtttatgtatttgtaagaattgattgactaatagtgaaacatctgtggataaaaggtattgtttccatgttacatcaacttagaacttcttgtcttttttgaggcgaaatgttggataactttacactctgtctgaagtcttgctgaatagaattactgtgtgctggcatcatctgggacttcaaaacttggaatatttgcatctacttgtgttttactggccagtcttaaaaatagagtttaacagttacatttgttgaagtgggaggttcagtaaagtggctactgcatgcaaattatttctcaaatctaatttatgagggtatttatccatgtagaaagggattagctatccaaattggattttgcatgttaaaataattagataaccacatacttccgtgaattacactgttataactaaaactatttgtagatataaaatattaaaatggattttgtctaacatcttgatttatgcatactagttatatgagaaaatcaagtcatgatttgattggatgaaacttatttgtggcctaactgaaaatctgaatgagccattaattgcacagaatagagggacaaacaaaatacccacaaggacttgatgattggtagttttgctaaggagagaatgcattgttacctgagaggcgaatctttagaccagttactagagctgcttgtttttgttaagactgaaagcaggtgaatgatgcatgaatgtgtcttctctggcttttttttcctgtagtttcaccagtgatcattaaagaatgggcagcttacaaaggaaagtctcctcaaaccccggaactggttgaagctcttgccttcagggagtggacctgccccaacctgaagaggctgtggttgggtaaggcggtagaggacaagaaccgcaggatgagggccttcctggcctgcatgaggtcggacaccccagccatgctcaaccctgccaacgtgcccactcacctcatggtgctctgctgcgtcttacggtgggtgccatgcatgggagctgggacctgggtccccgccaggtgtaggggccatgaccatggtgtcagatgagttctagaaaggatgtaaagtttattcctgatcaatcatgttgaaatttattgtcatcccatatttatatatgtgatagaaatgtaggttatgtaaatgcaaaatatattttaatttatatgatacagtatgtttataggtatattttgtaagcatgtatggtatgtaaatattatataatgattttaaacatggtttattatttaaatattgaagattttgaaggctataagaggggattcttgttatatattatttggagttcttctgtagggaaaatgtgccacttcttcccccttcatttatttaatcatttacagtcacacat

SEQ ID NO: 5497 - DNA, 1176 bp, Homo sapiens
actgaagatggaagaggagcagaagctagagaagtcgcctctagctggaaacaaagacaataagttctctttttctttctccaacaagaaactcctcgggtatgtgagtgcctggatgggaggggtgacctcgcgcataaccgacatcacacacaccatacatactgcatcacacccactgccttataccacacacacattacacacacactatgcatgcactctgcatctcacacacaccacacactgcatcacacacaaccatacacactgcacatcacgtaccccataaacacacagcctttggctgacacacctctggggactcctctccctctgagctgctgacctcactgattgcagccctgttcctggcacgtcttcatcaggcctagacaccagcagagccacatccctgcctcccaccacgctccacctgtagtgtgggtgtgaggaagcagacatgcctgggtgggactgggctggaagatacagccagcctgcaatgagggatggccccccaggtagggagggaggccgtgggactccatgagtgttagatgtttggctcttgtgagctggtgctgaggacgtgcatgggggacagggtcctggctctcagagcccggtggccagtggggagggcctggtgtgaacccaacatgggaccctgggtgctgagaacgtgacccacctgggagtcaggagggcctcctggagacggcactgagcagagattagggggtgtgtttgggtggtgtgggcatgctggatgagcctcggggtgaggcaaggggtgcggagggctgtgagcccggtggcaacctcgagagcctcatggttccagcggcaacacttgggcctgtgtgtgctcccggtgcgtgggacatgtcacctgctgaggccccaggcctggccggagtcagacaggtcccagcaggaggggcggccacttttctgcagcagccactgactaacttggccaggttgtagtttcctcattgaagagatgagaggagaaggcctctttctgggtggtggagaaagggagcagtgcccaggcagagtcttgtgagtgtcagggagctcagggcaacacgcgaggccattcagccaaggggcaggtctgcggggtcctgtggctgcccagcttcatggccctgggcgtgtcacttg

SEQ ID NO: 5498 - DNA, 1204 bp, Homo sapiens
cattaagaaaagtgttgtcagtaatagaagagacttctaatggtatgtgtttaataaagcaatgtaatttataaaatacttagaaaaatattaatgttttatacttttttcccaaggtaggaatttttattttcctgcatttcatacacaacagtataattcagttattttaattttataataggttgctgttagagccagatctgtctttgcaggagagatttttttaaaatgtgagtaaaacaaagagccatcagcaacacttgtgtggctttgatttgatgtactttttaacactccacgctgatttctggagtcttgtactaaaattgcttagggttaaggagctattttatacaatcttcattttacgactccttcattaacacacactcgagtaattttctagtgtctaacactaattttcagctatttaaatccatggtttatcatctcctaactatgatgaagaccagaatctggagaaaaaagggaatctgcattgtttggaatatctttaaataagaaatcctagagaatggttctggattttacatgtagaaacgttaatcaacagcaataaactctgtgctgacgacatatttaaaacaaatgaggacttaggaaaaaacaggaaatttgaccaaacgactctcctagtaacaggttttgtgtgtctttgttaagagcatcgcagcttgttttaattctttttttacttcctttccaaaatttgatgttaagtttcttcacagttttatatacagcttttatttaataaccactcttcacttcaaacgaactgatttctgtaacaggaattacaaatgaaaggaatctgtaatgaaattgaaatgctgcatttcagtccataggcatattggtgttataaattgctgattagtgagtcttttgctaggctagggcttaaactgctttcaagcccacttttaattggtaacattacttggcattttgtagggtggaaatgccttttgcttaccattcttagccttatttttatattcttaatttaaacttgaccctttgttgtcactgtaatgcaagaaaccattcctgtttaatcttggacagctgcatatgtttagagactatatgcataggttctcacagaaatctgacctaaaacagacagatgttggaactcttatgtaaaaatctattctaaacaatctgggctact

SEQ ID NO: 5499 - DNA, 1210 bp, Homo sapiens
cccttcaatttgctgtgacagcatggatgatgagaatccacaggtacggggcgggagtgctgggttcacagtagacattcagagggcatgaactagcagccttgcattagctgtgggtttcaactcctggtagaccagtttcctgaggtgtgaaccacaagcacaccgcctcaggtgaacctcacgtgtcttctgtacctcagtctcctctttggaggaagtgctcagccgccagttcctggcaaaatcatcacagcagcggcagtgaggaggagagagaagatgggaaatgagccgacaataatgtgtcccagaaataggcagaaagcaacttgggttcccagactttctcctgaatcccagaatttagaacaacaggttattttgtcatcttgggaaaatgccacttctttccgagcaaacacctgcaagttgccagaggctgcatgagcacatgatagaaaactgaagtcttgtagggaaaatgctgcaatcacagaattgagaatacttgataagacagtatgcaggaggctttatgtcactgtagtcacgatgtgcttttagcacagagaaatccagctggttttataggggaatgactagtagacttcttatagcacatattatgcagtattatcaatataattttaaggcctattaagatactcaatctcagtggtgtctagaagaattctacatttaatggtcagtcaagaaaactgaaactgattattttgcaaatttcagagaaagtatatttttcaaattatatgaactacgatatgtttgcttcttttatatctataatagcagttgccataatgtggtatactatttgggctgctaataattttgctgtcatttttgtccagtagttaaacttgtattttctaagtgactaaacatcttgtcaaggatccttaaagacatgtggaataggttctgcggcctcacttgaggcagcacccaaaatgcctgagtcatcacagtcacttccgttcatccaagcacctggccccctccataggctcttcaaattgctctactgctcagcagaatcacaagacagggagagggtttattaaaatcttttcatttttagcttaatttcctttatttttggcatctaaggctttgtgctcaaatgagtttgctggggttgccataactaagtaccacagactgggtggcttaaacaacagagatt

SEQ ID NO: 5500 - DNA, 1146 bp, Homo sapiens
acagtatttgtcatgccagtttataacaaaaaaaaatgcagggattttatttctattggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtacatagtagtcatcaagtcttttgacagaagtatatttttaaagaatttatatgtgatgaatccataatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataacttgttggttatatctttgtttgtagaatgctttttttctttaaaatacttgggagagacagttagtgttggagccatcagaaactgttgtttcatcttgctgaccttgtgacactcttcttttttgctctatctgatggagagagttttaggttttcctcctttttgttttgtataaatagtgggtataagcatagctctgttacatggatgtattacaaagtgggggctgagcttttagtgtgatcatcacccaaatagtgtacattgtacccattaattaatttcttatcacctgaccctatttttgttttctcataccaagaaacttcctaagttaaccatcaaaattagtccttctgtcatctctcttagcatacttatttcccttatgtgatgcctaataatgagggaacataaataaagccaaattcaaagatgattatcatcagtgaaggtgtcatacttctaaacagtgtcaaagataatatggaattgattgaacctg

SEQ ID NO: 5501 - DNA, 1198 bp, Homo sapiens
aacaggatatgtcatggtagttaagagttttagaattaggcagacctgggttcaaatacttactttgctacttaatagcagtatgaccttgagtgtgttgcttaatatctctgtacctcagtttcctcatctgtgtttctgggtaaagtccctgaattaatttctgtaaactacttctaaaggccttggcacacagtaagtgctcaataattgttatgttattattaatactattactacttctgccacaaaaattgtcacgttaatctttgagtatctcatcacagtccacactacatcattcttctatgccgtggttcctgaggaatcagatttgatagaaaactccttaataattgagcaagatttattgaaagatataaataattcagtattctctagttgcattatttaacctagcttctgttaattttaataatacgtaagcaaatgaattttaattttatttgtgttaattttatattcagttttataaaattgtattttagcttcagaataagaattatcacccttcccccatgtctacagcaataccactctgaacacaccacatctcgtctgatcttggaagctaagcagggtcggacctggttagtacttggattagaggaatagctcccagagttgctttgtgtgtagtgacttagcagttggacactgctttccattttattattttggcatcatttgcttaaaaaagacttattaaatgaaatattatttattggattgtaggaaatgctaagttcttatgtactttccctggactctgcataatagcataactcagttctctgacatctttcactaccaaaatgaatttttgaaccattatttcacctttcataattttgaagaccaatgtttgtaagaaatatcaagaattatgttgccaccttaatttttaaacatcttctggaatcttagggctgatgccaggactctttagattcattggcacctttgatgaatggcctctcaagtggaaaactactaagactgctcagatgcaatttgcacctagcattgtcatctcgtaatatacaaaaaaatcaaagggagacactgtaattggacttagtaattggaggcctaatttcatatttgaaagttaaaaatggaaatcataggattaaccttcacccaaaggacggacatacttgagatgaatcaagta

SEQ ID NO: 5502 - DNA, 1201 bp, Homo sapiens
aggaaagccatgactcactgccatgccattccttaggccttgtagtccctagcctgcctatcttctctgtacctttcagagttttacgtttatttcctatgtaatatccagagttttagctgcacttagtggaagaataagatgtgcatctattcctgaattgagttttttaatgtatgcattactttatttagctagaatgtactaacactttttaaaaattatattaggaaaatcttgcagaagtagtatttgagtatcaaaaaaaagtaaaaaccagcacaaactatttacgtgggctctaatgaccagttttttagggattttctagagtggtagaaataaaattgtgccttaaatatttaatttgtggcatatttgtattttaatcaccaccttactttgatgaaattaatgcaatatcgtactgttttggctatagaaacctggcacagttgagttatagcacaacagttagtttttgctgttctaatgtgctttttttttttctctttcctccagggctggtggactaggcctcaattttgtcggtgccaatgttgttgtattatttgatcctacttggaatccagccaatgatcttcaagccattgacaggtataatactgacaaaatttaaagtgatctgcaaatacttttaatctaaaaatactcttgaacttttaaggttgcttatactatgactatgattagaagaaagggggaaactggtaaaaacgtacatttaatataatcctgaccttctcaatccaaataacagtccaaaaatagccatttttcatccatctcagaatcctattaatatgacagaaatgacttaagaagaaagaataaattcctaatactgtaggaaaataggatagttctgtactagtagatcagaagttttgagaaactcctggaagatagaaagcaagtagaatctgtgatcagggtatccgcagagaaatactacaatccaaagtctgcaggaaagagtacagaaattttaagcatgggcttgcaactacagtatgtgggagtagacagagtgcatcattctgggaaattgataatgtcctgactctaatacaaattcccctctgacaccctactttacagagagattggccgtaacaggtactctttgattaaagctgaaagaataattttacacattttataaacaaatggggaatct

SEQ ID NO: 5503 - DNA, 1192 bp, Homo sapiens
agtggctcacacctgtaatctcagcactttgggaggctgaggtgggaggattgcttgaagcaaggagtttgaggccatactgggcgacacaatgagaccctgtctttacaacaaaataaaaataaaaattagctgggccttgtggtgcatgctagtagtcctagctacttgggaggctgaggtgggaggattgcttgagccaaggttgaggctacagtgagctatgattgtgccactgcactccagtgtgggtgacagagcaagaccctgtacccaaaaaagaaaagaaaaggaaagaaaaaggaaggccgggtgcagtggcttatgcttcatgcctataatttcatcactttgggaagccaaggtaggaggatcacctgacactgggatttcaagatccgcctgggcaacatagtgagaccttgtttttactaaataaataaataatttaatgtaaagaaaaaagaagaaagatttgaaaccaataacctaaacttccaccttccaacattagagaaagaagagctaaacctacaagaagcagaaaaagaaaataataaagattagaggctggtccgatggtagtaggttatcagaacttattaacattagtgccactgaagctggtctactatcccctgctcttaaatctgactggctttacaattttgtagattaatggctgcctagaattggggactgggagtgctggaggtcatggttaaagagtttcgagttctttttgaggtgattaaaatgttctgaaattgactgtgatgatacatgcttctgttcacagatacacatatctgtgaatatacttaagccccctgaattgtacacttgaaatgagtgaattgtaccatatgtgggcattggagggcatccatagtttggatgtcccctccaaatctcatgttgaaatgtgatctccagcgttggaggtggggcctggtgggaggtgactggatcaaggggtggaccccttacaaatggcttagtggcatccccttgttggtgagtgagttctcacttagttcacatgagatctggttggttgaatgagtctgggtcccctccttctctccctctctctctcttttttttttttttttgagacaaagtctcactctgctgtagcccaggctggagtgcagtggcgtgatctcagctcaccacaacctccgcctcc

SEQ ID NO: 5504 - DNA, 1178 bp, Homo sapiens
ttaaaaacttaagaaatgtataatttaaaaatttaaaactttgatattattaattgcttattgttgaatgaatccttgtgaaaattattgattgtaatgttagtgccatggatatgtcctttgtcccagcacctatctcattgtcctaacaaggttactgaaggttctctttccactgctttaaaagccagctgatacatactacattctttctttttcatatagttgaacttttactgcaccaggataaatttttaaatatttagtgatagtatacatagtaaatatagagatattgctatgcattttcaattcttttctgatcattaccataagtttttattagaatgaaaattggaatagttcctttaggaaaacaggcaaaatatataaatgtcaaaaaaagaaaatatatacttagaaaacatagatgattagaatttttaaaaacaaatgttagtcttttcctccagtatctattaaagtgtttttcagtgtcaacagtaaaattttataccttgattcatatatactgcactagtttactgttgccattaatcttttttcttgctaatcaaaacttatcattgccatataaaataacctgttagaaagtatcaaccgtgtgtgtgtgagtgtatgtgtgttactaaaaagagtgtcataaaatactgtgctgagaggttcctaatttggttcctgatttcagaagcataccacataagatttaagcaagctcatctctaggagatgcataatttgtggataacggttttcttagttgggattgtgtgtacttcaggtattatgtaatgctgaacagcttacttgctttttctttttttccccccagagataaactgaggatcacaaatattattcttttatgttaataatggtttccattttctagtatttgttacattttacggctttattcacaaagctgtttatgtatttttgtggcagctctaagttaaaaggcacacttgtaacattacagtcccaattttccctttatcaactttatattataaaattttccaacacatagtcaataagcatgtccatattctagaagtagatattcttaacattttgccatacttcccatttctaattattttttaaaaagaacttacaaacgggccgggagtggtagctcacgcctgtatacc

SEQ ID NO: 5505 - DNA, 1220 bp, Homo sapiens
ctgagatggcaagaccagccccttgtcttcctcagcctgctcaacgtgaagatgatgaggatgaagacctttatgatgatccacttctacttattaaatagtaaatatatttttttcttatgattttattttcttttctctagcttcataagaatatagcatatgggctgggcgcagtggctcacgcctgtaatcccagcactttgggaggctgaggcgggcggatcacaaggtcaggagattgagaccatcctggctaacacagtgaaaccctgtctctactaaaaacacaaaaacttagccaggcgtggtggtacatggctgtagtcccagctacttgggaggctgagacaggagaatcgcttgaacctgggaggtggaggtttcagtgagccaagattgtgccactgcactccagcctgggtgatggagcgaggctctgtctcaaaaaagaaaaaaaatatatagcatataacatacaaaatgagtttatcaactgtttgttattggtaagtcagcagtgggctattggtggttaagttttgggggagtcaaaagttacatgcaaattttttactgtgcggggtgtcagcatccctaaccccatgttgttcaagggtcaactgtagtttaaaatgactcctgtctcaaaaaaccaaaggataacctttaagggattggtaactttgactcaaaactgctttgtaatcttttcacaatgtactgaaaagtgtggctagttatgtttgatccacattctagagaaatttgtaggttttaatttcttttctcttggtcctctcttcatgtataatggttgcttttaacagctgttcgctgatgtggtcctgctctgtcccagtctagcagctttagtgtatggaaaaattgaactaggaattgagttttgaagaaataaaggtgtaagagcaaacattcaacagttgctgtccccagtaatgaagttcatacagacaaaagatggcatgtcactgtacatcataccttgcaataaatattctgttaaattgtgctggtgcaatttaacatgcttttgtcaaagtaaacatactgttttcctaatttataactgtacttgaaaatgaaagatgaggaagggaccttgccaacctatgtagagcaggtttagctgttagtgatttctggataccaggattgtcttaaactggtaagggtgtagagggtgaatagaagcatcc

SEQ ID NO: 5506 - DNA, 1326 bp, Homo sapiens
aggaaacctggggtgggtgcaggtcctacgcagtactgaaggcctaattgaagctggagacaaaacagtggtttaccacgttccaacctcctagttccattggcctagaatttcacaatgctggaagctattaactaaggactgcctttcatggaaatttataacaattttcagtgtaagcagtcttgttactgatatattcagggactgcttatactttttacagacgaaaaaattctcctaaatccttttttaaatgaaaatgttattttataccaatctaaaacttgtattcagtttaacatcttggttttgcaaaagaggtggtctgtattcatggaaacccaatgctgcttctgaggtaaatttaaaagacaactagctgcgagagacaagatacttctaaatactttatggtaggacagtaagtattgactcatggtgccccttgttaacaggaggaaaaaaaattacaaggaaaagacacaatgacaatatgatgctttggtcttctttagtcctccataaactaaagcagagtaacagagaactgagtctcccgaactctcttgagagatgactccagagtcataaatataaccacaggcccacaatgtacaatgtccacaaacttgggacccccataagagatttcttacctacctcttttgggaggaaagtacatagtaataaataatgaaaatgaatttattttcctttttttagaagggtaacctctaccagtatggaataagagaaagctggtataactaaagaaatgccttatctctaccttatttatagagtagacatgcaaacccaaaacgttctgtacatttgaaccagctgaacgttcccatctaatattaaggcctgtgcatcctgaagttttgaaatcaaaacatttctatattctgtaactgatttctgtaatgtgtaacagtcctctctttcagactccttaagatgcctgttcactactttatccttcaaggctctccttgctactgaagagaggaaggactggtgtagggcactgaaaagattaaaaggccaaattcaaaagaactctccaaatactctctatcggtcctttgaatattttgatacagagttttgataccagttaaaaaaactgaacagcagtttctgccttgtatctaacaaggcagaacaatttgaattcactaacaagaaaacactttcttgtctttcaccttatttttatctatctatctatctatctatctatacacaccttatactatttaaactgtaaaattctttttggtagtaagatcaattctcaaactgctaaagtagaag

SEQ ID NO: 5507 - DNA, 1297 bp, Homo sapiens
ccttggcctcccaaagtgctgggattataggcatgagccagtgggcctgaccagctcaggttaataataagcactttaataattgctagatttgtaaaaagaaacatttggaagacaacaccttaaaatcgaggaaactggattaacttttcctgggtgagttgaggtgctgctgtgcattttgcttttcttggttctgtggtcaccacttatacttgctattagtcacctatattaatctgatcaagtttacattgttttatctcctaactgtcaaaaactttgttgttgttgcctccattggcaataatctaagcaaaatgcctttccactgtcctaaagtcaatttttgttactgtacagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtctgttttttcatgctttgctttttaattattattattattttttttacattaggacattttatgtgacaactgccaaaaaagtatttttaagaatttaagcgaaataaacagttactctttggtaaagcctagttgtatgcttacatttttaaattatactctcattgtaagctcatgttaaaacaccaaagaactggtttatttggcatttttatattagtagttgttgaggggaattgcacaagtgtgtaggatctttgagcatttagatcaaatcctcattgataactgggagtaaatgaagcatactttaaaaaataacgttcaaaatggaatactctggggccctgaaaaccagtaaaatgttaggttcaagtattatgtgaattaagggaaagaagatagtgtaaagcaaaaggccttcaccagaatcccaagagatctgaattctagttctggctctgccactgattttctgtg

SEQ ID NO: 5508 - DNA, 1143 bp, Homo sapiens
ccaaggcttttcatcctaggaagtttgtgtgctggttcacaagaggtccctggcaccctttctggggatgtttggatgcggctggtaggcagggaagagaaagggcaccccagcgggggcatgtgtggaggcagcacggaacatgtaggttatagatcgtcagggaggaggggtcagttgggtgcttgtttttctgatttttggtccttgatcacccccttcccttcccacacgtgtccccagcctgcctgtggctgttccccccacaagaagcacctcccttgcttggcaaccttcaccagcatttcccaaaagtatgctcctgggaaccctagttccacaggataataggtttttcataaagaaacgtagggtgtgtatgtgaaagtggggtgaggttccctggttgagtaggtttggcagacactaaagcgagctacacgatcatctttgctacaggcctctcacaaccttcagcatgccagcatgggtcaggcctcttcacagggccaagaaactcatagcatctcccacattactctcatcacttctccaaggtgcttttgcaagactggaattccttggacaccattggagaagccccgctttttctggaacagcggcaaccaagaggccttgcagccctggaagtgggtcagggcccttggtggtcacctttttctccccagcagctctgcagaggtggcctgcttggcagtgggacatcaggggaccggtcctgctttgagatggcagggtccctgttctgagagctctccagcctgagggcattgagctgaggctccaccctgagctctcctgcagggtggagggcattgtttcccagcacccaggcagtgtcttgctggtgtgtcgtgagtgctggatgtccaagtccctgctggccacggagggctcctgcctctcttcttcagcgccacaaaattacatggaggccagctggttttgtgaggagattgtttattttttaattcttttgtttaccgaacgtttactgagcatctaccctgtgccagccctactcgtacgctctgtctccaaagatgaaaaaggacttctctgccctcaagggaaccccacagtatcttagaggagacaatcatgtcggtgagatggtgtggt

SEQ ID NO: 5509 - DNA, 1179 bp, Homo sapiens
ctgctataaatacaaaaattagctgggcatgatggtgcatgcctatagtcccagctactcaggaggctgaggcaggagaattgcttgaacccgggaggtggaggttgcagtgagtcaagatggcaccactgcactccaatctgggcgacagagtgagactctgtctcaaaaaaaagaaagttttaatatttcaagagacaagttctcactctgttgcccagattagagtgcaagtggcatgatcatagctcactgcagctttgaactcttgggctcaggagatcctccctccttggactccaaagtagctagcactacatgccattttccatagcggctgtgccattttactctgaaactctgaaaggttttatgttgctcatgttggaagtatcctcatgtatatatcttcagtcatagtattttagtattcagcagtattactggttgtgggtagggtctgatgtggttttaggcagaaatagaaatctaggctgtagttgaaaacttttcttgtatagatcccctatctcaggtaggtaagagtagcttacttttaatagactttcttcataccagtataggacagatatttgactctggtcactggaagtgtgcttcataactgacaataaacttgccttttaccaaaacagagaaaaacatataaataaaatattgtttgtatttaaaaattttaggtttatttcttccttgtatatgcacattagaggggcctggacatattttttaagaattttaaatattgattagtttcccatgttttttctttttagatattaaaaaactgcactttgttttgtgtaagcaaaatgctaggccttttaaaagttaaatttttaaaaaaaattttccgtaacttaagagcttgttttttatttgacttccagtagagggcactctgttccttagatataacttacattcagttccgttaaatcaccccttgaatgtttcttgaaattgattctccttggaagatgcatttaatgtcttcatcaacatctgttcacttatgtttaataacttttgtcaaggattattttaaaatcttggggtttttttgcttttatctttttgtggcgatgagtggcgagaattgggaaaatatattaattttacaaatactgataatacagactcatatttaaatgattg

SEQ ID NO: 5510 - DNA, 1218 bp, Homo sapiens
gcattttttttttaatttaaatttaaatttttttcatttttttgaaaggtttttttgtttttttttgttgttgttgttgttgttgtttttgagacagtcttgctctgtcacccaggctggtagtgcagtggcatgatctctgcaacctctacctcccaggttcaagcaattcttgtgccgcagcctcccaagtaactgggactacaggtgcacgctaccacacctggctgattttttatgttttagtagagacagggtttcaaccatgttgcccaggttggtctcaaactcctgagctcaggcaatccacccgccttggcctcccaaagtgctaggattacaggtgtgagccaccacacccagctattttttctttcgttttttaattttaaagttggcggcggggcggggggggtctcaatttgttaccctggctggtctcgaactcccggacttaagtgatcctctggctccaagcccactaccagtctcaggtttctttactaaaagatcactacttttttttctcttatctgctgccatgtgagatgtggctttcaccttcctccatgattgtgaggccttcccagccacgtggaactgtaagtccaataaacctcttttgtaaattaaaaaaaaaaaaaatcactatttaaatactaggatggattgtgactgttgaggagtacttacatatcctacatttgactacaatccttccaaaccaagtattctatccaaaggaacatactgctatcatggagaccaaggagggactgtttaaggttgccaaggtgaagcgagctgaaaggctttgtcctcgtgccagcaactctgaaatctctcttaattcctgctgtccaggcagcagaatgccatggtttccccaagtaggtagctgctttagcaattaaagcccaaatgtctgttctgttgatcagaggtctctgaatttctgaaatggtgtttcgtttctggtgactgagttaatcctttacaatccctcttgtaaagtgtgctaatagaaagaatccacctttcaaagctgcagaaccagaccgtgccctaaattgaccaacgtaactgatgtgcctcgggaagtctcttgccagctgtccctgtgaagacccccctcctcccccccagctgctgccttgcacactgaagcatctcagactgcaaagccatgtagtcatcaagtcagtaaatcccagggct

SEQ ID NO: 5511 - DNA, 1197 bp, Homo sapiens
ccagctcacatgtcactttactcacttcccagaattgtaatcttcgtttcgaactgctctcgcacggcagctatacttctcagtacctgcttttgtaccattatgtgcgttttttctctttttataaaaaatctctttcagggaacgcatagttcttgaggtcaggatattattgttttatttttatatctccagtaagtcacagtgtgacttgcactgtggttgctcgataaatgttaggtgaatgacatcaatttacagaaataaatccaactctgagcgtctccccttgaggaccgtgttttgttcatctgcacgctctccaggtcctgcactgcgcccaggaccaagaagacgctggacccttactaggagaaccgaggcaagagccggctggagccgcggggaacccgctcgccccgcccacccgcctagcgccggtgagcctgcggctcccgcgaagcgcggccccgccccctcggcgccagggcgcacgcgcggagctggagccggcgcggaggagcgggcggccgcggctgtgccctctcctactcctcaccgcgcgagcgcggggaaccagtagccgcggctgcttcggttgccgcggtcggtggtcgttatggattctccatgggacgagttggctctggccttctcccgcacgtccatgtttcccttttttgacatcgcgcactatctagtgtcagtgatggcggtgaaacgtcagccgggtgagtgcggggcgccgcgggccggacccctcagagtgctcctgacggcgaggaccgtctaagtcgggtgggtcgggtgggtcgggtgggcggctgagtggccgctagcccagacagttcgatggtagagttggaggggcgccaagggccggttggtctgacttactgagtgcagatggggaaacagcgtgggggaggacggaggctctagtactcctcaaaggaggcgtgacctggggtccgcgaggccgtagcctgggcgagcagggccgaccttgccaaccgcccgcagaagtcccaggactgacagaagctgccgcagcgtttcggaaccacagatatccgcgccagcccagggcttgggcggcctcctcgcggtaccgccactcgctcgcagtgtcgccactcgctcgcagtgtcgccactcgctcgcagtgtttgaaagtcatgtgaggagacagcaggt

SEQ ID NO: 5512 - DNA, 1257 bp, Homo sapiens
gttgatattttatcttacttcctttgaatactaaatgcatttttgtgaaagtggttattctactcatttggcaccccaaaatatggtaccttgtattatttttaatgagttgtgttattttccattaagtagaatctcatggagaacagagattttaccagaatctagcttagattgcttcccctgcagattacattaataatgcattttgattttttttccttttgtttctctctcttgagaaacagaaatcatttgtatttaaattcaaaattaaacttttttcccccagataaccatgatgactacacagacttctactatgacatttgctccttttgaggatacattgagttggatgctatttggctggcagcagccgttttcatcatgtgagaagaaaagtgaagcaaagtcaccttccaatggcgttgggtcattggcctcaaagccggtagatgttgcctcagataatgttaaaaagaaacatactaagaagaatgaataaatttacgtgatgagctctacaaggccaaaaattttttttcttatctacctgttatattgtgctaatttttctatgtatgtgatgtgaaatgaagactatatatatggaatggaggtgacagaaagaaagaaattctttgtttgagggagacttcccctttctggattgtatttgtagagtgttacgagtgtatcatgtgattatgctttaccggtataagagattctgttgtgattatttgaatagttttatattaataaaagaagacaaaattttttaaatgttagaaaaagcagatctgtcattgcaaagtaacaaaaattttaagcttttaaaaatgtagatttttcatatttttaaaatttgaatctatttgagctttagttcagcagaattaaatttttacttgacattatcattaaaattgctaggtatggagaacaattcctattttattttgaacactgagaagagtaaacttttcctaaaacactttatattataaatgaaaataaattgctagtttatattttagatataaacatcatattttttattaatacctacatcaaatggaaaatatctgaaattttttttccatagcaggtattttctactagaagtagttttactacttttcatttagaacagagtatgagtcttaatctgaagtctttttcatgcccttgttttaaaaaaactactttttttggcctcaaaaaaatcaagggtgtaatttttaataaatt

SEQ ID NO: 5513 - DNA, 1168 bp, Homo sapiens
agaagtacagaaattgactttaagtttatctgatgaacggtagccagcagctcccctctctctgcactttctcctttcttacttctcctttgattttctcttgcatgctacaggtcaaggagacacagcagacaaggacaacaggcaagagggggctctttaatgagggtagggtatgatgggtctgggaaagtcaggaggtagcattccaaacccactgtgtgcttgaaccctacggggtgcatttggtttaaaatcccagtgcaaaattgtatggtatgcaaattatatcttgagagagtccctgcccacctagttttccccaagtgggtttgagtcagtcgcagcccatcctgggctactttcctctttctcaacttccagctgaatgtactgatgccactctacaggtgtccccttgttcctgtcccatccccatccccatggaggctgggagggggcgtctactacaggtacctttcttctccccagggaaggagactcagtttcatcagcctccttgttaaagaaggaaagacagatgcagccctggctgctgggaccttctactgtgacctgagacatgcccccgctcccccatgtattaggacgctctctttagacagaggttttactattcctgagtctcaacaaaactcgatgagtcctagcccctgtaattagtccatctctgttccctcttctaacttcctgttccggtggtgccttgtttgtaaggctggcttcccatgccccagcttcagtctctttggtcagacccccaaatgctaactgtgacccctctcctggctgagcactatctatttttgtttatgtttaaatccccaggatctagctttatgcctggcacacaataggagttaatatttattgaacaaataaattataagcattcaagggaaattagcattgcaggaatgggtggcaatcagttatttgttttcaagtcaggatgatttttaaagtttttattgtttattttcacccaaacctaacctgctaaagaaacatatgactgattttcttagattttacaaggtgccagaggacttaatttgacatacagaaactcttcaaatttctgaacgttaccccggatgctcttgctatatcatcccacatcctgttcggatttctgctgtttaga

SEQ ID NO: 5514 - DNA, 1207 bp, Homo sapiens
tgcttctagtttgttcttccttttttaggttaggtttagtttagttctttgtttagttttagtttaagattaaattattatctatctttgttagcatagatgtttatagctataatattccttctgcgtttatgctatagtagcatcccataagttttagtatgttgtatttttgctttctttcatctcaaaatgttttttaatttcccatttggtttctaatttaattcattcgttatttaggattgtgttaatttccacaagtttatgaatttcccacattttctcctttcgatttctaaattcattccattataatcagagaatatactttcaatacttttcaacttattgaggttcgttttgtggcctaacatggtatttctgaagaatgttctatgtatactgaagaagaatatagtgtagttcttattaagtggtctataaatatctgatagatctagtttgtagtcaagtcttcttccttagctgttttatctattattgaaggtggagctgtagttgtctctattattgttaattgccaatttctacctttaattctcagtttttattttatgtattttgtggctctgttatatataattgttgtgtcttcctgaaccctttttatcataaaatgccttttgtctatagtaacaatttttatcttaaatctgtttcctctgatatagccattctagctcttttttggttaccatttgcatagtatatacctttttctatcattttactttcaacctacttgtgtctttgaatctaaattgtgtgttttgtagaagcaggcagttggattgtaccctttacttcacctatcctagctttaatctggataaaacccagataacaaactgattttttagtttcttctgctttcatagatgaatagttattcgtgatgaattgggatttttgcccaaattttaagggttatttccaaatataatctgacacagcagtctttaacctttttggcaccagggaccagttacgtagaagacctttttttctaccaacataggtggggtgggcgcagtgattttgggatgaaactgttccacctccgatcatcaggcgttagttaggttaggaagtggggtggggcggtggttttgggatgaaactgtttcatctcacatcatcaggcatttgttaggctatcatacggagcacagaccctagatcc

SEQ ID NO: 5515 - DNA, 1141 bp, Homo sapiens
catatgagcatttggtagtattataggatttattatgaaaataataaaactgcagtaacactggccacagactaacagtacacaggtgcacagttgacaccagggattattgccttgtagagttttgacctttgatgagagagtgttttttacagttgttactgatagcacatttatgtaacttaattgtgctttaaaaatatttaattgtctcttgtgtaataacagtaagtgaaagacgataactaaaattttatataattagatcctggagagaatatttgttgggtgattgaattgaaaataccagtgaatgaaacatacctaaaagggtagataggttgggttggaaagatataccacatcgagggttaattaaatggataagatgtcattatctttttttctttgtaaaggaagattaatgcataaaattattttgtgtaatttacatacaataaaattatgtgttgtacagttgtataatttacatataataaagctaattcaccaattttagatgaagaattcagtacatttggacatatgtttgtagctgtgtaaccaccattgcactcatgatctagaacatttctaacacccccaaaagttccctacttccccttttgcagtcagccttctccctccactgccagcctttggcaaactgatcagtcagtaaagtttcacattatctagaatttcatataaacagaaccatatggtatgtagtctttttaatctggctcctttcactcacatagtgcattggagatgcatccatgttgtagtttattcctttgtattgctgaatagtatcccattatatgtatatgtcagaatttgttgatttaccagttgatgtacatttggattgttttcagtttggggttattatgaataacgcagccatgaacattctagtgcaggtctttatggggacaggagtaggaatgccacatcccgtggtaagtggatgtttaactttttaggaagctgcagaactaatctgcagtggccgtatcattttgcattcccctcagtgatatgtgagagtgcttcagtgactcctatactcaccaacactgggtgtattactgtgacactagatgtattatctattgctacgtaacaacttacc

SEQ ID NO: 5516 - DNA, 1113 bp, Homo sapiens
tttacagttaaagggctgctaaatggcttgcagatgagatcttctggctcaccttgatcttcacatgaacccattgtgacctatctggatttcctaggacctgtagtttccatttgggttatattagtgcctcaggaatgtgtcactactggtcaagcaatactcagaaattcaggctgtgaggggttagattagaggaaagtaatttaggtgagctatccagagctttcaacctcagggtttataggaaaaaaaaacaaaatacaaaaacccttaggacttctcatactctagccctgaccttgcagtctcctctgaggggcctcctaagacccttaaaataatattacaataggactttgagtgtgcatttcacagtggaaatagcctctggctagcattacttccaaatgctagttccagctaaaaacaagtactttttattagtttcttgtctttcaacattctgccatcaaaatatattcattttattaacttaccgattattgggaacctgcaaaaaaaaaaaaaaaaaaaaacacacatgctgtctgcagccactgtttggttatttttgatagtttaagagaattataaatcaagttgttctgtctactagagtcagaaattctgtgctagaatgggacttctaaaattaggtggtcctgtcactttctagagaaagacccaaattcataggtttaagtggcttgtctgacatacacatacagccagttagtaacagaattcagaatagaatagagttcttttttttctgtcagtccgttgttctacttctctttccttttcttcatggttgagcagcttttggcaaaatgtgttccatatagcagtagttccaagagatgttaatagatgtaagaaaaaaagtgtgtgtgtgttgggggtgggggattgcatggtcaattaaaatgaaggaatgctgagtttgtttccttactgtaggacttctaagagttttgaacatgctattacacattgtgaatttataaaaggggacaaacactgtttgaccttagactgcactccccttctttattcctcagagcatctcaaaggactacagggtcctttgagaaacatggcccttga

SEQ ID NO: 5517 - DNA, 1213 bp, Homo sapiens
ctatcctctgctcccaggggaatgtgggagagaaaagggttcttggccaggctgtaggtggtggctcacatctgtaatcccagcactttggaaggctgaggtgggtggattgcttgagcccagggatttgagatcagcctaggcaacatggcaaaaccccatctctacaaaaaaaaaaaaaaaaaaaaaaaaattagctgggcacggtggtgtggctatagtctgagctactcaggaggctgatgtatgaggatcacctgagtccaggaggtcgaggctgcagtgagccaagatggcgccactgcactccagcctgggtgagagagtgagacactgtcccaaggaaaaaaaaaagtgttggggggtagttcttaagcgttgaagatttcctttttggaaagtatttaaaggtagaaatattaataatttttcctaaaacatctccctaagaagtcactgataattataattagtttaaatttattcttacactacttaagaaaaatttcatttagaaaaggctaccatgagatcttttgactatatggagtagactgcatacagatctctttatttctattatgaatattttagcgattataatcagctattccactgagtattagatttggtcactaagtaactcatgtttttctttagtcaatcattcattcattcactaaaacatttgttgagagttggctaaactctagattctgtgccaggcactgtacagggtgatggagatcactcataagaaggcctcttgctcttagccagatcatatgtaatactaaatttaaattttttgcattaaaaggctaaaaaatcatttgtttttgttaattatatactggttgatttatagatgtaattagcacatattcataagagacaaatatatacaatgagttactatacatatacaaagtgattttagctgtataaagtgatattgcaaaaaactacagctaatgtttcttgctgggtaattattagcataaatatcaggttcttagaggtctttaagagaatactttagagctaccaaaattagcagcagtgatgtaatatcaccctgaaataccaggagcagaggtgccccagagtgcttcacagctatgatcaggaaacttgacctgccccattgctacagcaacggcataaggactaggaaggtccactagctggggaggtcttggaaccctccgag

SEQ ID NO: 5518 - DNA, 1185 bp, Homo sapiens
aaaatgtacctttttagcgtacaggtttatattttgtatgacatgtaacagattacacatttagcagcttaacgtacatttacgatacagcttctgtgggtcgggagttcaggcaaaacttggttgggtcctctgcttaggacctgaaaatctgcagtcagagttggggtttcatctgtggattggggttctctttcaagcagtcctgttgttggcataattcatttccttgtagttgtataactgaggctcatggctcctagaggctgcctctcttcataggcagctgataatttgggtttttgcttctttaaggccagcgggagagtatttttctaactttggtctctgacccctagactttttaaaagaagagctcgcctgattagacccagcccacccagcataatctcttttttttttaagtcagctaatgagggacattcattatatctgtaaaatccatccacctttgccatacatgttgagcatcccaaatcccaaatcggaaactctccagaatcagaaattttttgaatgggaacatgatgctcaaagaaagtgttcgttggagcattttggattttttttttttttttgagatggagtgtcactcttgtcacccaggctggagtgcagtggcatgatcttggctcactgcaacctctgccacccggattcaaatgattctcccgccacagcttcccgagtagcggggattacaggtaggttcatgccactacgcccggctaatttttgtatttttagtagagatgggatttcaccatgttggccaggctggtctcgaactcctgacctcaggtgatctgccctcctcagcctcccaaagtgctgggattacaggcatgagccactgtgcccggccagcattttggattttagattcttggatttggggttagtataatgtaaatattccaaagtgcaaaaaagatgtgagtcacttctggtcccaagcatttcagataagggacactaacctgtattaacagaaccacaatatcaggtattgaaggtgtttggctgttggctcatgttaagaatgagacatggccgggtgcggtgggtcacgcctgtaatcccagcactttgggaggtcgaggtgggtagatcacctgaggtcaggagttcaagaccagcctggccaacatggtaaaacactgt

SEQ ID NO: 5519 - DNA, 1158 bp, Homo sapiens
ctcactgcaacccctgcctcctgggttcaagcgattctcctccctcagcctcccaggtagctgggattacaagcatgtaccacaccacacttggctaattttgtatttttagtagagacagggttttactatgttggtcaggctggtctggaactcctgacctcaagtgatccacccgcctcagcctcccaaagtgctgggattacaggcatgagccaccatgccccaccaattatatataaaatgttttaatcctgttttttaaatttagcatttcattgtaaaatattttcccatgttataacagtgatgtttttaattgctgtctatattatttggtgtggatttactattttctttactattgagtatacaactgtttttggttgatttttctttttttttttaattttcatttgaaataatcctcagttcttagcttttcagttcatggtactaaaacactgtattaaaagcacactagatggctctagaaacttttttcatgaggattggttctgatatccagctttccttcctcgtcagatcttggagtctctgtggatcgttatgagccggaatgtgagcctgctgttcaccactgtcactacactcttgaccatcctcttctacagcgggacagcccttctcaattttgtactctctctggtacgtccacatagataagtacacgtcatatttccttccctgttaaagcatatttctggtttcatttgcaattgcagatgtctgtcttcctatagtttccaaatacgatttttttaggagatgttgtcctttgttttgcagataattttcctgaccacactattttatctattaagttccagtgatgagtactacaagccagtgaagtgggtgataagcctgactccactatctcagccaggtccttcttctaatattattggccagtctgtggaagaagctatcaggtagggataaggtttatgctattcttatttctcccagaactttttttccatgataagcctgttttttgtcatgagcatcctgataacattcagtgctaaactcgtgatggactctggtattttcaaggttttcatctcattttgacaggataaatatgaacagtgcagttgttaataagaaaaagattcaggccaggtacag

SEQ ID NO: 5520 - DNA, 1103 bp, Homo sapiens
tagactgggaaacccagagcctaacgcgcagtgtctagtccaatgtagccactccagaaatatttgttaaatgcagcgtcagaaaagtgagtggaggaaattgatactgctcgaacggtagaagacccctcgccagcgcctaccctgcgattacccctccctacctgcgggaagcagaggagggcgggtcctcgcccgcctcgggtgccctgacctgtttggtgccgggtgggcttcggaaacagaagtgtgtctgcaatgtgtccccgatccttttgttcctttgattattattgactctcagtgttttttcctcatatgttgattgccactgtcatcttttatcttcctctcaatcagttttttcttagtgggattctcattttagcagccctcatgtgttgaaaagatccttagtagtgaattgtctttcatatactttttttccaagcacctattgtgtgacaaattattaatccattcctggggaagggagtggggctgggattctgttctccagggtctggcaacctcagtataacccaactgctaagaaccccctccactgagccagaagacctttgagtggtctatgttagttgtcccaaaatccagacactacaaacaaagttgattaggatttctggagcacacagtttagtcctcccagttgtcagagcatgtcagagcaccttcctcctctaccagtgacaaaggtgtacaagggtgacaggaactttaaaaaaagcactacagcctggggcccaaaggccctgataatcaattaatcctcaaaataacaatccaaagtcattgatcgaaagttacactaatttgattgttatttgtctgttagtttgtttttcgagatggagttttgcccttgttgccctggctggagtacagtggcgcgatctcggcccactgcaacctccacctcctgagttcaagcgattctcttgcctcagcctcctgcacagctgggattacaggcatgcgctgccaaaatgcccagtaattttgtatttttagtagagatggggtttcaccatgttggtcaggtttgtctcgaactcctgacttcaggtgatccaccaacctca

SEQ ID NO: 5521 - DNA, 1201 bp, Homo sapiens
agggaggccacagtctattggcatacatgttgggatggaacttgaccatcctgactcttcacaggtctgcatggcatgaccagccacctgaaacccagggaagcaactgtagatgattatggcaccatagctgtaatctgcaccttctacaaaaccattttcaatgggttgtggggaatcacagtggatggcattgcaagatggggcatctacatcccaatcacctgtctctaaacaggtcaaggcactgggaccttcgagccgaaagcctcggttgcaagagtaggtaacggtctgtccatagtgtaggtccgtgtaagagaatttgccattcaaaatctccttgggtttcaggcactcaatggctttacatgttggttttcctccaagccagtgaccattttctccacaaagggtggtagtatttcccaccaattcaaagcctggcttgcaggtatagagagctgtgctgagataggcaaggccttgcacatcaatgattccattggggatttcctcaggttggggacattctactggaacacattctggcagtggagagctccaggtgccatcaggttggcagagggtggtagaatttcctcttaggaaaaacccacctacacaagaatacttgacagtacttccaaaatgaagagcagaagaaggaatggggacaccaaaggaaattaggggaggtggggtacaaagaacaatcttacaaacagggaaagagtcattccattgctgggatggcaagcatttcaggacagaggggccttgcaggacatgcccttctttacaggaaaatgtcacaactcctacctcggtggtcaactcctttaatactagctggttttccaagaggggcggctctgggcacttggcaggcatgcactttggatttgacttcttattccatttgccagatttctgacatgtccaagaactgtcaccaacaagctcataaccctcattacagaaaaactgaaccttggaccctacttcaaagttttctcctttcatgaagccattctggatcgggggaggttttccacagtcgagaggaacacacatcagaggggattcactgtgccagtggcgattggcttggcagacaaatacaggacttccgactgacttatagcccgggttacactgatacctcacttcactctcaaagatcctgccagttgtatgc

SEQ ID NO: 5522 - DNA, 1201 bp, Homo sapiens; identical to SEQ ID NO: 5521

SEQ ID NO: 5523 - DNA, 1223 bp, Homo sapiens
agtccagagactttctgattcctaatcttttgcttatgagcttccctacctgctttttgatattttataggacctttttaatatccttacagttaaaaaaacacaactcatgatgacagatgctgtgtttaatgtgggcatattgaaatcaaatgaaatgggcaggtaggcactcagtgggcccttacagtctacacagttatgaccttacgttttaggaaatattttgagttagtcatttgacttcactccaccccatttcctttactcttttattctggaattctatttggctattagacctgctggactcattttgtagccttctcatttttactgttctagtcttctttacttttttttttttaactctacattttgggcacattccttaaagttatattccaatctgtctactgaattttttttgaattcttaaaaattgacatataaaattataagtatttatcatgcacaatatgatgttttgagtatatatatattgtggaatggttaagtctagctaattaacaaatgcattacctcacatagccaccatttgtttgcggtaagaacagttaacatccactcccttggcattttccaagaataccatgtatcatcattatctatagtcactgtcctacacgatggatctgaccttattcctcctaactgcaatagatctcctgtctaactgtaaatatgtatcctttgatcaacatcttcccaactccctctccccacaaccaccccagcctttggtaaccaccactttgctctctacttctgtgggaaaaacttttttagattttgaattaccactttttaagcatcctgtttttgtttgaataagtgcaatatattcttctcgatgttactattgttaaacctattcatctgctcagattccagagagaaaaatctttccgtctcaggccttagatgatgtaagactggcttcagatgctatttagctctgataggcggaagagataataagaaagaagacaagcttcagctctgaactgcctgtatctcatcttgttcctccaggtttgggcttcaggaatttcttctattttgtttatatcagactatagggctctctgaagaatgatacatagtttgaaaaatttccccattttatctaaattgttgtatatctgtaatagttttctaaagtttttagaataaatttgtcctttccaggtttcagcatt

SEQ ID NO: 5524 - DNA, 1147 bp, Homo sapiens
tgatttttattataatttttaacttttattttaggttcgagggtacatgtgaaggtttgttatataggtaaatatgtgtcatgggggtttgttgtatatactatttcattacccagatattaagcccaataccccatagttatcttttctgctcctctccctcctcccaccctctctcctcaagtataccccagtgtctgttgtttgcttctttgcgttcagaagttcttatcatctaactcccacttataagtgagaacatgtggtatttgattttctgttcctgcgttagtttgctaaggataacagcctccagctccaatttctgactttaaaagttcagtttgtattttaacaatcttaaaaaattctttggatttgcaaaccttattatacaaattttgctccattatggcatattttctgccttccatgaggattggaatagctttataaagaagtgtgggtgaatcaaaactagaaattgttactttgaagagtaccttcccacactgacttttcgagaagcttatgcagtcttcctctccgttctgtttgtagatcgttctgtacttgcgcatgtgccttgcgcacagtgcgggggtggtgcccacctctcagagtttggctgatatgcaggatcatgccccagccattgggcgctacatacggactttaatgtcaagcgggcagatggcaccctcatcatctaacaagagtggggagactaaccctgtccagatctacattggcctgcttcagcagctgttagcaggtgttggaggtaggaatatgtgacgcgaaggaaagatactgaagcacttaagcaaaaatctaattttaaactttgctaagaatttatagcaaaattattctttttcttctgtaactgaacattagcctttgtttctttttaaacttacctgattcattctggatacactacttcttttttcggaaagaaatgctaacaatagataaatacatttttacttcggaagtggatgtgaagaacaggatatcctttttatagatagctcatctgtaaatttgctgtagtgaatcacatactatatttaggttgtgtaggttttcttttttttttttttaatagaaccgaaagaatgtgtgctaaagcagtggcctt

SEQ ID NO: 5525 - DNA, 1166 bp, Homo sapiens
aaaaaaacaaaaatgtaagggacagtgcataagccttttctttgttaagtagtggtgttttgctttttcttcaggattggatggcatgttgtccacaggaatgcctactgcagggctaacactggcaatatggcagctttaaattctgagttactacagtctccatgtcaaagcataatgtgtagcatatcagcaataactacatatttatagaaaacactttttcactttactgagccaattcatttaattgtcaaatgtctatatccatggtttaaatggcaacatatctataagtatgtatacacattatatttaagcttttctctgggccaaactgcttcatccttttttctttctttttttttttttttagccttatgatgaatttgtttgaagggcattttctttatgaacaaaggcttggatgcatattcctttctttctgtgaatgggtattattccctgaggaaagttgcacagtgaaaaccagtctggttgtgacccactacatgttttgtttttaatcactattacctgagttgaactttgctcaccatgtttgtacttgttggtctgtttaatgaagtttggttgatgccatcctttgcactgccgaagcgtaatcttgtgtattacttagctctctgctgatctcagtatggacagtgtaacaacaaaaccaaaatggctggacagacttcttgtgttttgtaaatataaactaggacagttctgtaggtttgttcagtgtgctagtggagtatttccttaatgtaaaacttcacttaacagagagattctttgtttagcaagcttggagtgatgataaaatggtaagaaataatataaatgttgaagaaagcatcacaacagaactataggagtctaaatttaataaatctttaaaaaaaaccagtgtctagaatatataccatgttttattatttaaaatcattgtcttaaatttttgttcaaaaaataaaaatttgaatacaatcaaaacgttagcaatagtgtattttttgttcttctgtatttttataagtagcatgttccaccattcacatcagaattattagaagagttctgtcaagtattccttttgaaatcttccttttacctgagccataggtaaaataaataaggacataggcagtcctgtg

SEQ ID NO: 5526 - DNA, 1193 bp, Homo sapiens
cttccagaggtggtgagaactccagggccgagtaatggagagtacaaaggtccttcttggcccccatgacccttccaagccaagaacttggcagtagctgtgagaagcagagatagggagaggaggtgaggggcacctatagctcttagccatgagttatgactccctccatccaagggagacccaaggacatgaaaggggactcagttccaaggatcagagggaacttgggttgttttgggataatgactgtggcttgggatgtcacggagatgaacaccagaattggtgtgcaacagatgagctccagtacccctgatagtttgcatgggttttgctctgctgatgatggtcagggacagcagtgaggccctctacaatgccgccttctgcctaaacacaggcagtgcccacaaaaggggagctgtcattatggagcctaggaatggatagtcagagagcagcggctgggcagtgcaactcctgcattggacaaggtcctggctagagaatgtcaatgtccacactgcatgtagccctatcgaggagatgatgtagggggctgtcagccttggagactctagcctaagtaccccaccaccactctggctggcttccaagggcacaaatcagctttctgaatctgacttggcttcctgtgatctgcattcatgaacattcttactagagttctcatggaaaatgaatacacaactatttggtctgaatgtgtctgagtttggtgtctccaaaacaattctctggattagatggagaatgaagaaacttcacaaaggcaaaaggacaggtccccatctcgacccccagagaccacttctcagagtctctatctgttcgtctctggtgttagccacgttcctttactttccctcatttctgtggccactcctgtggcttcctctctttcaacctgcaggctgctgctgccctgcctcagacccttgtaggcttctgtagagatgctactcagatgggggtggagctagatgcagagctgaaacccacctaggagatctagcttggagagcttgtgaatcttaggagagctaggcatagaatgactaaagtttgtcaccgcatgagataaaataaatgaaaagccacttctggagggaatgaggcagtctgcctttattggagagatacatattgttgaacagctctgggcagtt

SEQ ID NO: 5527 - DNA, 1174 bp, Homo sapiens
tggctcagcagagcacactcagcggtgaaaggcatgactaaccctgtacctccaggtagcatgggggatgccttcccaggaaaagagcaggaccagtgatggctgccctggccacacacagaggggtggctgagcttccatgctgctccccctcgcctcctcccatgggtgtgcgtgtgagctgtgcatagagatgcacagtgggaaaaccaaagtgtgttcatatttgtctcttttcttttcctcctccatgtctagatggcagatggacactgagtggggaggatgcactgctgctgggcaggtgttctggcagcttctcaggtgcccgcacagaggctccgtgtgacttccgtccagggagcatgtgggcctgcaactttctccattcccagctgggccccattcctggatttaagatggtggctatccctgaggagtcaccataaggagaaaactcaggaattctgagtcttccctgctacaggaccagttctgtgcaatgaacttgagactcctgatgtacactgtgatattgaccgaaggctacatacagatctgtgaatcttggctgggacttcctctgagtgatgcctgagggtcagctcctctagacattgactgcaagagaatctctgcaacctcctatataaaagcatttctgttaattcattcagaatccattctttacaatatgcagtgagatgggcttaagtttgggctagagtttgactttatgaaggaggtcattgaaaaagagaacagtgacgtaggcaaatgtttcaagcactttagaaacagtacttttcctataattagttgatatactaatgagaaaatatactagcctggccatgccaataagtttcctgctgtgtctgttaggcagcattgctttgatgcaatttctattgtcctatatattcaaaagtaatgtctacattccagtaaaaatatcccgtaattaagattgttcttcccttggttaatttttctgttactaagcgtcttctaaaaatgctctttgccccctgttagaaactgagatttggtggtagtgtagtagcaatgcttaaaacagtattgagcccatggctagactagagtccatgtgtgtttcaggggaggggttgccatagagggtgacacttcttttatctaaacttcagtaact

SEQ ID NO: 5528 - DNA, 1136 bp, Homo sapiens
tttgtaacctgaggcatatgttccagagaacagggatatttgtctggtccagtgaccttggtgatcatagtcataattgaaagatgcctatggcatgcttaaatcagcattgtcaactgatttgttgttgtattattttcacttcttggatctatgtagtagttgtaataacaaatatttaaatagctatttttttgatgccattaaaaaaatcatactctggccttttttcccccttactgttgtttcccagatcttttaaaaattcatcccatatccagaaagtaccagttataaagattgctgaccaagcaaagttttgcatcaaagtgtcacctcattgctctgaccaaagactgactgttgtggttttaactcctctctgtaaagcattttgcattttccccaagctcctttctgaaagaagaaccagtgcagagcggcctttactttcaatttctactgctgaatagactacttagagaaaatgtgagtttcagtgtgaacagaatggattaggatgacgagtttgatgggcattttcagtactgtatctaagaaaaaaaaaatagcacagctaggagcctctgacattgtctggtgttttacgtggtctgttcatcaaaattccccttttcagtttttaagaatgttcgtctaacagaagaaaatgctgtaaatatttgtaacaacattttttttaacaaggccaaaaaagaaaaaaaggtttttgggaacaaatgaacttataaagtggttttatataaaacatcaattgtcttgtatattttggataagcagcagtaccagctttcatttgtaacagtctgtggcattggaaaaaaaggagtctgtgattgttgaagtgaattatgttataaatgcaaagagaagataaaatattaaaaaacatattttctaaatgcgtagtgcatggttaattcaagcttctgtacactacagtatattccattttcgttcagtttgtatatttgctgactattacttgatatctctaatctcttttcctaacaaatatagcattgtagcatgccttttaataaatgtcatgacatctgtactctcttaaaatttttctgtgttcttgtctgtactttgggtttccctttgtctta

SEQ ID NO: 5529 - DNA, 1150 bp, Homo sapiens
ggccattcctggggctagtggtataccaggaaattctgttctactcgtcacaaatctcaatcctgatgtgagttgaaaagtattatatgtaaatagtctttcaggagaaggtatagtagcacttttttctttctttcttttcttttcttctcttctcttctcttctcttctcttctcttctcttctcttctcttctctcttctcttctcttctcttctcttctcttctcttctcttctcttctcttctcttcttttcttttcagaaaggattttactctgttactcaggcttcagtgtggtgctgcattcactcactgtgacctctgcttcctgggctcaagtgatcctcccacctcaggctctcaggtagctaggattacaggtgcccactaccacgcctggctaatttttttttttaattcttttgtaaaaacaggatcttgctatgttgcccaggctggtctcaagctcctgggctcaagcgacacacacctcagcctcccaaagtgctgggattacaggtgtgagccaccatgcctagccatggtagcttctgatccagggttgtattcaaattaaaatgcttaagtttgttttaagaacttctattaaaattcatcactagtatatacggaagaagcatataaaaccatgctttaaaataaaatcaactgccattacagtataaataaacttattttcaatttttacttaaattgtcagacacttaactttgtgttaccctttacagcttatcacaccacatgggctttttatcctatttggtaagttcatttttgctattttattattgtctacaggtgtgaattgagcacatttcacttttttagtaatatgtattgattacttctgtgtgccaagtattgtgctgacactgaggataaaacagtgaataagacttagtaagtaattacagtgatgatttatagtatgggaaatataggttttgtaaagggagtgtaacgcagggagacctaacctagcagagggactcaatagaaatgatagttaagctgacttgttcaacatgagtaagaatcagccaggcagaaagggagggcaatgtcttcacaggggaggggagaggggagagatgggtcctggtgcatggaagtgaaggaagcccag

SEQ ID NO: 5530 - DNA, 1230 bp, Homo sapiens
acctaagggtatttgtggccacttaacgactttcacaaatgcttgaatttataaaaatagataccagaaagcaaatcacataaaaataaaacatatatatatatatcctgatttataataatggtaattgacaagtatgccatcgtaaaggtacaaaataatatatgcatgttcagggtacagcaaatataaaggctatactcccaattgagtgccagacactgtgtggtacacaaaagtaccacaagccatagtcctcatctttgaccaaaaagtagaaatgactagcaaaaactgctacaagatgaaattagagtcagggatagatatcaacaagaggtatgtctaagataatcgaactgaatgtcaagttttattcttgtcaaaataggttttcgtgtactaaaaaaaaaaagacaacacgaattgatagcagcatatttcctaagatttagtatctccaccaatttagagctcaacaggaataaacattgaatacagctgcaaaaatggtgaaatcaatctctgactgatttaacagaagtaaatggtctacagccataccaccctgaatgcacctgatctcatctgatctcagaagttaagcagggtcgggcctggttagtacttggatgggagaagtaaatgaaagcacgagggtaatgatggctctattagtcagcttatgtgaggagtactgtgttcaattctagactttaaacatgacaaacaggacctgcgtctcagagatgtgagaggtgataggagatttgagaccgtttcatatgaagtagtaatgatttttagcttagaaaaaaaaaacatggaatcatacactttaaaacgactaaaatggtaaacatgtatattttgccacaatttttttaaaaacacatggtaaagtggggcacaagagaaggtatcactggagtgattaacaattgaaaaatgaaacaaagatcataattaccattttggcataatgtgcatttactgggtcagcatactgaagcaaggcttgaaactgattattctttgtaaaggtgataatcttcaagactgtgccaaatttagaaaatatctggaaaacagttcacattaggttaaatgtaaaagaaaagtattaaactgatgtatctttataaatacaacttgttcataaatccttttaaatgaaaattttctcttgaaaactttggtaccaaaatgacttaagcctaaaacattaac

SEQ ID NO: 5531 - DNA, 1178 bp, Homo sapiens
gtgtagtagggagcagtgctgtacacttcctcggaccatagcggggacggcgggttccacacctgtcggggcagtagggactgagctcgtgcgcgcggaggatggattgctccaacctctcggtccagcgcgccggccgccgcgtgcgaacgtgtgtgcggcaggaggctcgatctacacctcctcggggcagcaacgactgcgagctcggtgcgtgccgtaggaggtgtcgttacacacttcctgtgggtctcgccgaccacggcgcgtttccggtgccggctggagcccggggtccgagcccccgccccgctcgccggccccgccccggcccgcccgcgccccgccccctgcccgcccgccgcgctccgagccgggcgcgcggagctcggggcgcacggagcggcgcgcggcggtcggccgagccaggctggcgcccccgccccccgccccgctcctcggtccgccgcccgccgggcgccttccccgctccacttacctttggtgcccggccctctggccgctctcctcccgccctcgcgccccttcggcccgtcccgtccagcccgggctgcccggctctcgcaggcccccccgcgccgaccgcgttcctatggacagacgcacagacacctgcaggtgggtgagagcccgcgcgcggggcggggacgagtgcgccgacgccgcgacccaggcggggagcccctttgtgtggggggcggccgcgccggggtcgactctgcttccccgtcagcggccgcgcggtgacccggctgaaccttccttttgtctcctctcgggggagcgaggccggagcgagggcagggacccgggcggccgctcgtcggcagcgccgggcttgggggtgcgaggcgcagagacccccggtggcggctccggtccgcctgccccgggccgccccgccgcccggcagctcgggtctcagcggcggctgcaggcgcagtgcgtggggctggcgcccccgctcctgctcttgggtctgtcggaggtgggaaggagggcgggaaggaggaggaaaaggtctgtcctcttagtttccaagtcttgagatgcttatggagaaagagaggtggttcagggctctgccccactagttttcctcctcgggtggctcgccgaggtgcgtttggggcgtgtgtgaaggaacgtgcatggct

SEQ ID NO: 5532 - DNA, 1142 bp, Homo sapiens
gatgttctttaaacatagcttaaggaaaggtggcggttcagttgtttttagaaacctaccaaaggaatccttttctagcatctggatgaacccaagcagatatggagaaattttcaagatttttcttttccctccctggaaaatttgcttaagtttttcagctctgaagttttacaataaatttagaccagtttactacagccaattcaaggaaggatcaatcaacccaacttaaaatccataaaattcacggctttaccaaaatcttgtttaaacagcctttgaagattcttttaaagtttttttatgttgatataacttccataaaatgcataatcttatgtgtagagtggagtgatttttcccccttttatttttagttgagatggaatgattctacgtgtttttgggatacagagtaatatttcaatatgtgtatacaacgtataatgatcaaatcagggtaattaggacacccatccttgtgttgggaacattcaaaatcctctcttctggccttttgaaaatatgcaataaataatagttaaccatattcatcctacagtactgcagaataccagagctcattcctatctagctgtaattttgtatctgttgactaacctctatccatccctctccctttactcttcccagcctctaacacacacagttctactctctacttccatgagctcaaaaatttatctcctacatatgagtgagaacatgtggcatttatttttctgtgcctgacttattttgcttagcatgatgtcctccaggcttatccatgttgtggcaaatggtgggatttctttcctttttatggataaatagtattccattgtgtatatacaccacattttctttatccatgcatcggttgatggacatttggtttgattacatgtcttggctattgtgaaagtactacaataaacatggtggtggagataatctctttgatacactgatttctttgatacactggttttcttttctttggataaatactcagcagtgggattgctggattagtattgtagttctgtttttagttttttgagaatcttctatatggttttctataataaatagcctttgaagatttccatgaaattttagctgaaggtgctccc

SEQ ID NO: 5533 - DNA, 1462 bp, Homo sapiens
aagggtgtcattggagctgcatcctcttggttaatgcaagtaatagacacaattttattattgagggaccatctgaacctctctgtcagtgactttggaagtaaaatgtaccatggaaaagctcatttctttattgcttgtttctctttttctttctctcctttctttccccccttaggcaggaattattataacaataaagaaaagtaacaaaatttttctccaaatcccacaaccatcagtcatcagctgtttttacttttcctggtattctcttccagtccctgctcatctacagcgaccttaactagattcagttttgaagtgcgttttttttttatgccaaatgatcatatttggaacaaactgaagtaattgagctataggattatcttgggtaataatggcttcttcttttgattatttccctttaggagtgacactgctgatcctgtaacatggaggattgtcttcatacctcatctgagaatctgtccaaattggtcagctgggcccatagccatgggactatttgcagcctcattccaaacctgaaacacttgctttctgaaggttcccatgggaacctgacagcaatgtggggctgtagtgctggccatgcttatcactggccactaacagctacttgcagagctgggtcccaagagagggtctgtttccaggataacagaagttttaactctgatagtcccagtataatcggggtgccctctgagacacagactagccctgttgaaaggtaccctgggagaccagtgaaagcaaagctagactgtaaccggaccagagactcttgtgacttctcctactgtagtgagccctctgaactggatgaaactgttgaagaatatgaagatgagaacaccctgtttgacatggtttgtgagtcttctgttacagatgaggatagtgactttgaaccccaaacccaaaggcctcaaagcattgctcgcaaaagacctggggtagtcccatcttccctccattcaagctcccagacgcagatggttgacgaatgcagcaatgatgtcatcatcaagaaaatcaaacaagaaatccccgaagattattacattgtggcaaatgcagaactgacaggaggagtagatggaccagccctgtccttgacacagatggcaaaacccaagcctcagactcacgctggtccctcctgtgtagggtctgctaaactgattccccatgtcacatctgccatcagcacggagctagacccacacggtatgtctgcatccccctctgtgatctccagaccaattgtccagaagactgctagggtatctctggcttcaccaaacagaggaccccctggtacacatggcaccaaccaacaggtggccatgcaaatgcctgtgagcacatcccatcctaacaaacagatcagtatccccttgtctgccctgcagctgcctggacaggatga

SEQ ID NO: 5534 - DNA, 1207 bp, Homo sapiens
ctctggttcatggtaaacatactctagctggtattccgtatacttttttggatgtttaaaaatgtgattacttttaaaaatagatcatgaagcataaataaaattgattgtggaatatttacgaaggcattgtaacattattgctgttaccgaatgtggagtatttttgttagaaagcaaaagttactactactgtcttctagtatatttgtttatggacaaggaatttgagaattatcctcacaaattttaacactatgggttttctccttatgattgtgatgggatgctgtcatgggaaagtttttttaaagttcttctgttggaataaataaaaaacacaaaaataaaatgtctgttatctatgcagtacttttattcgaggatcaacattgcctgagttccacaaagtgagaggttatttcctttattttactgatggaaatgacacacaaagaaggtagatggtttggttgaagttatgacgggtgagagggaacctggccccctccttgtgaaccgagagggacagggttggcgaccagcatgcaccatgctccccgccccgcctttgcctgcattggtacaggagtagtctaaactgccgactgcttccccttcctctccttttatgtcacatcatgcccatcacttatccaaagtcgagactgctaggttatatcctaaagaggtcatttatttttaaaattagaatcaaaaaggacctagagtttaacagaaggattgactgaggatcagggagacatgtctcttagtcttttttctattaagtatctgcacaagtcacttacacttcagtttatcagacctgtttttaggatcaactttgtgacaagcactgtgctagactggtggagataaaaagaagaatattaaatttcctgcctcaaggatatcattgtttataaaagaagcagacaaaccaacaacttcaacttcaagtgtataaggaggtgtataaaatatagctgaagatttatgaagagtggttgactcagcctcagggaacacatggaagtatatttcaggtagaaggaataacgtgagcaaagatgttagagaagcaaggagttgactgtagcttgagaatatatctcaatggagccaggagagttgctgctggaaagatgggctggaaagccacctgtgaaaggctgtgcatgtgatgtcacagtgtcctccacgg

SEQ ID NO: 5535 - DNA, 1404 bp, Homo sapiens
atacataagtgtttacacacacacacgcacaatatgtggttaagcctggtaagcctgctaaaatggcaaagcggcctggcgcgtggctcacgcctataatcccagcactttgggaggccaaggtgggcagatcacttgaggtcaggagttcaagatcaggaccaacatggtgaaaccccatctctactaaaaatacaaaaattagccgggcgtggtggcaggtgcctgtaatcccagctacttgagagtctgaagcaggagaattgcttgaacctgggaggcggaggttgcagtgagccgagaccatgccactgcactccagcctgggcaacaaagctagactccatctcaaaaaaaataaaaaataaaatggcgaagcacctgtccatgtgtttggccaaagccgtcctccgaggtcttaagggggccagagtagcagtcctcgttggcgttctaaggcagttgttctggcttccagtcagctctaaaccttaccttctggggactccaggattttctgctcttggcctaatgcaagagaaaggagaatccccagagaaagaagtggggaggtaaagagcgttttctccacttacctttgggttttttatgctcccaagtagaaataaatatcaagaattcacaggttgactgaagcacaagttgcccctgggctctgtgtcaaggctggtggtactgtaggtgttatgagaggacccatagggtgtccttcaggtgagctgttgtccacagcacctttcatatctgctgtaaagggagccctactttctgtctatcccccccaccgccggcccccggaatctaagcagactccctgttggaagcttactctggcacagaagctaggatgtcaccttaaagggtgtgattcaattgaatatagtttagtgcggtaccaggcacatcataagcatgcaataaatgttagccagcttagttataacttttggtaataattaatattatttaactaatttgcattataccacttatttcttccattatggagattctgtctcccttaaactgttaaacttgaagaagaaaccaaacatgataatctggtcaagttaacacattttcgcccatgaattctacctccaacacagccaagctctgatacctcagatataagcaaaaacaagtgaaggaagaacagaaaagccttatggggctttatgagaaggtttttccattgtttagtgtgtttgcaaaaaggaattttatggaagtacctaaccaaagctgtgacagaagggtctccttggtcatgtggcattttccagctttccttggattttatgctacattaatttgccctggctgataaatggtgtttgaagaaatgtgaaattttgttactttgatttttattttaattca

SEQ ID NO: 5536 - DNA, 2182 bp, Homo sapiens
ttgtatttttagtagagacggggtttcaccacgttagccaggatggtctcgatctcctgacctcgtgattcgcccacctcagcctcccaaagtgctgggattaccagtgtgagccaccgcgcccagccaagaactgattttaaaataaattccatctcagcaataacaatgaaaaataaatgaataaacaaataaatttggtctcaagcattcagaaagagtaattttaatgccttggtcgaagaattgtgactctatttaatagcttaattgcctttttgtttttaatctttcccagcatgctcatgcacattcatctggatacttcatcactcaagactctgcatttgggaaccttattcttcctgttttacctcgccttgacccagaatgaagaaaacatttgcgatggaaaagtgactttgtaatatcaaatgccaaagctactatcattcagtgctacatgaactgtgactttaagaattttggtgaactttgatattttttgtttgtctgaaagaaaggaatgtgtaagtgaaagctgaaagaagaataaccaggatgatgagagctgtggaagctgtatcgtccaaggaattgattatgtaccgtgactgtaacttttttgtaatgctgtttaactctcaatcagactgtgaactggatggtcacgaagtcattccccaactcctagcaagtttgactgaatatatcatgtccacagtagattttcaagaatcatttatagtacttaactttaaagaaacaaggctgcttttaaaaaatgaactaataggcttaaatcaattgcatccatatttgctgtttataggattgctatcagtataccttttgcgtttatagtcaacatgtatcatcctgaaatattctttctggacttataactacttccccctttttcactttaaaacaaacctcaagaataaattactaaccagtcttaaccatcttttataaacatatgctcttataaatgttgtgactagatgcaattaaaaataatagggaatgtggtaggtttttaatttgtacatcctcttatttagtgttaccacataaatgatgagtttgtgtggttctgttttccatttttgttctaactgaaaactttttggctgggcacggtgcctcatgcctgtaatcccagcactttgggaggccaaggcgggcagatcacttgagatcaggagtttgagaccagcctggccaacatggtgaaaccctgtctctactaaaagtataaaaaattagccatgtgtggtggcacacgcctgtaatcccagctactcaggaggctgaggcaggagaatcgcttgaacctgggaggcaggggttgcagtgagctgagacggtgtcactgcactccagcctgggtgacagtgagtctttgtctcaaagaaaaaaagaaaaagaaaacttatgcaagtcgagctcctttttaattaagtaggaagggattaggttaagaaagtctctcaacatgacccatctttagcagtatctggggtgcttatttaagtatgcagtcccactaccctaccctagtcctacagaattagaatctgattcaaaataaagtctgaaaaccatgagatagagaattctatgaaatatcttgtacagattttcgtgatatatttatacacgcatgggtttgtagatccctgaaacttagaggtcatttagctaaaatctacattttttttaacttttaataggattgaaatgatattttacactgtatcacagatacagtattttatataactttttgtaactgaccttatcttggccttgagtcccatcctctctggtggtagcgtaaaactgaaaattccagtttgggtcaatatttagtgaaagttctactttcttttcagagagtttgttcccccctttcttccttagatgttttcaaacacacagccccatcctactcaaaccaagtgaagcaagagtggacaattctagaattggctgtgccatgtaggttttttttagaatttgaactgatttccttcattttgatgaggtggcaactgtccccattgtaatggtcaccattgcagcgaggatagccttacttctgcggcgcagagctcctcagggggcctctggctcctgtccttcctcaggtccatccaactactccttgggcctc

SEQ ID NO: 5537 - DNA, 1171 bp, Homo sapiens
ggtgggaggatcgcttgagtatgggaggttgaggctgctgtgagccctgatcataccaccgcactctagcctgcacaacagagtgagaccctgtctcaaaaaaaataaagaaaatgaatgcagccctgtcaacatcttgattttagcccagtgagacctctgacctatagatccataagaaaatagatttgtgacgttttaagccacgaattttgggtaatttgttacagcagccatagaaaactaatgcatatttaactgcaagaaccaaaaaaatctaggaaccctccatgacaccttcttcctcattccttcatattgaatccatcactctcctcctgatttaacttcctaaatagctattggatccgtttgtatctctgcatttccatccactaaaaacttttattatctctagctctttctactgtgatagtttcctgactattttctcttgtctattctcaacattgcagttagagtgatctttttaaagggggaaagtttattttgttcctcacccctacttttatgccttagatttcagttcaagcatcacttcctttgaaagccttctctgacactgctccccccgctttcacgctaggtcaagtttatttagcattcattcctacaataatgattgttataaatgctcatcaaatggtttctttatttcagactactcatgttagattttaattacacattcattcatgtgattatttgattgatctctattttcactggacagtttgaaaaccatgaaagctagaatcatgtcaagttttgccttatcattgcatccttagaacctaactttgtgcctgtatgtgatagcatgaaagactgctagatctgaaagagggcttagtccccaacacaataaatatttgttgaatcaataaataactgaaaacatgttaaacatgttaatagtgccacagtgacgttgctctagtactaaacataggtgtctcaactatggtactttaatgtactatatagttgtgaagagtatatagcttgtaggataaccacttgacaggatttaagtaatcttttaaaaattattgttatgaaagtgtagtagattgtccataactgcataatcaaaataattttcacttttagctttagattttttttacaataagaagaatttcagtta

SEQ ID NO: 5538 - DNA, 1190 bp, Homo sapiens
acaaacacctgtggaggcaatttggcaacatatatcaaaattacaaatacgtatgtttcttttgattcaacaagttcttttctgtttgtgtctgtcctgcggataaactagcatgtgaagggagaaggctttctttcctctccacctctagttaacatcattcaagacctctacattgaggtcgtttctgtcttttgatcctcccttcacttgcagaagtgcttggccgcatagcatcctgggctgtggggctggcacttggcatcacttctccatcactgcagtgccatcctgcaggaaagtgtccacttccccaagagcttgatgccaggagtctccactactgtgggtgcagccatgtccatgcagtcatcctgagggcacaactaaggcatctctgtagcttggcatggaccaggcaccaccctggcacagacaggaagagctgaatcttcacttggcttctgggattccactcactgttggttccttatgtaccttactggctgttcctcctctgtctccttggctggttccgtctcatctccctagctctaaatgttggactgctgtaggactccattctgatatggcctctcttcatctgcatggtgtccctaagcaatctcatccagcctcacacatctacacactgataactccaggccagaaacctctctcctgaattccaaattcctgtctcccactgccttcttgatgtttaaccctgcatctccaacaggcatgtcaagctagttatctagctcactcttaattccaaggataagccttggaattagcctcggctcttccctttttcatcccatacctaagccatcagcaagtgcttctgaaataccatgtccagaatctcatcacttctcactctctccactgctgctaccctgactgctgtcatcccctcttgcctgcattactgtaccagccgcctgactcgtcttcctgcttccaccttcccaccttcagtcatatatccaggcagcaaccggagggattatttaaaacataagaaacatcagtcgcatcatgtctcttgctttttaaatttaattaattaattaattaatttttgagatggagtctcactctgttggccaggctggagtgttgtggtgcggtttcgactcactgcaacctctgtttcctgggtgcaagcaattctcctgcct

SEQ ID NO: 5539 - DNA, 1238 bp, Homo sapiens
atgaatgtgaccaacttgaacatgctgtgagctcacttagccctgagctcatcttcccttcggatccttaattcttatgctttgttcaattcggaaacctcacctaatgtagggatggtctctatatatgtcttgtttctgaaatctaaatctccctcaacccctgcttccacagcaattccttgggcagaagagaccaggaagccctattcagatagtttcattgtgccttggccactgcatgttttactggcaacagcaagaaattgagaaaagcagagtcttgagaatgattcaatccttttcaaaaagcaggtattctagcttttattgaaaggcaaaattaattcggactgactctatgactaagtagctaccctagggttcttaaacattgatagaagagggacccaggggaggaaagaccataatccttgttaatccgcagatggagggtttgaatgttgggctctgggtcacctctgtgggaagtcatttcttataccccaacctggaataaggggacttttcacatataactatggtgtccttttcaaaggaagattgcattgaaccaagggtttattgttatcttgggatgtgtgtgtgtgtgtgtaagtgtgcacgtgtgtgtgtgtgtgtgtgtacttctttctggattgtagaggtctggcatgcgttcagaaatttccagagacaaaggcctggatctttcttccttcttccagtaactcagatacaattggaagtatctacccccttaattgttgacttactgtttaggatataaagaggaactggaatctaacctccaaaaactcaaaggagctattgaaacacaactagatatataagctgaaaaccaattgcattggatttaggacaattgaatgtttggaatatctgagctatgagacctgagagactgtgccattttcccaataataaaatgaggagttagtccattgaggaagagccacactcacttaagttgaaatacttgacttctagccccaagagtcagccttgcaagatttcattcaaggaatttttgcttgttgctgacttgtccctttactatacatgcatcattcaggaaggatgtctaatgagattgtaaagttagagacagtagctcaggagcattattgagccttaggatgatgtagcaaacaacaattagagttgtatgtcttctgcaagagaagaccataactttcacaaagttcagaaaagag

SEQ ID NO: 5540 - DNA, 1148 bp, Homo sapiens
gtgggaaatacattgtgcctttctctagatgtgatacgttataccaaaatctttgtagtgtgcagagcggtggtttgagactaaatacaggcttagaacttgcagagtgtgtattcttggatggctgatgcatcgacttgcattcccacttaacactttgattagcatgaacttgccaatcaaaaaatgacaatcaatttgagaaaatagaaatagatatttttaaataaaaccattcacagtttactttgtcttgataccttggtttgtcccagctgaagtgaagcaagagagtttgaattaatttttccattataatgttttcgcatgtctgcctctaaaactgtgattttcaagctttagcgtgcatcagaatcacctgtagggcttgttaaaacactaattgctgggcctcaacccaaaagcccccaaagtggcacttctgagttcctgctgatgttacaagggaccacacttttgagaatctgtgctttaagctaaggaaatattgcctggtgggttggctgcctggtattgggcatggaaatttgaattgctgattggtagatggtgtgtctggacttaactcacgtagtaaatactgctgatcaatacctaatcattccacatttattgagctccacctgtgtgtatgtgtacccaagcacacatgtgtgaagggctatagccaaagtatttttactagcctgtatgaaatcactagtccttatttttaaaggtctatggtttcttggaagtagtttgattgttgagagagacctttgatctgcagtgtaaatctaccagtcatgggccagaagggcaaaagcccagctttctctttggaaagactcaggctgtggtttgttgatggccaggttttcctcaggctccaacaactgtgcttataccaagcagatcctcatcctccatataatcatctttgttattcgtgggggtttaattacattacaagtggccaaaacccctgttctcagtgaagaaccacattggatttgtattctgttcagttgtagtctacactgcagtcttattcctggttcaaactacctctttaaattgatttgtcttgtgctggtctgttaaatcctgccctccttggtgctagatccagttgtgcctcaggg

SEQ ID NO: 5541 - DNA, 1199 bp, Homo sapiens
gcctctgggaccgcgggcccttcagttgtcctcaggagaccaaagccatttcttaaataaatagatgatcaaggtgagaactcaggtaaaggatccacttggttcattcggtgactgacaacccagccgagtgattaagccgtgctttcctttactcctcagttcaggaggctaattttgggcaagggcgtgattcttcgaagatatgtttattgtgcttagatctcccaaaaggagagtagtcagtcagccttgaaggtttgaaggtcatggtttttcaggtaccgtgttgagaaaagccagtagccgttgtgtttttcaacagtagcataaattagttagaagcaaattggtcatcacggtctcattggtgatagatatcggctccactaaatcatggaatcgtggctttcaaatcttgctttctctcttgcactttgtggctgggagtttttatgcctgcggtttctgcagagggcggcccacagggtgtggtacgtggccggtctccagcttcagtgtctctgagtaggcattcagcaagctatgggacaggcctcaggctgccttcatgtgccttggaagacttgtgggtaggggtcacctctggattcaccagctgagcaggtcagagggcatccggttgggagcaggagcctgcatgggagataagatagtatgtggttgaggaagaaactgtcagtcacctcctggtcctggaataagtggcccttcatgtgtgtatgggcacgtccctgtatgggatttcacctctggtgctgcatgttgatttttcagccagaggtacttgtggcaaggaaagctattcaaaatgtgcattatcagctgagcagtgtaagagtttgcagcctcaattgtggtaagtttaccagcatgctggtcagaagtcctccatagatgagtaccagtcacccaacgtacacaaggatgaagatggagtaggcagtcacttctccacacaaggcctttttcaaaaggaagcacctccccctaaagtgaagtctgattctgccgtcttggagggttaggagtacatccaaccccagtaacttgacaatctcactctttcctctgttttttcacctgtgaaatgggaatgacagtgcagccctcacagggcttttgggagaattagagggaacttggatgtaaagtatctggtccagtgcctggtacat

SEQ ID NO: 5542 - DNA, 1225 bp, Homo sapiens
aaggggaggtgaagaaaacacacctccacctggcaagtttttctccctcatctgaggtcagttgcttcaccaacaaagcccaagccaagaactgcagcgttgagggttgtccctcggagtggagtagcccaaggaatctcaggtccaccaagagcattggtaccatctgggccacgggtggatgcctttgttctggcacagttctccacttcccgattcctggctcagccagccaggcctccctctaatggcatttagtaaccaggaaacaaaacacatgccacctgagcaaaactgcctgcacttcatctctggaggttcgctgcacagaggccacctgccgcatcaccagtgaggaagctttgccaccatcctgcttggcagcttcacacttgacatctgaggattggtttttggctggaaaaagggtaccagggtttcctggcaaggacaggagagcagtgcagtgacacagatgagaagctgtgagtctccaggattcaaggaagccaccaggtgtgcaggctgggaagagacatctctttcagtttgaccctttatctcctgcacttttaaagaaacaccagagaaaaaatctacaaggcgtgtttccactgaagctgaacctctgcctttaggagtcccctatatttgagcaaggccacctgcttcccctggacttgagctggactccttgaagagtgggcttctggagagatgttaggaatatagcacatgctctctgggggccacagggtcattgggaaggtttgaaatgaagatgggatgtggctggaacagcctgtgagatggctccattggggacactcccctcatcttgtcatcacgatggatatgctggaagaggaggtgtcccagtgagccgcccgaagttcatagctttgccctcgccttggcaacagcggcaatgcctctatctctgggatgcatcttaaggagggctcctaacaaggccgatgatttagacagaacaagagactaagtaaggtccggctatcccgtggagccagtagtaggtgggagctcctgtccccgccagccctgctccagcccccgtgtccagctgggccagtggaagaactgggaaggaggaagcccctccctttcactgtggctaatgtttgctaggccagttatggtgaaccaatgatacagtgttttccctcttaacgttcccctcctggttttgccttttcagggtttt

SEQ ID NO: 5543 - DNA, 1129 bp, Homo sapiens
ctctctttttttttcaaagatagggtctctttctgtcgcccaggctggagttcaatgacgctatcacagctcactgtaaccttgaactcctgggctcaagggatccacctgcttcagcctcccgagtagctggtaccacaggcatgcatcaccatgtccagctaatttttaaatattttctgtagagattgagtctccctatgttgcccaggctggtcttgaactcctggcctcaagcaatcctcctacttaggcttcccaaagtgctgggattataggcatgagccatggcgccacgctgggcctgaaagcagaatttcttagcaaaggctcagctgggaggttttgtttaatccaatcagatgggaatcctaaagtccagaaaggggaagcatttgcccaagatcacacaggtcaggatgggccaaggccagactccagttgttctggggttgggagagtgagaatcggcatcatctcaggcaggctgagctgccatctgcaaactccatgccgtctgtctgtctgtctctctctctcctcgggggcattccatcacatagtccccttggcccttcctccaggagccagggaggaatgtgatttttcattctctgcctggcctccctccgagacgtctccaggcagctccgacaagaactccagttcccattcttgagcctggctactggggcagcctttgttcctccaatgcttcagagctgtgcccccacctcagagcacttgccaggggcctctgtagagcctgatcgggtagcaggaaacagaggcccagagaggttgggcacattgaaaccacacagcagccagacactcagatcagtcatggaggatggacaagggagagaggagggtattttcagggtctccctttctctgagtgcagacttaatgttatggttgtggctgagggagtgatggagtgggcagaagtgagatttgagggagaaagcgtaggctggttaagagaaaagtcagccgcttcttcactctgtaccagggttcctggaccttggcactactgacatttgggctggatggttattcgtggcgggggctgttctgtgcactgcagcatgctcagccacatccctggcctctgcctacc

SEQ ID NO: 5544 - DNA, 1173 bp, Homo sapiens
tggtgctggaccagggaggagagatctttaaaaccttacactacctcagcaacctcatccagagcattaagacgcccctgggcaccaaagagaaccccgcccgggtctgcagggacctcatggactgtgagcagaagatggtggatggtgagaaggcttcctgccgggggtgggtgcgcctggcggtggggagctggggcaggtggagtatttgatttccgccgcattttggctgagtttttgtcctcagcaagacagatacactggcagtcatttattcactcagcagtcacagagcctcacaatataccaagatccgcatgctggggatgaccatttcagtgcaaagagacaagagctctggcagaaaaagctcctgaggctgtaagagtccccacccctggggcccatcctgtcacaggctcccgggtgagccaggattttccccctttctgagcatgaggactctgctctctcatctgtgagctgatgtggtgctgtgaaggacaagctgcggagccagacagacctgagttccaatgtcagttctgcctcagacttggtctgtgagctggggcaagccacggccccatcccgagctgcccttgcctcctctgcacaagcggctgggactagatggctggttgttccactcttgagctgcaaaggttttggcttcctgagaagcccagtggggaagctagatgtaagcagcagcgctggctgatggggtgggagacctgactcctaccctcccccggcaggccctaggaggagccctaggcctcgaagaatccattcaactaggtgatcccccaaacccttgtgcaagtgacccagcctctctcaatgtcagttgtcttctctgtaaaatggatacatcccagtagcaacataggcaagtacttagccatgtgacccctcctctgggggctctgccagttgtgagctctgcccagaaggtttccttccatctcggttggaggaatcccttttctgctcacccaccctgacttcatgctcacctggggctcggcaggtcacaagatgcagggtccatctacagaaccaaggaatgggctcatcccccagatacatacatcacctccatcccacgctgcctgcaggtacctactgggtggatccaaaccttggctgctcctctgacaccat

SEQ ID NO: 5545 - DNA, 1237 bp, Homo sapiens
tttgtctgtgacattcggccagaaatccatgaaaactaccgcataaatggatagaagagagaagcacctgtgctgtggagtggcattttagatgccctcacgaatatgaagcttagcacagctctagttacattcttatgatatggcattaaattatttccatatattatataataggtccttccactttttggagagtagcaaatctagcttttttgtacagacttagaaattatctaaagatttcatctttttacctcatatttcttaggaatttaatggttatatgttgtctttttttcctatgtcttttggctcaagcaacatgtatatcagtgttgactttttctttcttagatctagtttaaaaaaaaaaaaaaccacataacaattctttgaagaaaggaagggattaaataatttttttccctaacactttcttgaaggtcaggggctttatctatgaaaaagtagtaaatagttctttgtaacctgtgtgaagcagcagccagccttaaagtagtccattcttgctaatggttagaacagtgaatactagtggaattgtttgggctgcttttagtttctcttaatcaaaattactagatgatagaattcaagaacttgttacatgtattacttggtgtatcgataatcatttaaaagtaaagactctgtcatgcatttttccccattcttttttttttccctgtctccgtgacaaccagtggttcttcatttttgatcatgcgaaatgcattttgacccagatggtctgcagaacttcacttaggacattagcacacaaatagcacacatatcacatacccatttatatacataattagaaaatgttcctgatacatgtgtcatgtgatttcttccaacaaatgttttggaaaacagcaagcaactagtctgtaggttgtcttttctctagagatccttgtcctgggacagcctggggcaagttattaagcatatttccttcctggtgggctagatgatgtgcattatacctgtagtaccttcatactagcccttacaagttaaatgtcctgtggccatcttagccgaaagtctttggttgcaaaatcttataggtaaaaacagttgaaagaacattatgggatttccttgcttgttctgatacaatacaactagatgaccttaaaaaccctcatatttaatatgactcaggattttatttttcagaccactactgtctctagttact

SEQ ID NO: 5546 - DNA, 1222 bp, Homo sapiens
ggtagatgggtctaaaagtgcatgccaccactcccggctaatgtttttgtttttgtttttgtttttgttttgtagatgcagggtcttactatgtttccccagctagtctcaaactcctacactcaagtgatcctcccacttcagcctcccaaagtgctgggattacacgtgcaagccaccatgcctggcccatttctataagtagatgtgctgagtcagaatgtacatgcttgtttgtttgtttgtttgtttgtttgtttgtttttgagatggggtctcgctctgtcacccaggctggagtgcagtggtgtgatcttggctcactgcagcctccacctcccgggttcaagcgattctcccacctcagcctcccgagtagctgggattacaggggtgtgccaccacgcctggctaatttttgcatttttagtagagacaggggtttcaccatgttgcccaggctggtctcgaactcccgacctcaggtgatccacccgccttggcctcccaaagtactgggattacaggggtaagccaccgcacctggcctatgcatgcatttttttattttaacagatattccaaattgttgggaaactctcagaccccagaacttagctggctgcatgctcggccagccctcagagacagcatgattggaggcaggagcaggaattggcaacctgagaagtagataccacccaggcaccctcattcacaaggatccaggtagtgggctactaaaaatgaagttcattcatttatttatccacaaatggacattcagtacctgctaagggacaggcattgtactgagcaagagtgaacaatacacaccaggtccctatttagtgtgcctgatttccaaacaaaacaaaaacaaaaaacaatttagacgcgtgggagcaagagcctcaagagatattgaagctttactcactgatgataggatattaaaagggatcctgcaacaggtgtgtggcctgatcaccatctatctaaaccctacctctccaacaaggttgccctcctccatgaagccagatgtggtccccctgccctttctgccaggctgcctttactcttcattctcactgctggtcactccagcgtgaacttagtgctgacacatcaatctcctataccagggaggcacagaagacaggggcctttggagctggcccaccaggctctaccacttactggcatgtggcattggcag

SEQ ID NO: 5547 - DNA, 1376 bp, Homo sapiens
tttcttattttctatccaagccctgttcactcaacatcttcattatgcaggtattggtgaaaattaactttgatattcactagcagtactccattactcataggaaatctgagaatcactgaagtgaagatttactgtatcatgtctacaaatcactgagcactttatatgcactattttatttcattacgtcctactgtgtatgtggaatgtaggtataaatatcaccacttacaaataagaaaaaatgaggttcagagtttatgtaccatgcataagttcacagagatatgaaacattagagtggggttcaagccaagttctggatgcaaacccgctgctctaaaagctcatcatgcttttccacctgctcccccgtccccctgagcgccaccctggctgcaccacactcgcttggagcttctggctgctgctaagctagtgctgccgtagtctcccttcagccgccatcatgattatctaccaggacctcatcagtcacaatgagatgttctccgacatctagaagatctgggagattgtggacgggctgtgctgggaggtggtggggaaaatggtcagtaggacagaaggtaacattgatgactcgctcattggtggaaatgtctccgctgaaggccccgagggtgaaggtaccgaaagcacagtaatcactgctgtcgatgttgtcatgaaccatcacctgcaggaaacaagtttcacaaaagaagcccacaagaagtacatcaaagattacatgaaatcaatcaaaggcaaacttgaagaactgagaccagaaagagtaaaaccttttatgacaggggctgcagaacaaatcaagcacatccttgctaatttcaaaaactaccatttctttattggtgaaaacatgaatccagatggcatggttgctctactggactacggtgaggatggtgtgaccccatatatgattttctttagggatggtttagaaacggaaaaatgttaacaaatttggcaattagtttggatctattacctgtcatcataactcgcttctaattgtcatccacacaacaccaggacctaagacaaatgggactaatatcatcttgagctcttcatttatttttaccataatttattcggagtggaggcattgtttttaagaaaaacatgttggctggggggcagtggctcacacctgtaatcccagcactttgggaggcaaaggcgggtggatcacaagctcaagagttggagatcgtgctggccaacaccgtgaaaccccatctctactaaaaatacaaaaattagctgggcatggtggcgcaagcctatagtcccagctgctcaggaggctgaggcaggagaatcacttgaacccaggaggc

SEQ ID NO: 5548 - DNA, 1266 bp, Homo sapiens
aaacaaaccagaaatgcatatattgtccacagcatttcccaagcagcatgacttgcaaagtgaggtctgggtatgattcctgttctgtaggagactataaatcagaaaaggaggggggaaaagcaagtatatttttatttttaaaattcagtattttttctccaatatttaattaacccatagcattaccccaacatttggaaaagagagagaataaattacccctaattctgtcactttaaaacaagcacacagttaattaacgtttggaagtgttccttctgtatttgtgtgtatgaacatgtggatgcacacatctctcctggaatgcagctttgtctcctgttcttgctaattgccattatgtcatagcatctcattccttcttatgaatgtgctgaaacttaactgcctcactgctgttggacatgtaggttatttctagtgatttgccatttttaatttcctaatgaatgtctttggacacaaatctttttctgtgtttagaggtttttttttttttccttagagttgattcccagatatgtgtcattagtaggccaaaggacagatagaaatatgcaataggcataaaatttattttcatttatttatttattttccccctccccccaacaacttttaatgtgtaaaagactgtaagtagtttgaaggccctgatagagtttgtcagatttctttctaagatgctggccctggtgtagagcctcaccagctgggtaccacggtgctcagttcctgcctgttggtagttcacgtagacaccaccaaacaaacagaacaccaagaacaggtatcctgttgttgctgtgtacatttaaaaaaatctctaatgaggttgcacctattttctcatatttatttgctggtttttcatgcattataggagaattaggttgaaaatcgatatagaggagtgatttcagcagagtgtagtcaggacggtgagcatagaaagccaggaactgtataacttgtggacctgccctctgattataggctctgtgtaaagaaagcatgtggcacaggtcctggcacactgcaaaggctcgaaagggttagtcactattattatttacttatattgtcattattaagaatggttagaaaactcacttttttttgacgtagagaggaaacctggacaaaggggcatagtttaattgaactcaaatatttgtagggctgtcatgttgacaagaaatagaccttatgtgactctaaaggacagaaatggttgtcaga

SEQ ID NO: 5549 - DNA, 1179 bp, Homo sapiens
tctggtgcctcccatccccagacccaccagacaccacacagcagacaatacacacccactcgcacaagcttccatccacatgtgttgtactttcagctctaggcatgcagacaaccccacacggccacaccaccacatgcccaagtgtacacacacagagccacaccgtccctctgggcctgctggctcctcccttggctttcccttggcccacttccagggcccaggtgctgcaactaaatgtgaaagctcagtggccgctccttctttcagcccatcaaccagcattggtcccatagggaagcacaggggactcaccctctttcatatcccttgccctgccctgaaatggacaatcactttttgggataggttgaaatttttaaagagcctgcatcatttggttccctcaaagggaagcccttgccagtgggggtttgaaagagaatttttggaaccaacattcaaattctgcctcatctggagggaaaccaaaattgggagggggaagaggacccctgatgttttgctgcttccagagatattagaaactgactcacttgattggaaaatggacaaaagtgccttgacgtggagggtgggcaccagatggggaccagccttgccaactgctgctgtggcctccagcttggctggttttgcaggccgccagcaggaaggcgaaggtggtagtacagcaagaggcactggcggggcagcaggcctgcaggagctgtttttccattgctaggcctgacccctctctacctgtgagcgttcagggggtccctgagatagtttagatgcccccccatcttagacctcagctcccacagtgccttttaagggggacctcacctcctgtgcacagcccacccactttcctctgcttccctggcacagcccaggcatagacgagctggcgttggacccagttcttcccccttttcagccccacagctgctgccacaggggccaactagggccaggtggaaggggagctgagaagccaacccctagcccaggggtgctgtgggaactgggatccaatttgtagcttcctgcctggcttcagagagcccagcaaccttctaggcctgctttccagacttctgagatagcctgggatgagcaatcctgttatagtacatctggaccttccctacctgggctctgggg

SEQ ID NO: 5550 - DNA, 1170 bp, Homo sapiens
tatttgtcacaaaagtgcttttttctcactgttgcctattttcatatatcaggttttaaatagttttaattttttaataaaattttctctacgttctatatgcaattgttatatatctatttgaatagctgaaggactaaaatacttttttaagagataacttcaggaaaccattatattttactatctgcatgctgttaactgtggtacactgtgaaatatgttgattacaaacccattcattacatagtataaggaattcacagtatattgactatatagtgtctaatgatcttgggcagatactgtcaaacttacaatatctatatagatgtaggtctttttaaatttacctagtcattcttctatcatgtatattgatgctgaaagaggaactggtcagctcctctggacaacaaattcttagtctataatattaggagacatcttctgttttgcaaatgtctgtgaatctgagcaacctggcattctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtcccttcccctgtaccccaatttcaagcttattttaggaagccttgaactaccatgtatcctggctcctagctgagtttattagaggtatggagcagtgcaacttaaactcaagttgcacttacattttgaattttaaaatgatggttttatctgttgtgtgaagtggttcacccttgaggaccaggagcctccatatcctgactgaaaaccttttctgagacttagagtaacagtgcttttggttccttgagttctcctgtctccagataccaaatgaccttgacttttctgccttgtgaattcgtagtccaatcagctgaaattaaatcacttgggagggacgcatagaaggagctctaggaacacagtgccagtgcagaagtttctccaggtggcctccctttccaacaatgtacataataaagtgtatgcactttcactaatatttttggggtgagagtctgtttcggcctgtattgaatgtctgtggatttccgttttcagaagtagtacattag

SEQ ID NO: 5551 - DNA, 1229 bp, Homo sapiens
agctgctcacagcccggagcctgcctgccaccctcatctccaggccacccccttccccgatgcttgtcgtaggtatacacagccctaaggagcctgtcccatgacccccgctcacatccccattgtccacaggagaagcgcattgcctcgttggatgccgccaatgcccgcctcatgagtgccctgacccagctgaaagagaggtacagcatgcaagcccgtaacggcatctcccccaccaaccccaccaaattgcagattactgagaacggcgagttcagaaacagcagcaattgttaacctgcctgaggagggaggaagctacccaaggagagggggactatggtggccaagggcagggtctcggcctggggaggcacccacggttgcagccccagcgcgggtgtcaggaggccgagcctcccctccctgccgctgtccaggaggcggccgcagagggagccaccagagactgaagcagcgtgaggcgaggtcaccagccgctccctgtggggtgcgggcagaagagactgcacgctggggagtggggacagcctgatggggcagggggcctgccaaaaatatgtctgttggttcctgaatgtggtgtgtccttgtcctcctggatctggccgagtgcatgtgtccccccacacctgtgccagggagggggcttcctggaggggggattcaagggctaggggcctacacctgtggcttcccctcgcctccttggggggcccgggactccctggcagccaggccctgtcatgtgggacctggcacttggcagatcagttggcaggcaggaagataggaggacacagagcaggaggtcagtgtcccctgcctgtctccatccgaagcacctgccactgcatgcagcctgttgggaccttcctggctgtgaggaactgaggattcctacccacccaccccctctgaacctgtccccagagcaccacctgctaccttcttccctgccttagttgtattgccagatagacccagtgagggccatggctttttcttgtgagctcttgtccctgtggggaggacccacagcttcccacacctcccacacaggcccaggctgatgctctagggctcccagaagccagagatctgggcggatctggccagatggctctgagcactgtatctgccttctcctggggcccagcacacccagggcacagtggtcctgtagggagtgccacctggtgctc

SEQ ID NO: 5552 - DNA, 1214 bp, Homo sapiens
gatttttatcttaattgcaagtctgccgattttgtaaatgttcttggtgtttgactgtaatgtaactatctcacctaatggttgtacatatcctttggtcctggtgctgccgagggctggccgggactgctgctctcccaagggttttattttatttctgaatctagagaacagtattgggcaggaggaaaaggcttggtgtctgcggggggtgtcttccctgcctgtggcatttgtgtgttggctttgcagctgctgtctgagtagtggccactggggtgccttcactgggccagtcaacggggggctcctgcccaggccacagagaacctgagttcccgggagctgggccctgcctgcagccagggctggggttgccagaggccctggagggaaggacagtccctgctggggaagaacagccccggggccccctggtcaccgagactcagcctctgctggagaaagccacgccctccctgctagcacagaggcctgactgacttttttgcttaacttccatgttctgggtgatggaaactgccaaacctcctgtcagtgaggactctttccgactgcccagaaagtgggggtggaggaccgaggctacagctccacacgccccggtcccccagagcatctgccccaggtacacctccccctgcgccccgcacgactgcgggagccagactgtccagggaaacagcctctctcttttctacacactcagccacaaagccccccagctcccacaccgcgtcccagctcccctcttttgtaagtatgtgaaaaggaaaaaatgcaaacgttggagtttgggctggagctcctccctccagctgcgacttttaactatgtaataatgtacagaggaagctgttggtgttctaagactctgtgtggctgtgcaatttctgtacatttgcaattagaaatattaaagatttatttagctattttaagcccgactcgtgtctccattcagctgtgtgttaagggatgaccctgagtccggagcggacactgtcctttaccaaggggaccccagcatctggttcactctggtggcattcgtgggcaggggatacccctaaagccagtggtggtggtctggccagcttggctcactgggagatctgggattgccccctcctcctctgggttgaggggtctctgcaccagggagtagagcagttgtcctcttaaaggctctt

SEQ ID NO: 5553 - DNA, 1225 bp, Homo sapiens
cctgaaaaaggaataaacgaatcagttgaagggagaaagcacagaccaattctgatttttctcttttctattttttaggttaccaaaagagatgaagactcttccctaatgcagctgaaggaggaatttcggagttatgaagcattacgcagagaacatgatgcccaaattgttcatattgccatggaagcaggactccgtatttcacctgaacagtggtcctctcttttgtatggtgatttggctcataaatcacacatgcagtctatcattgataaggtttgtgaaattagagatgctgatgttctatcattgctgttacattgaagagtattagaatattctaaagagtctatacacaaacagttggagattcctatgtttttaaatgtcagactcttataaattatccttattttctttttatttttctacttgcaaaataaagggatgcaacagggaaacaaatacatgatactagcataaaagcagtgaggcttacaaagtctcaaatttatctatattctgacctcagagagttaatacagcttataagttttctaagtgtctaatgatgaatttcatagggcagattctgaggtgaaaatttaattcatcactgatactcctactgtggaatctgaagacacttgaaaacgtattaaatatgttgataaattgaaagtatttgagtataaatgtgtcataagaaccaaagtaaaaagcattctcatttctgtttgttagctacagtctccagagtcatttgcaaagagtgtccaggaattgacaattgttttgcaacgaacaggtgacccagctaacttaaatagactgaggcctcatttagagcttcttgcaaacatagaccctaatccaggtatgtgggaatatgctcagttgcttatatttttttctacttttgaggtgaataacacaagagaattactgctaacattcttcccccccaacccccatgcccttggtggcttattttagacgctgtttcaccaacttgggagcagctggaaaatgcaatggtagctgttaaaacagtagttcatggccttgtggacttcatacaaaattatagtagaaaaggccatgagacccctcaggtaagtacatttattacatttctgactgctgttgtctctaactcagtttcatcctgaacatcttaaccagctgttttgttaattggactccgtatgtgactcataag

SEQ ID NO: 5554 - DNA, 1225 bp, Homo sapiens; identical to SEQ ID NO: 5553

SEQ ID NO: 5555 - DNA, 1149 bp, Homo sapiens
aaagagtacagattcaccagaacataagagaatgggatttttctgccagaaggtgagctatggtatgtacagtttagttagtgatgatttgttgtcttctggcagctatacttaataccaaaaaattttaagagagatacacacaatagttgaacctgttatgggcaaagtgataattcagtggtaacttgccagttcaaaattaggaagtcattggcaagtgcatcctgagccctgcattctgtggcttgcgtgaggtatgagtacacatgaggatctgtggtttgagtccattagacctcgaaagggcggttcatgatatgtggttccaaaagcttgtttggaaacaagcttttgaactttttcatgtggaatttacaaaggtaacttttgctctgcaactcactgaaatctctttccattattttttaaatgtttgtaaattgtggcttggtttactcagttgtacagttgacctttgaacaacatggtatgaaccgcatgggtccacttatacgtggatttttttcaataaaagttataccaactatgcctcctgtctccccttctacctctgcctcctccacttctgcctctgctacctttgagacagaaagaccaacccctcttcctcctcctcctcagcctacccatcatgaggacaaccaggatgaagacctttatgatgatccacttccacttagtgaatagtaaatatattttctcttccttacgattttcttaatattttctctagcttgttatattgtaggaattcagtacataatacctataatgtacaaaatatgtattaattgactttatgttttcattatggcttctggtaaatagtaagccattagtaagtaaattctgggggagtcagaagttacacgtggattttcaggtgcgcagggcgtcagtgcccctaactcgtgttgttcaagggttaactgtacttcctgataatcaaggtgagaattggaaatattttgcctcacatgccagtctaggaaaaagatagctacttttgttgtcattgttgtgatatttggtcttttgagaagggtcttgctctgtcaccctggctggaatgtagtggcacagtcatggctcactgcagcctcaacctcccagactcaaacgatc

SEQ ID NO: 5556 - DNA, 1232 bp, Homo sapiens
ggctgctttcctcccttctttagtatcacaaagagtaacagtactctggaattattgcccactagcctagtgaaatttttcttcattgggttatttgactcttctagtgaaattctattaacagctgaaatgatgtctctctctctcctgcaacatcattattcccctgtctactggctcattccagttggcacacacatactatatttcatctattttttttaaacaaccatttcttgaccacagtgccttttttagctgctacccaatttctctgctcccctttacagcaaaacttcttgaaaaagtttcttctgttcatctttagttctcatgttctctccggaaaccactctagtgagatttttaaccccaccactctactgaaaactgtacctgtcaagactacgaagtttatttcttatttgacctattagctgtgtttggcacaaataggtgcttccttttgtgaaacactttctgctttggtttctaggataccagattgctggtttttctacctacttggcttcatagtctcttttttggttcttccttattacacctacctcttaatattggactgcctcgtgggatctctgttgttgttgttgttgttgttgttgttttgtgagacagagtttcactcttgttgcccaggctggagtgcaatggcgtgatctcggcttaccgcaacctctgctgcccgggttcaagcaattctcctgcctcagcctcctcagtatctgggattacaggcatgcgccaccacgcccagctaattttttgtattttttagtagagacggggtttctccatgttggtcaggctggtctcgaactccggacctcaggtgatccacccgcctcggcctcccaaagtgctgggattacaggcgtgagccattgcgcctggctgactctcaaatttttatctctagcctggaactccaggcttgtgtatgctactgcctacctgacatctcttatatcttctatccttatttcaaattgaacttaccctgtctcctcttccccgtgtcccttttataatcttccatatctcagtaaatagcagcttcatctttccattttctcaggtcaaaacctggagacattcttgactcttctcacccattacatctgatcccttaggaaatcttagcagctctgtttaaaatatatccagaatctgaccacttctcatcacttgcactggcataagcctacatt

SEQ ID NO: 5557 - DNA, 1148 bp, Homo sapiens
tttacactgtttatgcttccagatgtttgtgcagtgtctaaggtaacagttaagtcattcttgttgctgcacggaagagcaatcatgcccttctcttgtgtaatgatgggatttgcttcctgctgtccctgaacagtattgtagggaggttgaagattgatgtcaagggaccaagtgcttcccagcacttgtggggatggtggggtggggggagagtcacgtgtccaccaagggccaggtgccgtgttcactaatgacactctttgcctcccaggcacccccattttgcagcacttgagaactgaggaagttgaatcccccaagatcacagagctgggatcgggagagccaagattccagtccagcctgctcactgcgttgcctgaatatttattttcactgtcttctgccctctggcaccttgaggagaatcctaactctgtgcttttgtttttctcttactaggcttggccggtacaggtgtgagaaagggactactgcagtcctcactgagaaaatcactcctctggagattgaggtgctggaagaaacagtccaaacaatggacacttcctgaatggcatcagtgggtggctggccgcggttctggaaggtggtgagcattgaggcccagtaagacactcatgtggctagtgtttgccgaatgaaactcaactcaataaaaaacaaaaaccaaattgggcagctgaggtctgggcactgtgtggtgtttttgggggcagtagggggctgctaaggccattggcctggcccttcagggtgctgatcctccttgagcactggcctaggctcagaggagagcgtaggagccatgcgcccctcctgaggacagataggttctgtctgctgtcagaagtcagagtggactcccttgaggcttcaggtgaccatcgatacctaccctttttgctggctgaatttgtttggggtggcctcaggtttggtttggttttgaaatggggtgataagtgcagcacaccctccacctcagcagccaagtaggaaaaaaatggcaaagccaaagctgtgttctcaagcccagctcagttctgagaaccaagagaaggtgagcaggtgcaccgccagagctgtgtgaaggtgggtggacctcactttggccggtttca

SEQ ID NO: 5558 - DNA, 1192 bp, Homo sapiens
cgactccctgggccatctgacctattcttcaatactctgctaaagcagcaccagcatctccagctcaactcctgtaggtcattgtcatgtccaagcttccaggagccaccccaacaacatatcagggcttcctcaaggtgtctgggccagtacactaaatcctgagtcataggtaaggacacccagaccaatgaactcacccctctcctaccttgtgttacagaccccagtacaatgacctcaagatccacctctaggtgttcttaaaactcctgttgatctgtattagccagatcctgcaattctctccaaagtaaactaccctttctggaaagtatgtcttcacttaggctgtgctacgatttacttttagctattagtctggaggcaataaagggaggtgtgattgatggaataatggcccccaaagacacccaggtcttaatccctggaactggtgaacgttaccttctacagcaaaaggaactttactaatgtgattaggttaaagatgttgagatgcagagattgttctggcttacctgagtcactcctaaatatcatcacacgtgtccttataagagggaggcagagggaaacttgactgcagaagaggagaaggagatgcaatgacagacatggctttgaggatggaagaaggaggccaggcgcggtggctcacacctgtaatcccagcactttgggaggctgaggcaggtggatcacttgaggccaggagttcaagaccagcctggccatcatggcaaaaccccatctctactaataatacaaaaattagacaggtaaggtggcccacacctgtagtcccagctactcgggaggctgagggaggagaatcccttgaacccgggaggcagaggttgcagtgagccaagatcgcaccactgcactccagcctgggggacagagtgagactctgtctcaaaaaaaaaaaaaaaaaaagagagagagatggaggaaggggcacaaaccaaggcatcccagcaaccaccagaagctgagagaggcaagggaacagatcctctgccccaagcctccaggagaagccagctgcaccagcgcctcggcttagcccagagagacgggttttggactgtggacctactgaactggaagagagaaatttgcgttgttttaaggcactgagttcatggtgatttgttacagcagc

SEQ ID NO: 5559 - DNA, 1127 bp, Homo sapiens
tcactgcaacctccgtctccggggctcaagcaattctcctgcctcagcctcccaagtagctggaattacaggcgtgtgccaccatgcctggctaatttttgtatttttagtagagatggggtttcaccatgttggccaggctggttttgaacttctgacctcaggtaatccacccgccttggcctcccaaagtgctgggattgcaggcgtgagccaccgcattttttttttttttcttaaagcacactctgtagtcttttttttttttttcccccacagccagtcatattactcttttacatagcattggcattacaaaatcttttgagatcgtctttattccttctccttcttccttcaggtcttgaaatacctttcctacttgtctgcctgtggaacttcaaggttcagcccaaatgtaatgccctctctggcacctcagtctgttctaatgaattgcttcttcatctttgtttctccaacacttttcttacccactttagttacagtactcataacatcatactgtcatttatctgtttagtgtatgtgcactgcttgtgagttagtatggagtggtgagaaataaggttggaggtcagcagatgatgagtacttctagggcaaggatcacataatattattttatgtcatcatagccagcatagtgcctagctcataggagacactccatgagtgtttgtagaattggatttttaaaacctggtttctggaatattttattttagtttccaatccttgagttttttcctgaactatgaattctttccacctccaggagttgaaggcataactggaaattgtatccaaggatgttcttagttgctctcattctttctccactctcaggaactttgcttcttagtcccagataatatggacttcatttgactgtgatttcattattcctatttagttgaattaaactctttcccttgccatagggaatgtctgtatcaaggatctgacagatgagaaccagagatcttgggctcttgttttttgttttaacctctgtaagtttaaaaaggaatttgaaacattttctgcatgctcctgattttctaaaatggatacaagtccctctccttgagaatggtcaccgg

SEQ ID NO: 5560 - DNA, 1264 bp, Homo sapiens
gacagctgtgggcaggggccccaaagccggaagcaggtggggcaagtggccttggccagccaggcctctgaggctggacgttcatacaggcagcagctggtgggccctgcatacagatggacagagtactgcctcagcccccagcatgctcttgctaaccagagccgaggtaatggtaactacccccggggcttggtgggtgctgcgtgccctgtactaggttgtcatgtgactgtcctcgtgactgggaatcgggcagtggaaggagcactgagttgggagtcacttgactgagatgcaagccccggctcttccacagctttgccaagacttggacactcagcccagtaggtcagcagacttacatgaaatgaggatggtcccaccagccttagatttggggggattaattgagttagtgacatgtgtggcctgctggcagtcccatggtggcagcctcctcctgagtggctctggatggccctccccagcccccttagctgctgcagtagctcctcagccctgggtccttggattcaccctgccgtctgtctcccagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagactgctttgtttcctggcacttccactgattgggtggaggtgggtgggtctggttttggggaccaggtgtctgatgggttccagcaagcgtcctgcccaccacagttgtctgctctggtggggcctggagagtcctggccatggggatctgctggatgccagcacagtcactttgcgtctgtggggagaagcggcatgcctgtgcgccactgaggggagcgggtgaggtcggcaccatctaaggtggttggtgttaggtttgagggtccctgggtgatttggacgtgcgggatatttgacgtctagtctgatcggcagctccagacactaagattttcccatctggggtgaaggcacaggtgtgggccacatccaggactccctgctaagagtagaaggtggggctcgaggcaagtcctgccttgggagaagctgtccacagcttcctcagtgccacagcgccgtgccttaccttcagggtctcaaggcactttcctgtgttgcagtcccagactttgacc

SEQ ID NO: 5561 - DNA, 1235 bp, Homo sapiens
agtaatcataatttgattttttttttctggtatgcctctcaagttctaatggatcaaaaaaggaaccgtcaaagaatacttaaaaccctttaaactgtgttgagaccgtctgtcctgcgtcctggcttggtctcacagtttccctcctgttttaggtgcccaccagctgacctctcctccttctcagtcagagtctctgctggccatgtttgatccactgtcttcacatgaaggtaaaccagtgaaatgaactttttcacttatgtcacagacaggaggaggaaaccaaatccccttgttaatgcctttgttagatatgttgtgtctcagttacaaaactttttttcctgtgttgcaggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagaggtatgggacataggccgtgaaaaagaattatgttctgcctgcctagttctcttgatatctgaaattaacatggaatatataaatctaggattacagatagagagtagtcatgattaaagatgatttgtcaatctatgggcccacaaccataaccgcaggaaacctgtacaactttggttttgtagtgatactatcttgcatttttatgacacttttagtttctctaagcaattttgtatctgattttatttaaaccttacaatatctttctgagatgttagatgagttgttttttgttttttgagatggagtcacactctgttgcccaggctagagtacagtggtgcaatcttggcttactgctacctccgcctcccaggttcaagcgattcctctgcctcagcctcctgagtaggtgggactacaggcatgcgccaccacacccggctaattttttgcattttattagagacggggtttcaccatgttggccaggatggttttga

SEQ ID NO: 5562 - DNA, 1223 bp, Homo sapiens
tggaatcagtgaatttaaatgaatggggttccattcaaaagtggtatttccagaaagtaaatgcatatttcacttttggggaccctacttttgaaagactttggtccatttttttttttttttttttcaagatgaagtttcactcttgttgcccaggctggagtgcaatggcacgatctcggctcactgcaacctccgcctcctgggttcaagctattctcctgcctcagcctcccgagtagctgagattacaggcacctgccaccatgcccggctaatttttgtatttttagtagagacagggtttcaccacgttagccaggctggtcttgaactccggatgtcaggcaatccaccatcctttgccttgcaaagtgctaggattacaggcatgagccaccgcgcctggccaactttggcccattcttttaattatctttaatagtggtaaatataaaatgaatagctagagatagtagtaagttaaatgaggttgcgtgactacagcttctgcccatagacaagtctaaggcctgtgcatgtttacagggagaggtcaggtggcccacagagggtgatggagatttctagagtaggagaaacgatagtataggccaggatcagggaggtgatgagataagagaaaatagttagattgcttttcatctttcaggtctcagcttaaatgtcacctctttgaaaggacttttttaattgattttgctaaagtcggtcttccctgttatttttgggctctgtccttcatagcatttatcataacttgtttattattgttttttgtcaaggcccatgaaagtagggaccttatcccttcttttgccattgatatgcttcagagggaaggcaatgaagaacattgctactgcaaggcctccaatgggtgggactgcaaacttgaggaagggacttcatatttctttaacatggactttatgcttatgtttggtgctttttgttctcttgtcttcttagaatagccttatcaggcagttattaatgtttccattttatagatgagaaaactgaggctcagagaagtgacgtgacacagccagtaagcagctgagctgacatttgaatttggagctttgtaatttcaaaacccacaggataccacatgatccatgctctgtggaatttgttggtgtggtcagtgtaaaaggtgatcaatagatatgtaatggaattcctagacagtattg

SEQ ID NO: 5563 - DNA, 1196 bp, Homo sapiens
ttgccgttgttgttttcccaccttatgggtctccaaggacacagtagaggatgggtggctgagccagtgtatgtgtgagggtggggaaggaggtggagggaattatgtgcggaataaggagtggatactagctgttggcagaaaagcgttgaacaccaggttaacgagcctgggtttattttgtgagtagtggagacccacagaagccttctgaggttatgcttgagcagctggaggattaccctgatggtgggtgttagatggatgggattgggggagtgtggaggcaggaagacctgcgaagggtctggggaaccagcctggggggatggagggaaggccagcatagcacagtggggaaggtggagaggagaggaaaggtttgaagccagtttgcaggcaggcctagctgaatttgagttgactgcatgggtttggggtgggggaaggagaaaccagatctgatcgctggtttgggaccccattaatggaggagtggtgctgccactcctaaggggtgaaggcagcttggctgagggtcaaggccaagaggcagatgggcaattcagtggtgactgtgtggagttggaggagcctgggagatattgtgttcgggaggcccctgaacatgactgatgctcagaagtgtggtctggccagagatagagtcagggtgggcaggcaggcctgggggtcagaaccaccagagagaatggggtgcctggaagagccagtgtgcctgcccagcattgcttcacccctgcatggtgatgctgggccttcgtggctgcttcttccatcagactgggaagactgggagctcctcagggcagagatcactgtctgcacccagcccagagctccggtgccagcacacagcctggcacctggcgagtgtaggtccctggggaaggcaaggaggatgcagcatggagctaaggaaggcacagaagggcaggaggaggagacctcccggaccaggtgcagcccatcagagcctctggggagtgggggcacagcagaaggctgtggtttttggggaagcaatgggaatggatacccactggcacccacacgggcttccatctcacactgttccctcaccagccctgcaaggtggattctgtgactgctttcacagatgagggacggggccaggattggagcccagatcttcaaggaaaacacatcttttg

SEQ ID NO: 5564 - DNA, 1157 bp, Homo sapiens
tcagccttcagcacaccccatctcaccctgtcctcataaatcactgcaagggggggtattgccatgtcccatttcacagatgaggaaactgagggactgcctgggatccctcagccagtaaggcaaagctggacctcagccccaagcctggagctcaagcctgtacctttaacaggatgacactaccccactgccggaattctgcagacaaagcttgtcagggcgtgaagggcctggggagtcgggagggactagctgcaggggcatgagtcaggccccctcatcactgggctttaccaaaaatcgtgtttccacatcagaatcttgagccagggctggtctcctgggccttcaaagccatgagggaggagcagggagctccctgggactgctgaagcaggcgggggacagagctgcctgcgccctggtgagagggaggcttctgggcaggtgccagggcaccaatgggcagataccagggcactgggggccaggccagtgtcccaggctggacttggcttctaatgacacagccttagtgcctgctgcttcctcgcttccccctctgcccctcctggggctgcagtcactgcctctggtctcccagccatgtcctgggctatgtctcacccctcagtgttcctagctgcttcctggacacagcctccctgagaaggtcccacagtccccccagctcatcccaacccatgccgtatgctccatcctgcccacacgcacatggcatgccctgctcctccccacccttctctgcaaatggcaccaccatccgccctgtccgagccaggaaccaggagtcacctctgaccttccccatcccacactgctgatccactgaggtgccaagttggggagtgaagtcttctcatgtctctcgcaccctcctaggagctgtctctcccacagccaccttgacagagaccccacccttcctctggcttcctcacccactggccccagcctcggtctcctcctccagcctttctcaccctcgtctaccaaaccctccagcggctcccagcggcctcggggacccccacccagctcggcaccccagggctccccatgacctgtggtccctctcagctggtctcccccacaccgacctctctccctgcctcttggccccacgtgctgca

SEQ ID NO: 5565 - DNA, 1153 bp, Homo sapiens
tgccagggacatcctgggcagattcaggggcagatgccctatcccccaggagacctggcccttctctctcagacccaataagttggaagggacgtcagaagcggtcatctcatctgccccttattttatagttggaaaccctgaggcaagagagggaaagaggcctgtccaaggtccgggttagtgacagagctgagctgagaacagggacgttgtgccccactgtcccctgtggtttgtgaatgacctccaggtcagggggtcacaacttgttcttagtaaacttgccagctgttggggtcacatattcccattctggggcctcacaaacccccgaatccagccgggaccccatgccaggagctggtctagggacagcatgcttgtgacccacagactgttaaagccagaagggacctcagagagtcccttatgctggaggcgccctgtcagccgtggctaggggccccttgctctatgctgtgccttgctgcccacaggctcccagacaccagtgcccactctgcccagccccggactgggtgtggctcgcagatgaacaagatgcagggcctgccttgaggggtgtctcctagaaggaaagccagactctccggcccagccagagagtccagacatggcagggacccgtttctcagatgaggagcctgaggctcagagaagggaggcgatgtgttcagggccacccagcagaagcctgtggggctgggcaaccttctcccactttatgggaggagctgcagccttggctgggagctgggcggggagtagccaggaccaccccttgcccgtgccgtgacatggaaccttcatcactaagggggctggagtgggaagagggagataactgtgtggtctccagagcaaaagagaatgagaggtgggcagggggagtcttggcaaaagaccaagttccacttccctgctggggaagtcaaggctcagaaagaggaaataattgccccaggtaacacagggcagaggagggacaaaaagctgggcatggccccagccagagcctcatctgcctactccgtgaagcctcccaggtactctgctatcctgggaaacgcacagggaggccacacagagacactgctcacaagagtcagaccaaggtgccagcacagcc

SEQ ID NO: 5566 - DNA, 1197 bp, Homo sapiens
ggatgtgagcgctgagcccttggcaggtactgcgtggccaggaccacgggcggcaagggtaggggaggagaagtcggtgggggagttaagggctcctcagcaggccccgacgctcgcgccgctggccccgccaggcccattccgtggaccggcataccaaagccccgcgcgggaggttggggtcccggcgctccagctccgaatcccgcagtcttctgcccacacggcgcgcagaccgcgataccgaggcctttggggcagcttctcgcccaaggtcaccctcgcggcggcggagctccgccggccacagcgcttagagatcccgcccccgtccgtccgctggcctttcggggcgtagggtgggcgcggcttgacgacctcgggttcgagccaccaatgcctgaggcctgacgagccgagctgggagaaagactgcgcctggacttagctgatcttctgtttaagtaaaacattcagcatcccctgttgctgtctctgtcacctgttgtaacctgccctttttgtctttcagctaggtcgctgtcaacctgatatttctctccactttgtctttgtcggggtatctggatcctgttttatatctgtctccaccttgcttctgtgtctgttcaccctgtctctgccactcagcccttactctaattcagggcctgtcagtctggctttttggccatctgtctgtttctctctttctgccaactttgtttttgcctcttgtctctctttcctgagtttgggtggggcagggctgcccagacctctgagccatggaaggtgactcatgaccccgtgaagttccctgcactggtgacactctcagtgactcgaccgcagtttggcctcaactctgacaggtgtcgcccaacataagtgtcagagtgcaggagagcctgtcagggagacaggaggcccattttagggccagagcagcttgatgagtcctctccttttctcgcctgtggtttctcaggcctgcacagcttcccaaatgccttcgctctatccactcaccacaggatggtctccagggatctctggagcctgctctttgagttacagctgtttaacaggcctgtctacaggctaagaaaggatcagactgaggtctttggggctactggaacagtagcagggtttctgggataactgcatgcttagttcagagattgtgtcagc

SEQ ID NO: 5567 - DNA, 1120 bp, Homo sapiens
aaatgaaatgaaggacacatgatctgctttggcttcagactttaaaagagcttttgctgtttcctcttctgcagttaaacacagtgggaatatcacttttgatgagattgtcaacattgctcgacagatgcggcaccgatccttagccagagaactctctggtaagagcaggacaacatgtaaccgccataactgtagttgtgtttttcactgagtgataacattcttcttacttgaagggtgctcagtgagacccaagatggggtgcagttttctgggactgaaaggatggatcgtaaattggatgtgtttaatctgggcatcaaggacccatggaagctttgcattccgggttatggaactagatggaactctatattctatattaggggagcaggaacctcattccttccattgcctgctatgaaccccttcagtattccccagtatctgcagattgtgagggactgagccagcacctccaatgccaccatttctttacttaaaggaaccattaaagagatcctggggactgcccagtcagtgggctgtaatgttgatggccgccatcctcatgacatcatcgatgacatcaacagtggtgctgtggaatgcccagccgtaagtgacattttcattgttacagtaggggtgaaaggggggccacccagtgtattcacagagataagctgggaagttttggaaatggttactggtggggtgggataatccttttaaactttttactgattttttttttctttcccacagagttaagcacaaaggaaaacatttcaataaaggatcatttgacaactggtggattttctggtgtggcgtcttccttgagggagctagctcctttgtggggtggtcagtggggtcagggtggcagaacctgtggagaagtaacaagcaccttgtggtgggtaacaaaactgccctgtatgggctgggctgagctcagaaaggaagcctttctttcctttttttttttttgagacagagtttcgctcgttgcccaggctggagtgcaatggtgcaatctcggctcaccacaacctctgccttctagattcaagcaattctccagcctcagcctcctaagtagctgggatta

SEQ ID NO: 5568 - DNA, 1213 bp, Homo sapiens
ggaggaggggagggcgaggccgggcacctccccctttataacgcgccccctcctgggctctcgggccgtctcctagtcggctcttcccgtctcgccccctcgcccggccgccccgggcccgggtccggccagggagctcccaggccgcggctcgggggctgaccccccgcccgccgccccgcgcagcccggcggaggcggcgccgtcggaggaggaggagcagggcactgcggctggccccggatcgggcgccagagcggcagcagcttcggcagcagcggcggcccgggcccatgcagcgggacgcgccaccccgagccccagctccggcgccccggctccccgcgcccccgatcggggccgccgctagtagtggcggcggcggaggcgggggcagcggcggcggcggcggaggcgcctctgcagctccggctccccctggcctctcgggaactacaagtcccagggggcctggcggtgggcggcgggcggaagaggcggggtcggcgccgcgaggccggaagtggccgtggaggcggaagtggcgcggccgcggaggggcctggagtgcggcggcggcgggacccggagcaggagcggcggcagcagcgactgggggcggcggcggcgcgttggaggcggccatggcaaagcagtacgactcggtggagtgccctttttgtgatgaagtttccaaatacgagaagctcgccaagatcggccaaggcaccttcgggtaaggctgggcccctcggggccgggagccctgggcctgcacccctagggccgacgtcgggatgcccgggccccccccgagttggtagagaagtcgtctgtccccgggcttgcctgctggtctctaggccgcgccgcaccccgccccggcctgacggagccggctggtggggaggagcctgaggcccgtggtgggggcggggaggggctgcagagaggcgcccgtgaggggagcgggatctctccaagggacgcccaagtgaggagaagggactgagggaaggaagcagaggctccgaacgagacaggctgccgggtggcggggtagccgcgtgccctgggtacctagcccagccccgcccgggaatctctttgctgctgcccctcctcctgtagtgggggaggggcgggccctgcggaaatggcctgatgagttctcgggtctccctttccgcctgcagggaggtgttcaaggcca

SEQ ID NO: 5569 - DNA, 1213 bp, Homo sapiens; identical to SEQ ID NO: 5568

SEQ ID NO: 5570 - DNA, 1213 bp, Homo sapiens; identical to SEQ ID NO: 5568

SEQ ID NO: 5571 - DNA, 1207 bp, Homo sapiens
gtcaaaggaccccagaattgtgagacaagtgcctccctgccctcaggggcccttgggagacctgcttaaggaaagataaaggcgctggaagagcctgttccaggaggcggggagtactggggggcggggggtggcatcagagagactgccctgaggaagtgagcttcgcactgaaacctgatgcttggtattgaggtgaaggcgagttaggatcaggctcgggggagagggctcctagcagagggaacagcatgagcacaggtctggcatggaaggaggttgatgagagcctagagcagagagagtcaggctctctcagtctggcaagtagtgtggactttctcctgagggcactggggagccatggtgtaggtttgagcaggggagtggcaggaaagattggttttaggaaggtctttcaggctgccttggggaagggattgaaggtctgagggggtatctactggggcttcatagatgggaagatggggaggagatggccctagggggcaggaatggggtccctgtgacatggtgcccgcctgcagattggacagcccacactgctgctgtatgtggacgcaggccctgagaccatgacccagcggctcttgaaacgtggagagaccagcgggcgtgtggacgacaatgaggagaccatcaaaaagcggctggagacctattacaaggccacagaacctgtcatcgccttctatgagaaacgtggcattgtgcgcaaggtgggccccgcgggcccaggggcagctccgggaagaacgggttcctatgtggctccgcctcagctcactgtgtggcctcaggccagcccctctctctgggccttggtttccccactggttcaatgaggggctgctgtcaattaggttgggctcggggaggcaggcctggtctctggggcctgccatggtgaggcccaccccactccacctggtgactcagccctcacggcccatctccccacaggtcaacgctgagggctccgtggacagtgtcttctcccaggtctgcacccacctggacgccctaaagtagcaacgctggagccgcttccccagctcagagccccgccccaccccgtcctgattcgaggtcctcctggcctgagcgcagcgcctccaccctgccctgctgagcacagacggaggaagccgcttatcctgttttcatggacagctgagcactaaag

SEQ ID NO: 5572 - DNA, 1181 bp, Homo sapiens
accatcttctggccaatcaaggcttgctggagtgtctcccagccaatcagggccttgaggaggatgtatcctccagccaatcagggcctggggaatctgttggcgaatcagggatttgggagtctatgcggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctcctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggccggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtatttttgcgcaaactccttcagggttgggggactctgaaggaaacgggacaaaaccttaagctgttttcttagcccctcagccagctgccattagcttggctcttaaagggccaggcctccttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttg

SEQ ID NO: 5573 - DNA, 1238 bp, Homo sapiens
ggaaccccctgcatccttcctcctttcctgggttgtcctggagcgccccctagcctggcctggctctgcagcctgggaaggaacttgtgatccttgtgcctgtaaggactatgggggaagtagctgcatacggtagatgctcaataaatgtaggctctctccttccgtaccaaaaccaaacacctgctgggtctcagggaggcagaacaccacagcttaacaacatagattctgaaatcagcgatctgggtttgaggtgtgattcacccactcactagctgtgtgacttggggcaagtcacttagcctctctgcgcttgcttgcttcatgagtcaacaagggaccatattctggcttgcagggacggcagatatgaaatgcctggcacagtgcttggggtctagtatgtagcttccagaacccaccctgcccctctacctgggaggccaaatgggtgagtgggctggggcttagaccccacggctttcccacaccttcctccccattggccacaaccacgtctccctacttaggatgggtgccctgagggcagggcggggaggactccgggcatgtccccaggaatggataaacaatgcccagagtgtcttgttaaagagcccctggtgactcccagcggctgggttgcaacctctgattaaaccacccttttctcttccagcaacaactaaatgactcctctgtcatcatcagcgccctcaagacctacctggtgtcggggtaaggagcccctcggagaccaggtggccattgcttttggtggcttcctccagggaggcctcccctgagttccctcctgggagcacgtggagctgctgcttagatttccagagtacagagtggctcgcacctgtaatcccagcactttgggaggccgaggcaggcagatcacctgaggtcaggagttccagaccagcctggccaacatggcgaagctccatctctactaaaaatacaaaaattagccaggcatagtggcgagtgcctgtagtcccagctactcaggaggctgaggcaggagaatcgcttgaacccgggaggcagagggttgcggtgagccaagatcgtgccactgcactccagcctgggtgacagagcgagactccgtctcaaaaaaaaaaaaaaatgattttccagagtagcccgtggccgtcctcctccaagccccctactttgtcctccccacacctccctctcttggggaggtagccctggca

SEQ ID NO: 5574 - DNA, 1196 bp, Homo sapiens
gccgggtctcagcagggtttagccggctctgcgccctgcatggcccggccgccccgccagccccgcccgccgcccggccccgcccgccgcgctcctaccccgcccgcctcccgcaccccaaacctgctgtgccaggccgcagcaccgcctgccgcaccttccccgaagccggcaagccacagagccggcggcgcagcgcagccccagcgcgcctgacgccgctcggccccagcccgccctgctcgcgcaacggcttcgggcggcgccgccgcgcggcacgctgggagttgtagtccacgccgcgcggccccacccagccgaggagacccccgagtccgcgaggagacaggcgggcttcaccccggcccttcctccctgccgaccccggcccttgccccctgctgtccccagcgcccggatgtaggaagagcaccccagtccacaccacagccgaaaacccggagcacgctctcgggccccggccgagttcagcaaacacccagcaccacacctagaagctcgctaagagggcggtttcaggcagaggtgagcggggcggccgggttccgcagccggctctgtggcgcaatggatagcgcattggacttctagctgagcctagtgtggtcattcaaaggttgtgggttcgagtcccaccagagtcgaattttgatggctcctactccctgactttcacctgcgtgttttaaggactccaggacctatctaacaaataaggttcagaacgaaaatcataagtcacacccaactttgctgcgacacagccataaacctggtgtctaggtgactacgagaaatcctttctcgtaccatggtgtcttgtgagcagcctggcacacctgttggcacaaaggacacggatttggaggcccttagttaacttcaccatctatgatctctggtccctgcaacaaatcagttaacctatatttgtcatgccacccttatttgtcatgccacctccagagccataggcgagtggccagattctcggccctgttgggactcttggcctctgaaaaattggtttcttgttaagtaaccatgttgggcatccacagttgccacttgtccttaaacattaatagatccctgggaggctgaggcaggagaattgcttgaacctgggaggcggaagtcgcagtaagccgaggttgcgccactgcactccagcc

SEQ ID NO: 5575 - DNA, 1328 bp, Homo sapiens
ttaaaaaaataacaagaagttttttaacactttgcccaaagacctagcctcattcagtagatcagattaacccaagataactttctgaggcaagaattatgtcattctctgttttcctgggcagaagatctccttaccaggtaatataatagctatttttctggggtgctggtttccagggacctcatgtcttggatcaatggaatacgggggttggtgtcctcagatgagctagccaaggatgtcaccggagctgaggcattgctggagcgacaccaggtgggtggacctgcctgctgagtagcaaagacgtggctgctctgcagggccctagaggcctcattcccaccctttgtggtgagtcggtggttgacgtcagagtgggcatctgctgccagttacctaatcccttccctccttttggcaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcaggtgtgtgtgctcctggtttctgaccaagtgtttccttgctgaagggcctcattttctcacctgcctcttgccctctttagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggtgaggcctctggaccatggagttggagtctggatttttcctgattgacatctgtttcttggcttatatagtcactgttatatctccaaggaatacctgcgttgtctaagaaaaatatgtacataaataatctttaaaactttatagattctggtatttctgagattttaataatgggggtgccacaggaaaaaaaaatattatcaaagggatggaaaacaaatgtgtgggtaggtaagggaataatgaacaaacaacaaggaagatgtaaaactgtttgatttatacgtcactttgctgtaaatctgacagcattttcctattatcaggcttaattttgttctgttctgatattctaacacctgccccacctgagtgacctggagacttcttgagttaaactctactctagtaatgaatgaaatcaagctttcttttggcattttacactcttgcttctaaagtgtcagtgtatt

SEQ ID NO: 5576 - DNA, 1196 bp, Homo sapiens
tatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaaggatttgatgcttttctctcagcataggtatgcttactatgaccttccaagtttgacttgtataacatcactgtcaaactttgtcaccctaacttcgtattttttgatacgcactttgcaggatgacctcagggctatgtggattgagtaatgggatttgaatcaatgtattaatatctccatagctgggaaacgtgggttcaatttgccattggtttctgaaagtattcacatcatttgggataccagatagctcaatactctctgagtacattgtgcccttgatttttatctccaagtggcagtttttaaaattggccttttacctggatataaattaattgtgcctgccaccaccatccaacagacctggtgctctaatgccaagttatacacgggacagttgctggcatgtcttcattggctatataaaatgtggccaagaagataggctctcagtaagaagtctgatggtgagcagtaactgtccctgctttctggtataaagctctcaaatgtgaccatgtgaatctgggtgggataatggactcagctctgtctgctcaatgccattgtgcagagaagcaccctaatgcataagctttttaatgctgtaaaatatagtcgctgaaattaaatgccactttttcagaggtgaattaatggacagtctggtgaacttcaaaagctttttgatgtataaaacttgataaatg

SEQ ID NO: 5577 - DNA, 1138 bp, Homo sapiens
tgtctattaagccctggcacagcctaagtgctcaatcaatcatagctgtatacaggttaggaagtactgcacagcatggaacaccccagtgtagctcttcagactgtgggaagctgaagagtgaaaatctgtattatccccacccaagcactgggtccccagcacacacgtctgctcacaggcaaataagtgcttggacaaggctccatgttctttgcaggtcaaattgtgcatagatagtggcacagcagaggcgggtgaaagaaggagtcaggagacctgggcctggccctgctaagctgctaattggagtgtggtctcagtttccctactcagagcgtggacatgggaccactgatagttctagcccttgtgtgtggctcacttggcatcttgtccactccccaggcagtggctctgccaatgatcctgtgagtattcaggaatcactgttgcccctggggatccttgtcctggagtggcccacctgcttgcccccagcatggcgtccgacactcccgagtcgctgatggccctctgtactgacttctgcttgcgcaacctggatggcaccctgggctacctgctggacaaggagaccctgcggctacatccggacatcttcttgcccagcgagatctgtgaccggctcgtcaatgagtgagcagacccagggctgaggaggggcaggggtcttaccatgaatgtgtatagagagattgggaccgtgtgtgcactatgtggggagtagctatggagatgaatgtgtgagggtgtgtgtgtgtgcacatggatgttcatggctgcaagagaatagtggtgtatccataaccgtaaaggtgtatatgtgtgtgtgttggtgtgtgtgtggaggggtgtgcacgtgaaggcatgggtgtgtgtacacatgtaagcttatgcagcacaggttatttctgactgtgaaactgcatgtgtgcatttagagatgtgattgtgtcaaaatctgcatataaatgaaggaattaagtgttgccccacacgtgtatgtacattcacatgcacatacctgtgcttgtgaattcagtgagcatggccacatatgcatgtacatgccggtgccagaataacggatccatgatcagggagtgaatcatcc

SEQ ID NO: 5578 - DNA, 1179 bp, Homo sapiens
cccgccactacgccaggctaatttttgtatttttagtagagaccgagtttcaccatgttggccaggctggtcttgaacttctgacttcaggtgatccacccacctcggcctcccaaagtgctgggattacagacgtgaaccacgtggaatttttaaaccttgctctttgttttatggaagtgagttcatgttgtgccccctctgcatgttgctttctttcctcatattttgcgggaatccctccagccctttgctgcagctttacagcagctggttcccagtgaactgggagttttaaatgtgtccctctggtcaatctgttcattaaataggtggactttagaaaggagttcccgattgctcttactggaatgcaagggatggagcagagaaccctgaggctgcactggggatctgtctaatctcactgtgctcagtcttcctgtgtattaaatggggagcctgcctgcctcccccagggtggtttcccagccaagtggccacatgctttctgcagaagggctgataagtgggctgccccgtggagtaggcaggctttggctcccagctagatttgaggtggaattttggacaatggaagaattttcattgtcttcttcccctgacccctggtcctaggaaagccaggccaccctgtgctaacccccctcctatggctcccttttaggttgaaccatgattccggtgacagagctccgctactttgcggacacgcagccagcataccggatcctgaagccgtggtgggatgtgttcacagactacatctctatcgtcatgctgatgattgccgtcttcggggggacgctgcaggtcacccaagacaagatgatctgcctgccttgtaagtgggtcaccaaggactcctgcaatgattcgttccggggctgggcagcccctggcccggagcccacctaccccaactccaccattctgccgacccctgacacgggccccacaggcatcaagtatgacctggaccggcaccagtacaactacgtggacgctgtgtgctatgagaaccgactgcactggtttgccaagtacttcccctacctggtgcttctgcacacgctcatcttcctggcctgcagcaacttctggttcaaattcccgcgcaccagctcgaagctggagcactttgtgtctatcctgctg

SEQ ID NO: 5579 - DNA, 1185 bp, Homo sapiens
tttgttttttgggtttttttggtgtcttgttttctttctcctccatgtgtcttggcaggcactcatttctgtggctgtcggccagagggaatgttctggagctgccaaggagggaggagactcgggttggctaatccccggatgaacggtgctccattcgcacctcccctcctcgtgcctgccctgcctctccacgcacagtgttaaggagccaagaggagccacttcgcccagactttgtttccccaccgcctgcggcatgggtgtgtccagtgccaccgctggcctccgctgcttccatcagccctgtcaccacctggtccttcatgaagagcagacacttagaggctggtcgggaatggggaggtcgcccctgggagggcaggcgttggttccaagccggttcccgtccctggcgcctggagtgcacacagcccagtcggcacctggtggctggaagccaccctgctttagatcactcgggtccccaccttagaagggtccccgccttagatcaatcacgtggacactaaggcacgttttagagtctcttgtcttaatgattatgtccatccgtctgtccgtccatttgtgttttctgcgtcgtgtcattggatataatcctcagaaataatgcacactagcctctgacaaccatgaagcaaaaatccgttacatgtgggtctgaacttgtagactcggtcacagtatcaaataaaatctataacagaaagtggcctttggaggtctttgtgtcatgggaggacgcttccctcacttctctgaagcctgccgggccgtgtggaacgttgcttgggcacctacaggagagttaactctgctcatctcctgccccatgagactctgtgcctttggaggcagttactggagcttgtaagctggacgcagcacctgctaggtaacaggctgtgacctgggctggggatcccatagccagcacaatctctgtcatcctactcacctgtggttgggcactcatgagggggtttttttgttgttgttgtttttttgacagggtctcattctgtcacctagagtgcactgctggaatatagtggcgtgatcacggctcactgcagccttgacctctccaggctcaggtgatctcacctcggcctcccaagtagctaggaccacaggggcatgctggctaatttttttttt

SEQ ID NO: 5580 - DNA, 1222 bp, Homo sapiens
acagggtttcaccatgttgcccagggtggtctcgaactcctgagctcaggtgatccggccccctcagcctcccaaagtgctgggattatagacgtgagccaccacgtctggccagttttctttattgtaatgtctgttttatatttaattgatttctgttgtgtatttttttttttttttaaattttcactcttgttgcccaggctggagtgcaatggtgtgatcttggctcaccgcaacctctgcctcctgggttcaaatgattctcctgcctcagcctcccaaatagctgggattacaggcgcccaccaccacgcccagctttttttgtatttttagtagagatggggtctcaccatgttggccaggctggtctcgaactcctgacctcatgatctgcctgcctcggcctcctaaagtgctgagattacaggcgtgaaccaccgcgcccggactctctctctttttttaaaatagatttctgcctccgtgtgtgtgtgtgtgtgtgtgtgtgtgtgtgtgtgtgtgtgcgtgtgcccagccttgttctttagtttttatatatgtatatgttttttctccctttttaaatggatttctgtctctgtctgtctctgtgtctgtgtgtgtgtgtgtgtgtgtgtgtgtttgtgtgtgtgtatgtgttagaagtctcactgtcacgcagagtgagactctctggatttaatgtccaaatattggatgttttttgtaaatatctgggttttttttttgagacaggttctttctctgttgcccaggctggagtttagtggcacaatcacggctcactgcagccttgacctcctgggctcaggtaatcctcctacctcagcctcccaactagctaggactacaagatgctgcaggttttgccatgttgcccaggctagtcttggactcccgggctgaagggatctgaccaccttggcctcccaaagtgctgggattacaggtgtgaagtactatagcagacgaaacatcttattgttctcaatgtttttatttgattctgttatcagagaacacattctttgtcattttagtcttctaaaatttactgtctcatgttttatggcctaccttatgatctttcttggtgattgtacctgtacacctggaaagaatgtctagttgttttttcagttgaatagtatgagtttattagcaagggattggtagtaacctaaatgctcatcca

SEQ ID NO: 5581 - DNA, 1147 bp, Homo sapiens
cctggaggaaatctcaggttcgtcagtcatctataccaaggtgataattgagtctgtgagagtgattcattcatggagatggtacaaggacaaaagaggcccaaggagaaaaccctggggattgactgcatttaaggagcctgtgaaagaagaggaaaggggaaaaacattgagatgagatggttaggaagatagaaaatgaagatagagcatagaaagtttgagaaggatcaggataaaatttctaaggaatgtatcgtaacatgcattttataatcttaagactacataaaattagtagacaaattttgtgggtaaaggaagagtaattgtaattgaggggtttattagtgaggtgactgggggtttgagaagagtgaaatatcagaatgagagagtgaggccactctttatggcttgcttattgagcgtgatgaagaatctggtcgagggatattaacactttctgttcggagatgtagatgtgttttcttctctcactaggatatggactgtttaatgttgacctttggggacattccacatcatgccccagtgcttttggcctgggctctcctccgtcacactctgaacccagaagagacaagcagtgtggtccggaagataggtggcacagccatccagctgaatgtgtttcagtacttgacccgattgctccagtcccttgccagtgggggaaatgatgtgagtttaaggctctgggtggtgagcatgggagtgagccggcagaagcattataataatgtaatagttataatggtggtgtggataatgggatcatgttgtaactaaccttttgagagcatttagacatcatcaggcattatttataatgtttatgaacattatctttttgaatccttgtaacacttcttcgtgttaaagattatcattctgttttatacattaggaaattgagactcagagagatgtaatttgcccaaagcaacaaaaatgccagtaaatggtagataacggtttgaactctttgccagtaaagtatgtcttaagaagatagctttggccatattgactggagaagtcactttcaggggacttaatcaactgtaacaagatgaattagaaattctcttgagtcttatgttggggtttgagtggcatggtt

SEQ ID NO: 5582 - DNA, 1085 bp, Homo sapiens
acccgcaaagctcgggtgctctatgactacgaggcagccgacagcagtgagctggccctgctggctgatgaggtgggcccggtgccgcaaggtggggcaggaatgggctgggtgaggagcagcctgggcactgggatcaggcacatggggcctggaggggccctgttggcaaagtggggaccagcaggttaaagagggcatatccagctctgaggaaaggatccttgctctgctgggtctctggagcaagtgagatgagcgccagccactgaaggtgtagcacatgccacgggccatggggaggtggcagctctgtccccacttagtcctggggccagttccacccttggccaggccatgaccgtcctctactgccatctctgcagctcatcactgtctacagcctgcctggcatggaccctgactggctcattggcgagagaggcaacaagaagggcaaggtccctgtcacctacttggaactgctcagctaggcaggtgcccccatcccccccgcattctggcctaggcaggagaggatgggcgcagccctgccacttaacttgtttgttggtgacacagttgttcagagtggggagaattcaccccattctgtccctgcccctagtcacctagctgtgagggtgcctgaggctgaatggctccacccctcccccagccctgcttctgacctgtggctctggagcccctgcccctgcctgcatccccgagcaccccaccctccaggctccactaaggagggaggggctgtctgcagcagctgcactcagcacctaggccagggtggggccgccgcagatgggctcaggaagccccaggtgcactcagcgagagccctgcctttcagttgccaaaagctgcatcaggggaatgcggcaaggcacacagggctctggcagcccctggggactgggcgctgcccctgggaggggagagcctggccagggctggtgttgggcccggagcagcatcttccggtgctatcctcccctcccacccctcacagctcaagccaagtccagcggccgcagtcttcacctctccacactcactttttatctggt

SEQ ID NO: 5583 - DNA, 1072 bp, Homo sapiens
gagtagtgtggagaactcagggcggcagctgtcccatccccagggcccctccacctcctgctgtctctgaatgccaggccctggggaggccctgaggatagaggaggaggcctggccgtgcctttctggagttcacagacccctaaagacaggaggcagggatggcgtcgtaggcctggagagcgcctggggggcgggagggcctgaggctgtgcttaaggcccagaggtcctggagcagggcatgtcttgtcctgaggcttaggcagggcccccaggggagttggggcaggaggtggggaggacaggatcgtggaggcttcgcatgtcatggtgtctgttggtttttaggctttcttgggaagtctggtgtttcctatgtagtttggggactaggccacacctctccctcatgcttgtcaccactgctacaccttgtctgcccactttctctccttcccgcccctggaggtgagaccctcacctctctcgtgagcatgctgcctcatgtcttccgtgccgtcgttctgtggctgggtgactgtccctcaggccgccaaccctagttggctctcacagcaacttccagtgctcctggacggggacttcctaagcagcatgggggccacacgggccggccacgcacactggcctgggtccgcattccctatttcaggctgttgtctcgggtcagatctccggaagcggcaggagcgctgggtctcctggtcgtggccgggcagcgtctttcttcttcagggtctggatgccacttcccgcctcctccctgtgcccagtggaaggagaaacatcctagagggtggagactgccctgtttttcttttgccattgagtcccagtgtgactcaagcacgaggccacctttctctgccagaggacagaaagcttcagtgactggcccagggtcacacagttctgccgcccagcccagcagcctgagccagcagtcaggatggggtggggacactccgtctctcttgagaccccactcagagaatggggctgacactgtaggagaaatataagcaggactcctgctggctgctcccctc

SEQ ID NO: 5584 - DNA, 1126 bp, Homo sapiens
cttgccctgagcacaggcgccctgggaggtgccaggaatgggatgagggcctgggcctgggcctgctcccagagagagggcagagccagacccacatgggtccagaggaagcagtgggagggaggagcctggggatggaaaggaccggctggggctctggtggtggacaaggggacttcaggtaacctggggggcatcatggtgggcagtggctgggccaggcctgacaccagccctgctcccccagcaccagattgtgcagtacctgagggacatgttcgacctggacaatgtgcgctacacgtcactgcccgcgctggcagacgacatcctgcagctgtcccggcgccgcagcgagatattgctggggtacctgggggtgcccgcggccagcagcgcaggcgtgaatggggcgctgccccgagagaatgggcccctgggggagctgcagtagaggcggcacgggctggggggtggcagagagaaggctcctcctcccttccctgggttggtatctgacagctgtggtggctgagggccgttgcccctgactttgccccacccccatcatctgggagtccccaaggcccagaggggacatttccatggagaagaacggttcctgggggaagcagaggccaggaccagtggggcctgtgggagagaaaggctgtgagagagggggttgttgtggagaattgggacaggcagagccaggatgccccaggtgggggaccccaaaacctcccatcgctccagggctgctgacaagggtgctgggagggtggaggtgaaggatggggcctagagccctgtggtgaaggtcacagtgtcctgagctagaagccacctgtggctatatggtctcagcatccagctggcctgtcctgatgccctccccacctcaaccgccttctcagagagtttgcaactccagagaaggagagtggggccaccttagtgggcagcaggcctgggccatccagagatggggcagaggtgggcctcccactcctgtgctctcttctgagcaggaactgggcccttgacagtgtcctttgacattccctcgccctaccaaagatcgtcttttctcctcccacctctgtcaccaccaaagacgggc

SEQ ID NO: 5585 - DNA, 1199 bp, Homo sapiens
aggcagggatgccacaatcataaccatggcaaagaccaggatcagaaaggcccaccatctctgaccccaaatccctgggcagatggttccagaactcagaattttcccagttgtagaaagatggggccaggtgcagtggctcacgcctgtaatcccagcattttgggagtacaaggtgggcggatcacctgaggtcaggagttcgagaccagcctggccaacatggtgaaaccctgtctctactaaaaaaaaaaaaaaaaattagccgggcgtggcgatgcatgcctgtaatcccagctactcgggaggctgagccaggagaattgcttgaacccgggaggcggaggttgcagtgagccaagatcgcgccactacactccagtccgggcgacagagcaagagtccattcccccaccaccaaaaaaaaaaaaaaaagaaagaaagatgatgtgatacatatcacatatttcctaacacccccaaccaaacacatttatgcatatgcataaagcagacgaggaaagattctaaataggctctgaatctcagttttctcatctctacaatggggcagtgatggcatgcacctcccagggctgttctgagaatctgatgcctcccattgcactggtgagcctggcacaggcacaggtcccaccccaggccctttgaactggctgttcctttggcctggaacattcctccccagatacctcctgagagggctccctcacttccttcaaggcactgctcaaatgctacctcttcacagaggctttccctgaccaccccgtctctttcctcttcctgcatagcctctgtcacctgacattttatgtcataaattactcatttattaatttcctgctctcccacagtggcacccgagctctgtgagggcaagactttgttcggttgtgggctatgcccccaacccctcggacagtgcctgcacaggtggacatttttgttggatgaaggattttctgttaaatgtgtctggcacacacagaaaaacaaagcccagcaggtacgatggtgattattattgttactggtggcgctctattattgttattagtgtctgttgaaaaagaccctgagctataccagcccttggttctccagcctgtgaaatgggcatcctgggcactgaggcactagccttgggaagctgatagggggtccctgcaggagag

SEQ ID NO: 5586 - DNA, 1175 bp, Homo sapiens
gtggcccagggcaggggcagtggctcactcctgtcatcccagccccttgggatgccaaggtgagaggattgcttgagcccaggagtttgagaccagcctgggcaacagaccgaggccccgtctctacaaaaaatacaaaaaaaaaaaaatgagttgggcatggtggcgcatgcctgtagtcccagctacttgggaggctgaggtgggaagatggaggatggcttgagcccaggagttcgaggctacagtgagccatgatcccaccactgcattccaacctgaacagaatgcagaatgcaacctgaactttcaaagataaaggaatgtgtggcccagcagtgtgtcctcccatgctcatcccctcgactccgtacaagctggcagccagcacagacctccccaccagtgctcagcttgtgcggagtcctggaatcctgacttgagtctaagtcctagggctcgtgaggaagggccgcacgtgcggtgacagggtccctctgataggttatatgcctctgcttttcaggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggtgaggaactacttctgttgtgggctccaggacttcaccccggagccggactcttacgacgtgatctggatccagtgggtgataggtgagggttccaccgcccttccctgctcacctgtatgtctcctgccactcgcgttccccataaggtgtcaggaccagggctttgcactcctgcagcaagtgggccagtgaggattccccaccccgcccaggcccacccccaccccgtacttcccaggactgagggacaggctcggcctaaaaggtagatttcttccttctaggttttgtttcagttgaatacctgctaccatccatttgggtgcagttttttgttgaaaaaattttaatggccaataacttactgcattcaaagtgaggagttttataagggttttatttttaataagatgaatagtttaagcttcgtgtctagccctgcaccctcttagcctaacagcacacctcgagcgctgtg

SEQ ID NO: 5587 - DNA, 1679 bp, Homo sapiens
accagcttggagaacctggctgttaccaccaggcctacaaagcagagccgccagagctgctgtgtagcgcggcctcccagccattctgagagggtgcgccccgttttatggtcccttcttacagaagaggaaactaaagcccccaacagcttcagtagcgtgcccactagaacaccccgagggccctctagtatctggtgaggacagctctgtcctaacccttgatggtgacaggaggctgggcctgtgcttctggacactttaggtgggagtttggggctgggctctgggtccgggggccccataagaatgcggacagataggacccacatgagctgtgtctgcaccttcagacccagtcacctactacacggccttgcacatcgccgtcctgcggaaccagccggacatggtggagctgctggtgcatcacggggccgacgttaatcggagggaccgggtaagtgccaggtccagcttgctttgaagcagggttgggcaggggcctgagcagcttcccaagccaacctggctgtgcttccttggctcagatccacgagagtagccccttggacctggccagcgaggagcctgagcgcctgccctgcctgcagcgcctcctggaccttggagctgatgtcaatgccgctgacaagcatggtgggtgcctcctgcaggaaagcaggacagctgggcccccaggcaccttgtgggggacacccagggtgccccaggacaacagctaggtgggcagactggatgctggccctggctggtggcacagcatggctgggcacacagggattctgctgacttgctgagctcagaggcttcagagaggcagtgcagtcattgtccctgtgctggccctcaagggccttctataggaagaaatagggcatgtgtgcacttagtttccaagaaacaatggcttcccattgggagaggcccagccaacatctcaggtagcatcttggggtccagaaaaatcctacctttcctggcctttccgctcccacttctctgggtggaaagggaatggccagaagcctgtcaccctcagccctcacctgagctgagagttgtctctgaaagttcatcttctgatcctctgagtgtctggatttctgccacctcctctgggttgccctgacctgggcttcctggcctcctgctcctccttgctctccctccctccctaggaaaaactgctctgctccatgctctggccagcagcgacggggtgcagatccacaatactgagaacattcgtctcttactggaaggaggtgaggctggcgcgctcctaggcctcgtcctctcacccgccccttcgatgtgtgctgttgctttgccagggttgaaggccttctcccagcatctcttgttctatggctcttctaggggcagacgtcaaggccaccaccaaagatggggacacagtgttcacctgcatcatcttcctgcttggtgagaccgtgggaggggacaaagaggaggcccagatgatcaaccgcttctgcttccaagtcacacggctgctgctggcacacggggccgaccccagcgagtgcccagcccacgagtccctcacccacatctgcctgaagagctttaaactgcacttccctctcctgcgcttcctcctggagtccggagccgcctacaactgctccctg

SEQ ID NO: 5588 - DNA, 1323 bp, Homo sapiens
tttttttttgagacgggagtctcgctctattgttcagactggagtgcagtggcatgatctcggctcactacaacctccacctcctgggttccagcgattctcctgcctcagcctcccaaatagctgtgattacaggcgtgcaccaccacgcccggctaatgtttgtatttttagtagagacagggtttcaccgtgttggtcaggctggtctcaaactcctgacctcaggtgatccgcccgcctcagcctcccaaagtgctgagattacaggtgtgagctaccgcaccccgccgaggttagcactttcatcaccaaagaccccgtgcctctcgtggtcctttgagggatcccgccgccaccacccttgtattttatcacgtgctcttcagggcatgtggaattcgttgagtttgcttttagagccaagtttctttccctgtgtgggtttttgaggaaaacctgaggtcccctaatctgtggccaccaccccccccccccgccacgccttagagcagagcagcccctcctctcatttggtgcagaaacagtcaagaggaaccattggcctagagctcctgtgaccgagagcgccacggaagcctggggatgacgtcgggcagctttattctttgcttggctttggtaactaggtggtcccctcaagcatcctcagttcctcttgctgtttatgaatctaagacaaggaagtcctatagaagccaaagggacagggacggaaaggacaggtcccaagggatggggctgtctttacttgtggaaaccaggaaattgctcctctcagccaaccaaggttgaccacacaccacccttccggagcagctcagtcagccctcggggacgagaaaccacaagcgcagagacgctgaggcccaggcaggtgaagaggaagtggctttgggtttttaaagtaggtgagcgtgagcctctctgactgcttcttccccgggggggactgcaaaccgctcagggttgcggcagagccatggacttccggtccctgcaacgggtgacctaagcgtggtgcacccatcagtcacgcaggaggactgacttgacagacgaaagacaagcccggatgacacagggtgagaagagtcagggccgcacctctgtccctgcaaaccaacaggtgcatggtgagtgtggcagtccccacagctccacaatgggctcccccgccaacggggacgacagggatcttcaggaacttctgacctcaccaagtcaagtggaccactctccactccacgaggatgtgaaacggttctttaaaatgggattttagagcctcgggaatgcatg

SEQ ID NO: 5589 - DNA, 1317 bp, Homo sapiens
acagatgagataagactgtttcagaaacaaagatggccacagccttcctaacaagcaggtcatctggccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccagctgacaagccaccctcctgcagcctgagtttcacagtccactgggttcgttgtcatgcggtgtttgaatggttaagcccttgcagtatttcagatcgggcaaaaaatatcggatgcacatagcagaaccattggtggtatttatagctttgctttgtactcctcactgtttctgcctacgcaaaatatccatgtttcctctgagaaatctgttgtggactgaaagcgctgctggctgtgaaatttaataaagtgtgtatgctttgctagaaaattatttcttggacaataggaacagtcattgatctgtaaatcctggctcttaacagtgagtggccaaggacttgatcagcccatttcttggtccctcagtgctttaaaatttaagtagcactgcattttgtaatgttgaatatgactctagtgacttgtaggaggcacttgtgaggagatgcttgcttcagtgtaaaagatgctcatggcctgagtcagttgagttttctttcaagaaaccacttcagagtgaaatatccagggtttccccgccctggacatgtccagcctgcccaggcagcacacagccctgtaagtccacctcgtgtgggtgagatttcctcctgcgtgatgacctcatcgccatctctgctgtctcattccacagcctccctccctcttctctcctcctctgccctcgcccttcccccttccccatcccctccccctcctcctctgccctcgcccttacccctcccccttccccttccgctcctcctccctcctccacctctttctcctcctccttccctcctcctccctcctcttcccttctctgccatctttctccccgtgcctattgatcccacataggctcattctgggtacaccggctaaaggctttggtgcattgcagcgttttctcccagcagctgtgtgaaagatgcattttctaagctaaggagaattttctcaagagtggcatactcatgccaaatattattgctctgg

SEQ ID NO: 5590 - DNA, 2516 bp, Homo sapiens
agagaactctgccttgccctcgtccctcgtccttcggcagccggagaggctgtgggtgggccgagggtgtctaggggttctgcctggtcaacgttatttgtcgtcccatcttttggcagcaaaaccacctgcgtggctaggatgattaattatgaggatgatgattttttttgtgataacagtattgtgctttttgtggggaaagtgaggtttttttttatatacatatataattgatatctttaatttattggttgttaactgttgctgctgcctggtgtgtcctcagctcccagggctgcgggcccaccgtttacatgtgcacgccctgacccacctgcccacgccgacttgggaggatggtggcctgcagcggccaagaagccaaaaaaaattttttttttttcagatactgtgcttgatttttggagaggggagaggtggaaattcctaaatggctaatgcactgttccctccagcccgaatgcctcctgccaaaccccttttccctgctgcctctgtccccgcatccttgttctcccctgggtccgtaacattttttccgaggatgaacaggggacatctttaggtttctcaactcttgctttggtgtttgccgcagcatggaaaacagggcgcctaaggctgggagctggaagaaggggcattgggtacccaggcagagtcaggagaggtggtctttgaagtaagttagcagaaatcaaggggacccccgcctccttgggctggggaggggatttcaagatagttcatgactctctcccgctctgccttccctccttcctatctgctttttccagtaaactgcatggtgtccttccctggccttctcttggctcaaaggctgggagggagggaaggagagaagagttccaggcaatcccatcaatatagtccctacacctggggctgcggcccacatgtcttcacggaggcttccagcggtgcctgccactgaggcaggtgcggccccaggaccatcaccaggaatgcgaggccaccctggaccagaggtaggagcccaaggtccggcccttgctctttgattgtgggcagcctcctgccctctctgggtctcagttgccccatctgcagagcgaggaggcccgggctggttggtcttgaaggcccttttccatgccgacatcatgtcactctaggcctggggttcagtttcctgtggctggtgatgctgtggttaagtttgcttgaccccagcagcccgagggactgtctgagtcacagcacagcccctattgcgtggctgctggtgtgtggggtcagttccagcagatgaatgtgtcatgtggcacaccttgtcccttcccgcagcatttcctggttccccccagacccttgagcgctctttgggacccagaaggagtccttgcacagggaaggcttgaggtgagaagccgcttcccagactgtcagggccaggcctgggtctagaattcttgctgctgctttgcagagtcaacagcccatcagcccatgttttagaggggacactttggtcctcggttcccaccctcagcaagcaggcctccagcccgaggaaggcctctgccgtagtgacgttgccgtgtggggctgcgtggctgttccccttggctggagcattcagccaaccccagcgtcccccctgaggcgttcattggcagccccctaggactgcacgctggccccacggtaaccccccctcccccaccaacatcctgcagggatggggtcagtggttccaccttcacaggccactttgaagggtggattctttgaggcccctgccagtcggctccctgctcagctgctggcccgggcgacctgggactcagcaccaacggctgaagtttctcagctgggctctgacctggggtctggggcagggaacgaacatggtggctttgggctgagaggatgagggaggtctttcccaggtcaaattactttcctttggcctctgcctgaggctcgatttgcctctctggtccaatgggactgacactgttgtacaacctgacctgtggctgagggtgtctgggcttaagcatgtggaccccttcggtgtgtccggccttcctccatcgtcctgccctttggccttttggtttgaagccacaggtgtggcttctggccttagcagatggtatgcttgcggaccgcagcccagcatgccggtgggcccacagcccgagccagcccagagctgccggaagggccgcccttcccggccctggcggggtgctggacactggccattttcactagagtttgcctggcagggaccgatctctgccccctcctctccccaggcctctggctgcagtgatgccgcagaatcctgagccaggtgcctcctgagcagcccgtgcgcctctccacagcggcgtttgccacccaatgcggctcgcttcagatgctctgatgcagagggcacgcccatagtccctctgcagagcctcgcactggggccagggcaggcaccagccccaggc

SEQ ID NO: 5591 - DNA, 1182 bp, Homo sapiens
aaacaaattaggatttactagtctcttagctttatctgggtgaacgtttttattttctgagtggaacaaaaacctcttcccttaatggagtggctgcagacagccacgttgatgtacatggagtaggcagaggactgctgcagtatgctgactttcacaaccctgggtcctgcggactcttccttggcaggacgtggacttgagctgtcctgccaggaccagacatggatttgcacccagctccacccatctccttacctacccagaggcacacatctcacaggcaagatgagtgtttggggttcaggtatgagctagggtcatggaacaacgcagtgctcctgggccagcaggaggctccagctcacttcctcattggcttcagcttctctaatgtctggcacatgagttctggcttagagtgcaaggaagactgcaaagggaaatgacagagaagagtattgaaggtcaccttctgctgggatgtatgaatagcctctgagtcccaaagcgttctctgcaaaaatgtgtactatgtgtatgcatgtaggcgacagcaattataaacaggaaggacaccaatttgaatatacttaggatgtatattctgtagtctccttttcattcatcccgccaatcttgcagtgacctagcttcgtgatatatttctttagctaggtcagggggttttggtccaggtttccccctccctggtgaaacggcagaagacccactttcatgatttgccatgtggtgcctcagtgattctcggtaacaacggcttcatctggatttacccaacacctgagcacaaagaagaggaagcagggggcttcattgcaaacctggaggtgagcaaacactgtggccattttcagtgggatggagggggctcagtctttgctgtgtttttgtggccagtgaagttggttgtttttagctatgttactggtgtaggctgagtcactttgactttccatcacggtatgttcatgaagcccatattatcttctcttctaaggagatgaattcagtgaatggtttggtgtttgttggtggaggtggcaaagttgcagggtaatagccgaagagccagtgaagaagccattctttttctgtttttttgtttgtttgttttgttttgttttgttttgagacggagtcttgctctgtcgcccaggc

SEQ ID NO: 5592 - DNA, 1190 bp, Homo sapiens
aacctcgtctttaccaaaaatacaaaaattagccgggtgtggtggcacaagcctgtatgtagtcagctactcaggaggctgaggcatgagaatcgcttgaattcgggaggcggagttgcagtgagctgagatcgcaccattgcacttcagcctaggtgacacagtgagactgtctcgaaagaaaggaaaagaaaaggcggccggacgtggtggctcatgcctgtaatcccagcactttgggaggctgaggtgggtggatcacaaggtcagatcgagaccatcctggctaacatggtgaaaccccgtctccactaaaaatacagaaaaaacaaaccatagcctggcatggtggctggcacctgtagctctactacttgggaggctgaggcaggaaaatgacgtgaacccgggaggtggagcttgcagtgagctgagatcgtgccactgcattccagcctgggtgacagagtgagactgtctcaaaaaaaaaaaaaaaagggacactatatgcaagcgctgtcttcacatatgtggcaaacttgtttgtttgtttttgagacagagtgtcgctgtgtcgctaggctggagtgcagtggctcgatctcggctcactgcaacctccacctcctgggttcaagcaattctgcctcagcctcccaagtagctgggactataggcatgcgccaacacgcccagctaatttttgtgtttttagtggagatcgtttcaccatgttgagcaggctggtctcgatctcttgaccttgtgatccacccgcctcggcctcccaaagtgtttggattacaggtatgaaccactgcacccagccatattttttgatatttatagacgtcttttttttttttgtttttttgagacggagtcttgctctgtcaccaggttggagtgcagtggcgcgatctcggctcactgcaacctccgcctcctgggtttaagcgattctcctgcctaagcctcccgagtagctgggattacaggcacgtgccaccacgcccaactaatttttgtatttttagtagaggtggcattctaccatgttggccaggatggttttgatttcctgaccttgtgatccccccgcctcagcctgccaaagtgctgggattacaggcgtgagccactgagcccagctatagatgtcttaacatcattgttttctgttcttttgt

SEQ ID NO: 5593 - DNA, 1214 bp, Homo sapiens
aaaaactgaacttcatatcttgtccccagatctgatatagtcacttcttcctttgttcagttaaacccagcttcatgtttctgcttgcccagggccaataactttgggatcttccttgactcttctttttctgtcaaaccccgtaccagtctttcaggtaaccgtaacttcagagtctatccaggtcacctctgcttgtccaagcccctgtcatctctcacttggatgatttcattagcctcttggccagggtccctgcttctgctggtatttccttagtttcttctccctacagcagccagagctaatcattttaaatgtcatatttctgtctcgcctcagctgcaaaccttccagtaccttcccagctccttctaaataaacaccagaggccgggtgcagtggcttatgcctgtaatcccagcactttgggaggccaaggtgggcagatcacctgaggtcaggagttcgagaccagcctggccaacatggtgaaaccccctctctactaaaaatacaaaaattagctgggcgtgatggcgcctgtaatcccagctacttgggaggctgaggcaagagaatcgcctgaacccaggaggtggaggttgcagtgagccaagactgcgccactgcactccagcctgggcaacaagagtgagactctgtctcaaaaaatataaataaataaacaaacaagcaccagagccctggcagtcacctgtgaggcttcaccccgtctccccacccactataacctctgacttacctccttttacactccttcttgctgactctgttccttccacattggcctctttgctcttgcttgaatgatccccagtcatcctccctgcccagggcctttgcacttgctgttctctgccaggaaggtgcttcctccgtagttcactcttcacctcctttgggtctttgctcagttgtcatcttcagtgatggctcttctgatcaccttatttaatttttattttttaattaaaaattttttttgtggagatgtcttgctatgttgcccaggcttatctcaaactcctggactcaaacgatcctcctgcctcagcttcccaaagtgctgggattacaggtgtgagctaccacacccggccccgatcaccttatttaaaattgcagctcccagcccccaaccccagcatacccattcctctttttttttttttgagacagaatcttgctct

SEQ ID NO: 5594 - DNA, 1116 bp, Homo sapiens
cacgccccatcactggcaccaactcccctgcctccctcttgtgtatttgccattaatctctaatgattgatggggcccagctggataacccaagaggctcttcctacctcaggtcagctgattaacaaccttaatgtcccctgccacagaacacaccatatttatggattccagggattagaatgtggatgccttgggaaggctgttattctgccatcagaccaccgtatctgatgaaacccccgtttttctggtcatagctttgtcatggagggcttcttcagtgccacagggccatagccactgtcatggcccagagaatctgtgtttcccatcagcccctcacccgccaggccactgcaccctaagcccagggccatggcattcttgcaaaaggaaggaggttcttgatcattctgacctctccaccccacagtgaggggaactgtggtctcctggcgactgtctcagccccagaacccagagcctagagcccatctttagccccactgtggctgattcaggacctgccagcacccccgaccagctctgccctttccctccctccctctgccagagaggccggggagatgatgtcacaggtggctgaggagccgtgtgccctgcagccaggaagtcaaaggcgtcgggcccctcgtggggcaggcgctccaagctcagaggcccatgagcaaaaaactcactctgttccatggccactctgctggcatatgtaagaaaaggggcttattcctgaaagaagcgcttgctgggtgttgggcacactgcaggggtgagatggatggacggcctgtcctcatggtgctctcaggccggcccgctcccggggcaccctgagcagctggaggtgagggcatggcaggggagccaggcttctgcctgttgcttacggtggggacacagaaacaaacgtctgggctggctggtgacagcatcagagggaatgaacacatcgaccctctggccagcatgtccaccttctgtattctgcctacgagcactcagtggggcaaagagcaggagctgagggaagataagtatttaggccgagcgcaatggctcacacctgtaatcccagcactttgggaggctgag

SEQ ID NO: 5595 - DNA, 1324 bp, Homo sapiens
ctccaagccaagttcaggctcactgacctggctctgacgaggaccccaggccactctgagaagaccttggagtagggacaaggctgcagggcctctttcgggtttccttggacagtgccatggctccagtgctctggtgtcacccaggacacagccactcggggccccgctgccccagctgatccccactcattccacacctcttctcatcctcagtgatgtgaaggtgggaaggaaaggagcttggcattgggagcccttcaagaaggtaccagaaggaaccctccagtcctgctctctggccacacctgtgcaggcagctgagaggcagcgtgcagccctactgtcccttactggggcagcagagggcttcggaggcagaagtgaggcctggggttttgggggaaaggtcagctcagtgctgttccaccttttagggaggttactgaggggaccaggatgggagaatgaggagtaaaatgctcacggcaaagtcagcagcactggtaagccaagactgagaaatacaaggttgcttgtctgaccccaatctgcttgaaacctgactctgcttctctcatttgtcttcctaccctactcacataattcactcattgactcactcattcaccagatatttattgacctgctattataagctttacatcctcccatgttgtcctggcatgtgcagtatacacggtctaactcatctctccccagatctctcagaaccttgagcttgggaattgaactggggtcacctgtgtcctttcttatggactcgcaggattttagaaccctaatgcaccctggagggtagctgggccagacttctcatttcacaggtgaggagactggtgccccacagggattaagtgccttgcccaaggtcaggcttatctccagagggaggtgccctggactggggcccagatgttcagggaccctgcctacacctcatttccagtgtgggctgccttagttagttatgagaacagggaagggctgggaagagacagcctccaaggtcaacacttggagagggtttcacttgctctgaagaccctggtccaggattcgccctctcccatgccttcaagtcagcatcaggcttagggcaaagaccaggcctctgaagctgcctcttgtaattcatgcaggaagatgtcaaagtcagccccatcttggctgatcagggtgttcagccttaaccccacctgtgttctgaagtctcttaccctacctgctcaggactgagacagttattcactgaacatatttattaagcacttgctgtaggccaacagttaagaatccaata

SEQ ID NO: 5596 - DNA, 1126 bp, Homo sapiens
tgaattccacttagattcaaaacttttttagtagagagtgttaggttttccagctcttggggttattatttctactttcatcatgtcttgttttattgcactgttgtcagttttactttacagaatttgggatttttcttttcttttttcagacagagtcttgttctgtcacccagggtggagtgcagtggcacagtcacggcttactgcaaccccaaactcctggattcaagggagtctcccaagtagctgggatccaggcatgtgccaccacacccagctaattaatttttttttttttttctgtagagatggcgtcttgctgtattgcccagactgatctcaaattcctcacctcaagcgatcctctcacttcggactctcagagtgtggggattacaggtgtgagccactgtacctggcctgaatttttcttaaagtctaatatagtcacttttagaacatgtttgctcatctacgttgaccgtctctatcttgatgggcttgatctaccaaggtggacaggcttctgtttgttctaatgtttgtactttcattgtgggtggtcctcttggccctttaaaactaccctgctctgctgcttgctcttttgtgtctgtctcctttgattcaacattttttttgtgcgtttcatctgtatagttgtgtatgtttatttgttcttattgtaggatggtttttggttatgtggatgtaattatccatgtgacagactgagctcatttccatagttcttccaaacaatgctgccacagtgcgggtatgtgcgtgcgtgcgtgcgtgcatgcacacgctgttgggtatatacctaggtttggagttaactgggtcatgggtgagcatatggtggctgcatgggcagctgccagctctcagtgatggcaccaggtacatgagggtcatccttgctctgctgacgctgtaaagatgttgcttctttgcaaattaaccgctggattccctgtaattctagtgaaaatcccagcagcttttcttttgttttagctgtttatttcagaaattgacaaactcattctgaaatttatatgaaaatgcaaaagggccaagaataatcaaagcattctctctctctcttttttttttt

SEQ ID NO: 5597 - DNA, 1189 bp, Homo sapiens
acttgattatttctgaaggataatactctggctgccctcctttgatttggttttgcttgcccttgagatgaacagccgtggtgtaagtgggttgtgtacctcccctattctgctagccttattttcagtgttatacatggatgtgttaaagtactgagcatttatttttccatcttgagctgtccttgacttggagagggctctgttgaagtttacatgtcagtgtggttggtgtgcagtagactccagccaactcagagtgagaggaattaacagcaggtgggggttgggggggtactccacagatcgcctcggggtgtctacataaatgccctgtaaatgtgaatgaacagcctgtgggtggtgagagcagttttctaaggacagtccaaagccatcttcagatcttcaaggagatccatgattcgtgaaggattcactcctctggatcagaggttctgctgtagtgacactcttttttttttttctctctctttttttttttttcttctctatttcaaaggcagatcgggagcggtgccgagaaaaatttccttactagatgacatttcatcgcaatgtccgatcgtttggggcaaattaccaagggcaaggatgggaaaagcaagtactcgactctcagcctgtttgataagtataaaggaaaatcagtagacgcgattagatcctcaggtaaggcccagggttgaaggccagttcctcaaactttctccgagtgacatatcccagaaacccagagtccctcacctggttagacagatgtggtccgtgcacaccaggcttctgggtgtgcatgtagaatcactctctacttcctacttgaggtatgatttcagagccttgagcatcctgactctttctgtagtggaattttctccatctattaccttattgaagctggggagatatatctatagatatctatagatagatagatagatatctatctatagatatctataggtgtgtgtgtatgtgtgtgtgtgtgtgtgtgtgtgtgtgtgtgtgtatatatatgttttggagacagagtctcactctgtcacccaggctggagttcagtggcatgatctcagctcattgcaacctccaccttctgggctcaagcgagtctcttgcctcagcctcccgagtagcaaggattacagatgtgtgccaccacgcccag

SEQ ID NO: 5598 - DNA, 1229 bp, Homo sapiens
cctggcgagttttcagcagaggtgacctcctagggttctcaggaggggagctgtgccttgtagagtcacggtcactacagaaagtgctgcagccagcccacccagatcaagatctggcatgttggccttctttgttcacgttcctcattagcagctgcgcagttttaaagacacatgccggaactgggccttagtctttgtcgctggagcaaaataaagtagctctctgtggacacgggaggttccagagcaccgaatggagagaaacaggtttgggtcctggctttgctgtgtcactgtctgtgtgacttgaagctggtcactccccaaatcctgctccttgtctgtagagtgggcctggcattttctcgtccctgggaccgctgtgtggagtgtgcgttacagggaaggttcagggctttgctgctgctcagaaagtggtggtggatggatccgtatagggtttgaatctaaggtgctggcctctcagcaccttgttgtaataggctgttattgtacagtggaataagggagctggccctcttctgattctcttccttctttcagaatacaaattcagtgccaggtggaccaaagtcatgggcacagctgaatggaaagccagtaggacacgaaggtggtaagtgcgcacgtgtgtgtgttgtttggggacgctggggagagggaggtgaatgccttttccagaatgtctggttgggtctaggcacccagaagctttgaggactctcttccacaaagaggtaccgtctatggagcccttgcctgtgcacagcgggcgctgactctgtagaggtgccagctctttggtttctttggatgtgtgctcttgctgagacagaggagtgctgactgggctgtgctgctggtgatttttgatgatagcttgaatgtttctagcatactgtgcttcagaccaaactaggcagcagctctgagtgggaaggagagtggtcgtggtgtgggcagacgattcaaaggaatgtactggggaaagcccacaattcactttctcctgtaaagcagcactggctgccctttattaccctttgccaccatcctgatatcgccttctgcttcctgcactacccctgccagccaaggcttcaccagacttggtctttagtagcctgtattagaaaaccagctgcacatccttcgttacctgaacctcacccccagcctgccatgcctaggaggtcctgcccctt

SEQ ID NO: 5599 - DNA, 1167 bp, Homo sapiens
gcccaggccggtcttgaactcctgagttcaaatgatccacccaccttggcctcccaaagtgctaggattacaggtgtgagccactgtgccaggcaaaagcagcatcttaatccttttggggtggactggggcagggatggcagcacactctgtaggtgttgcctccacaggaaagcagttgccttcttggcctcccctgggctgattttataggaggctgtgcttgtctgtggccccaggcagtcagtagaaccttccctgctggggcaggctgtggcctggagcggctgtgatgtcttacctctttccatttgtaagcaggcactggtccttgcaggtcagctgggaaggggcatgatgctgtcagcagcagtctcccttgccaccctcagcaccctcgtggcatctgccagcacagagcacccttgtgacaagactcccttcaaaagcccacttccaggcaacacggctttcaaggtgtggagctgggaagcagacgactgttgactccatctcacttcctccatgtctaccccgtcttcttgacaggtttaaggggctcaagccgactgttatccttctctcccgaggaatttccgacgctgaaagcagctggagggcaggacaaggctggcaaagaaaagggcgtcttagatctgtcgtatgggccaggaccaagcctccgccctcagagtaagtgactgcagcctctgggcactcgatggagtaacagaacttcctcctctcatctctctgcactcctaaaagggtgctgatgccactggggtctccggttcgagctggaaacgtggctctttgactcgccacgtgatctgtgcatccattggacttgctgcctaggccattggattgggccttgtgccttttttgtctcttgggttgggccaggcctgtcccctccccctctgtcatccggttgttaattttgctgtgcctggtggctgtggcaaggatggacaaaggaccaattaacttaggtccccggttcaagagcttgttttctaaagctcccaatcctagctacatctagtcggaatcactggggagtttgtgaatgagtctgatttccagtcctcccctcccccagcccaattaggacctgtatttttaacccattcctctggggattgttacataaatcagcct

SEQ ID NO: 5600 - DNA, 1795 bp, Homo sapiens
gagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcgatggggtgctcagagcagcaggcaggttgggggagggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacataccacaggcccatcccaggccccgtgggctctgcttctggggctccataccctgccctgcaggggtgctgtgtttttcacacatttctttccctgaagccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccccccaccagaggctgccttcagcgtctcacgggtgcaggacagcgctcaggcttgggctctaagctctgtgtctagtgtagaacatggggaaggagcatcttaggaactgctgaagtaacttcttactgctctcaca

SEQ ID NO: 5601 - DNA, 1324 bp, Homo sapiens
acagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaagctgaacgtgctttctcaggttgtacatccctcgtttcttggtcatttgaccagagagacctacagatcaaagaattctaattttacagagttcacacggaaattaggagtggcacggctgaaatgccttaacagaagctgtgtgggtagagaagggattgaaacccgtggctaagaagcatcttccaaatgcggcagcatcaagcactccaccctcttcccacggatggcatctggttgtgcacagtgcctgcctgtggccccgtcacttgccgtgagaaacgagctggtcagaggaggtaagcatttgatgtggcgtgttgtgttgtcacttctagcggtgcttttgcaggaagtggaggaggattatgctgtgctttgggg

SEQ ID NO: 5602 - DNA, 1836 bp, Homo sapiens
agaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcactgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcggggtgtgggggggcaaggaggggcaggcacacaccatgtctgacctgaacccgattctggggagcatcttcccgctccggccccacgacctccacagggttacattgtaatatatatgccccagctaacctgtctgatggtggcatcttcctgcagacatttcaaacatgtaacttttatatgaaaaaaaataaacacagatgaaagctgcccaatgccatgtccgcgcccagctgcatgtgtgcaactacagtgacagcccagcctgctccatgctggccttgccatctcttttctgagacccctgtcgcaggcggggctcctgggaggctggggtcattcagctccactcccaggcccacttgctgccattggggtagtcgtggctgagtgaaatggacgtcaccagaactttccctcctaggccttgtgccctagaagcattcaactggacaaagaattgctcgtgctccagaggtcggttcatgcacaagagcccctcaccccagtgtcctgatgaaaagggcattcctcgggtgggattcgggggcacaggctctagaattgctccttcggggcccggaagcactgtctttatggcgtgcctttt

SEQ ID NO: 5603 - DNA, 1179 bp, Homo sapiens
acattgactagagcagtgattggcaaaccaaggcccactagcctactacccgtttctgtaaacagagttttattgagcacagccatgcgcattcatttccatattacatatggctgcttttgtactacagttggagatgcacagaggtcaggcattgcggcagatcctgtagccagaaaagctgacaatatttactccctgggccttcaagaagatgtttgttggtccccaatttagaggaccacctctagtgtcccaccgactgggttcaaatccacctccccatcagtagctgtggaccaagttacttgtgtgctgttttcccatctgtaaaatggggataacagtatctgcttcatgggtagtcatgagaataaatgaggccatacatgttgaatcatttatcgtctgcctcatagcaaaccatgacaaaacttggctacttacaacaaaacattttatttactcacgattgtgtagtctggtctggcccagctgggtgattctactcctgatcttgtcagtgatcattcagggagttgtattcagttgtgtggttggttgggagctgattctctttccctgtagcctcagagcccctccctctccgtgtggcctctgcacgtgatctcttgagcagaagagctggacttcttaggtggcagttcagggttcccaagagtgcgaaagcaaaagctgccaagcattcttggggcttaggcctggaactgacaccatgtcaattctgccatgttttattgtttaaagcaagtcacaagactgtcccagactcaaggggaggagactccacaagggcataaatactgggaagtgttccaccggggaccatgagtgaaacagactaccaacgtggaagaacatgggaagtgcatgataagtggtatctaccacttctgctactgctgctgatagaaacatatacatggcgggctggacgtcaggggagggtctggggtagtaagtgcctttccctaggtgctttcctcctgactggagtcccttttcttaccctgtctaccacttcaaaataaagtaggaagaaaatggagtcagttgtcaaatctggttggaaattggaggactgtttttgttagagagtgcgttgcctccttggccgccgtgtgccccctctccctgagctccgcttgctggcttggg

SEQ ID NO: 5604 - DNA, 1103 bp, Homo sapiens
agctgcactgttacgactcataatgacaatggccggcacttattgagcacttgccatgtgcggggcaccatgctaggtactttgcgtgaattaacacatctagtccccacaagagcctggaggcgtgtgtactattattattatcgttctcacttgagagctgaggaaactgaggtgcacagagcttcagttacacagcttcctcttcactagcccctgagttctcccgcctctcagcagagtgcccgacacatagcactcacgtggtaagtgacaggtttgatgataaagttaaactgtacggcaaatctcttaatagtgttctttgtggtttctttgctttcaagcttgagaacttctccatctagaaatcgttaactctttattccattgggagtcattttggtttatggaattccttgcaattttgaagtccaggttcaaggcaaagagaccaaaatcatagtgtttaattgcatttgaagccataatgaaaccaggttgacctccatgttcttgtcgtagccctgccatggactggctggcttctccgctctgctgcctgttctctaccagcaggcagagtgtcatttagcaaggacagttaggtcctgtcactccgttcgaagccctgccacggcacccatcttatccagaggaaagcttacaatggccgccctcacccacctcagctccttccttcttccctgtctcctgctgattcaaagccattccaggcacactcccatctccaccttagagcttctgtgctgactcttctgcccccaaatatgccaaatacctagattctcattttcagatcacattgcaggtgtcatcttctcagtaagcaccacatttaacattgcagcccactcccatgccctgcacatttgaaaaaccataacatgttctatcttctaatatactgtatattttactttaaaaagagtgcttactgggaagtagcctttgtttatttcagtgatatttctcgagtgcttagaaggatgcctggcggccgggcgcggtggctcacgcctgtaatcccagcactttgggaggccgaggcgggcggatcacgaggtcaggagatcgagacc

SEQ ID NO: 5605 - DNA, 1163 bp, Homo sapiens
aatggcgtgaacccgggaggtggaggttgcagtgagccaagatcgcgccactgcactccagcctggcaacagagtgagtctctgtctcaaaaaaaaaaaaaaaaaaaacaaaagttgaagttctccattataggttgtgaccaggtcttatttttaggaatgggactttatcattttttatttgaatttattttttcctttcatccttgtctgacgagtaatgaatcttgagaatatgttcatacaataatatgtattatttgttcagaaatgaaagctggaactctatgcttcccaagcagtgtctctttggggtgtaattatttctcccttctcattgtttcaaggaaaaccagcattggaatcagctgattcaggatgctcagaagcgtggtgccattattaagacctgtgacaaaaactatagacatgatgcagtgaagattctgaaactcaagcctgtgctgcagagaagtctcactcaccctcctaccatagccccagaggggtccagaccccagggtggtttgcccagcagcaagctagacagtggatttgccaagacatctgttgctgcttctctataccacacaccctctgactccaaggaaattactcttactgttacttcaaaggaccctgaaagacctcctgttcatgaccaacttcaggacccacgactgctgaagaggatgggcattgaggtcaaaggaggaatattcctttgggatccacaaccctcgagcccccagcatcctggagcaacacctcctacgggcgagccgggcttccctgtcgttcaccaggacctgagccatatacagcagcccgctgctgtagtggctgctctgagcagccacaaacctcccgtgcggggcgaacctccagctgccagtcccgaggcttccacgtgtcagagcaaatgtgatgacccggaagaggagctctgtcacaggagagaggccagggctttcagtgaaggggagcaggagaagtgtggttccgagacccatcacaccaggaggaactctaggtgggacaagaggacactggagcaggaggacagcagttccaagaaaagaaagcttttataggaaagcccagtgacatgggccagcagccacagcatattgtaaactgaagatgaccagctcgtgggacca

SEQ ID NO: 5606 - DNA, 1177 bp, Homo sapiens
agctcttaaagggttcaaggaatccaacagtacaaagaagaagtctaagaaaaggaagcttacgtctgtcaaaagggcacgagtgtctggtgatgatttttcagtgcccagtaagaactctgagagcacactctttgattcagtagaaggtgatggcgccatgatggaagaaggtgtgaaatctaggccccgacaaaagaaaacccaggcctgtttggcaagcaagcacgtgcaagaggcgccaaggtaacgagggagtggtattccagctgctggtatatttctttcgtatggattctgccgatacctctttatttagcacagacttttttttatttttaattttatttttatttatttatttatttatttttgaggtggagatttgctcttattgtccaggctggagtgcaatggtgcaatctcggcttaccgcaccctccacttcccgggttcaagcgattccccagcctcagcctcctgagtagctgagattaccggcatgcaccatgcctggctaattttgtatttttagtagagacgacgtttgtccttgttagtcaggctggtctcgaactcctgacctcaggtgatccgcctgcctcagcctcccaaagtgctgggattacaggcgtgaaccaccgtgcctacccttagcacatacatattaaatggcaaaaatcatcaagaggtagaccctcattgtacagaatatcgtacatctttaattgtgtaaacttggcaggtagtttaatttcttcatgtgtgaaataagacagattcgattttcactaagaactattccagccctagaaaatctatgagtaaatttaaaagcccaaattacctttgaaaaatataaaagcccaaattacctttgaaaaatagtctgagcaaataaccagtggaaatggggcttagggctgcacttttagcttctaggctccctctgagatatatccaagtaattcaagttccagtaaaaagtttgaaaatcacagactgagtcaactccaagatctcatcttgctttaatattctagtagcctaagtgagagccattttaagaaaagtttaaggccaggcgtggtggctcatgcctgtaatcccagcactttgggaggccaaggtgggtgagtcacttgaggccaggagttcgagaccagcctagccaaca

SEQ ID NO: 5607 - DNA, 1143 bp, Homo sapiens
cggtgagccgagatcgcgccactgcactccagcctgggcgacagagtgagacgctgtctcaaagaagaaaaaaaaaagaaacacacatctttgtttattccgatccctgaaaataaatgcaatcccaagatttcatagttagcagatgatctccctttatgactggagatttcattagcaagtgttaatccagatagcagctcctcagaccggcccagatcttggaaagcagagagggaggcctgtgggcgggggaattggaggcagcattgtccttaccttgagaagccgctagggagagagcagcctgccgcctcctgccccagctgaccctcgctagcagatgggcaccaagaccacgatacccctgtgagcaggggatttaacagggctttatttagggaagaatgggctgattagctgataaagagcatgtaagatggtatggggcagcctttgatgtctggctggcgcggcagggagccgggtggtgagtgacagcagtgtgtcacaggattactccgcccgtgacaatgccgctctctgttcttgccatgtccccactctgttacagctactttttccgttgctatgcccttcttttgaaggcatttctcttcacactccttagatcctccccccacccctgcctttcgaaggcagacgggcactcgaggatacagtagttacctttttttatttggggaaatcttgtcactcctggaggaggaatgactttgcagctaatctgcacatggaccgtataattgtggtcagggtaagcggcagagaaaacttgacagattttccacacctcagtcagggtttgagcaaatgccagttgctgctttttgaggactggaaagaaaagtccattaaaccccacaaagtgcttgagttatgctgtggtcacaattactgttctgagctgaaacgtctcctctgaaatccgtctgtcaagaaagagaatgggttccttatgttttgtatgggtgaataaaataatggcactaaattctctaaactattctgcattccattttacggtgtttactgcctagaataattatatattatgtgcaaacctgtgatatctgcaaaccaaatccatcagactaacagaagcctgtctcacctgtcata

SEQ ID NO: 5608 - DNA, 1099 bp, Homo sapiens
ttatgccagatagaattctgacctaaaatgcaatgggtttgaatcagaataattgaaaatggactaacaagctgctctcaaggtgtgatctgccgacccctgggtggttccaaaactctgctttggcagaactcttgtggggaacccagcaggtcaaacctactctcttgattttttttttttttttttttttggagacagggtcttgctctgtcgcccagggtggagtgcagtggcacgatcatggctcactgcagccttgacctcccagactcatgcaatcctcctgcatcagcctcgctagtagctgggactacaggcatgtgccatgatgcctggctaagttttttttttttttggtggagatgaggtctcactatgttgcccaggctagtcttaaactcctggactcaaacgatcctcctacctgggcctcccaaaatcctgggattacaggtttgagccaccacacctgaccaaacccaccttcatagtaacactaagctgtcatttgcccttcccactgcattggcatctgcaatgatggcacaaatacgacggggggtgaaatggtggcaacttagcctgaatcaaggcaggcattgaagtgtcctatcccaagaggccttgcattcttccctgacatcttctctccattaaaaacaataaaaactaaaaaattttaaaagttgagtgttctgtattaagcagtaaccattattaattttattaaatcttagcccttgagaacatgtatgtgtaatattcttcgtggcaaaatagaaaatatgcataaggcacatgtactgcataccagggtatgatggtgacctctggccctcatgcagttatttgaattgagaggtgaagtagctgccttttttcatggaatgccagttttatttgaaagaactgctgtcttacaaactggttattcagacttgggtgtttggcaggcagcttctcaaatgatgagctgagtctgtcacttcaagataaacaactgacagtatttgttgccaacaataaaagtcaactctcaggtggaaatcaagatattaaaaaacgtgtatatactaccatgaacttgatagctgcc

SEQ ID NO: 5609 - DNA, 1177 bp, Homo sapiens
cggtttctaacgcaggcactttaaaaagaaggcccaggctcgatcccgtctttctagttttgtttcacaatgtgaaaattactgctattctttgtaagtgtgcagatgctatgtactcatgtagaaaactaaggtaaaatggaaacacattttaaaaggtaatgatcacccgagtgaatttgatgatgtccgagacctactttaagatgcacttcgatgaaatgcagttaaccatgtgctgatcattgctgaagctggtgacgggcttgtgggggttctttacactggcctgcctgcttttgtgtcagtttggtgtccaaccttaaagacgtaactactacaaatattttgagaaatacctacctaagggtgttctgtgccaacatacagaggtagttctagaatctctgctttgtatgtgtgtgtatgtgttttaagactttatttttttagagcaattttagaatcacagcaaaataaggcgcagcgatttctcctatgccccccagccacccccactcagcctcccccgtgatcagcatctcagtagagtggggcgcttgttaccagtggatgaacctatgctgagacgtcgtcacccagtgtccgtagttgacattggggttccctcttggtgttggacattctatgtgtttggacaaatggaacccttggctttaacccctgtgtttcatgacaatgccatttggtgaggttctttgttcattcatctacatgtggtcgagatgcttgtgagccaaagagtcatgctctgttgggtggcaggacaggtgtgtgatgggacctttgcagccagccttctcgatgggagtcccagctccttcccaggagctccgtctctgggcaaatttcccagtccctgtggtttcagctgctttattagaaaatggtcccttctctgtaggattagtttgagcgttaaataagtgaatcgcatgtaagcagatgtgagtgagtgcagctcttgtccctgttttgacaacggattgcgttctctcatgcagctgtgctgggtgatttcaccattgccagctgctggacattagactctgtccagtttttcactggctggacagtgctgtgcctgactcagtgcacttttggggccaccagccccatgacaggtgccctttcctgcactccagcctctaggacc

SEQ ID NO: 5610 - DNA, 1099 bp, Homo sapiens
tcggcaggagcacaaatcgagcccagctctggtttatagcaggctgtgggccagaggagatggtgggaaatggagccaaaaggaagtgcttgccgggtgccagggttcaaggagtacaggcctccctggaacgggcgccagagccctggggcaggcctgtcctttcctggtccttggatcccttgtcctgagtagggcaggattctgggaggtgacctggattctagaaagcctgttccaggtgggcagccagcactgcagtatgggcaggacggggtgaccctctgccagctcaggccaagccggggggttctggagtcagtccctgtttaaacaagagtcatcaggttttgtgaggacctcagcagagtctgtcctcaggcaggagtcattgagaggggtccttggagttctggagctgtattggaggggatctgaggtctgtggctcaagacagtccttgtatgggctctcaagcggtaggggtatcctgcagggcccccaggagcatccctgatcacccctctgcccctccccaccagagctgaagatccctgaaaacgccaacgtcttctatgccatgaactctaccgccaactatgactttgtcctcaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtga

SEQ ID NO: 5611 - DNA, 1470 bp, Homo sapiens
gcttacaggaggcctcaggagagggtcttgcatgcaggaggcgtcccatgaatgccaaccccagttgctaacagtgtgaggcagagtcaggcccgcccgatctgagggcattgggcaacacatcctgtgcagggaactttatctgtgccttcattaggggggcatgtgtatctgtgtttctgtctctatgtgtgtgtatctgtgtctatgtctctatatctgtgtgtgtgtgtctgtgtctatctcaaacttgttttttccctttttgtggagaatggggtcttgctatgttgcccaggctggtctccaatttctgggctcaagaaatcctgcctctgcctccctaagctctgggttacaggcatgagccaccacacccagcctctgtgtctgtctctatgtctctgagtaggtatgtctctgtctgtgtgtctctatctctgcgtgtgtgtctctgttccaatgtctctgtgtgtgtgtctccgtctctaaatgtgtgtgcctgtgtctgtctctgtgcgtctgtgtctctgtgtctgtctctatgtgtgtgtgtgtgtgcctgtgtctctgtctctatgtgtctctgtgggtctgtgtgtgtgtctgtgtctctgtctctatgtatgtgtctctgtgtgtgtgtgtctgtgtctctgtctctatgtgtgtgtctgtgtgtgcatctctgtgtatctttgtgtctgtgtgtgtgtgtgtctgtgtctctgtctctctgtgtgtctctgtgtgtgcatctctgtgtatctttgtgtctctgtgtgtgtgtgtgtgtctgtgtctctgtctctatgtgtgtgtctctgtgtgtgcatctctgtgtatctttgtgtctctgtgtgtgtgtgtgtgtctgtgtctctgtctctatgtgtgtgtctctgtgtgcatctctgtgtatctttgtgtgtctgtgtgtgtgtgtgtgtgtctgtgtctctgtctctctgtgtgtgtctctgtgtgtgcatctctgtgtatctttgtgtctctgtgtgtgtgtgtgtgtctgtgtctctgtctctatgtgtgtgtctctgtgtgtgcatctctgtgtatctttgtgtctgtctgtgtgtgtgtgtctcatgtacagccagagcagtgatcaggcttcccagaagttgggaggtgagtcccaaaggtaggggaacaaggcaggaagaggaactttgtaaaaacagacaccggccagagggactggctaagtaacgccctcccccgccctggctcctgtagatgatatagtcagatgggagggagccaggccagccgcgttggggggtttagtgtgatgaattctttactcttcaccactccagcctccttggggccacccctcgccccagcacccaggaccttcaaggccagaatagtggtgattcctctatgtcctcatgagtcacttgtccttctgggctataaaacgggtgggcgcttgttcccagg

SEQ ID NO: 5612 - DNA, 1350 bp, Homo sapiens
gggaggtgatgagtgcagtgagccaagatcatgccactgcactccagcctgggcgacggagccagaccctgtctcaataaacaaacgaacaaacaaacaaacaaacatcatgggagccattggaaggtgttcccattggaagatgctcccatatgccacagggggccgatatctgatttttgcttcattttcaacccgttcatggtgcaaatgaggaaaccagaccaagaagggagtgactttccccagatcacagcaccagtgcccagcctgtccgacttgtattccgggctgtgtctcgcccctgtgagaagtttctttcctcacagttgtaaaggccagaggtccaaaatccaggggtcagcaggaccctgcagtctctgaaggcccttttccttcctaatccttccatctctaagtctgtgaggcagctaacaggttttgtagtattgtctcacattagcgtggtgatgtccccaggaagtagacgttagaaccatccccattgtgcaggtcaggagactggggaggccctgaaaggcacaatggctagtttggggtcacagaactggcaagaggcaggagcttggtgacccagatggcttcccctctctgagcctcaggggctgggagcatgagaacacactggttggctgtcccagctcccagggtggctgtgagtacctggaagtgccccttgtctcccctcacacatctgccatcactctccccatttccttaacccccagcactgctgccacttgatttttacgaacatctgaatatgacgaacatacagatttttacgaacatctgaatatgacgaagtagcaaaggtggatattcactcattcatttcgtatctgtctcctgggcccaggccatgccggggcggggggtgggggtaacaagaatccggggagttgccaggggaaggggaagtgctcatctggggagtgcgtgggcacagagagattccagaaggaggtgtcctgtggtcgtggttgattcgtggaggggaggtgtggtgatggcacagagggtgatgactgggaccagtgtctatcgggtcagcttcctgggctgctgtcacaaagtgctgggtggctcaacacaacagaaatgtattctctcacagttctaaaggccagaagtccaaaatccaggggtcagcaaggccatgctgtctctgaaggttctaggagaggatacttccttgcatcttccaacctctggtggctgccagtttccttggcattcgttcctggttttgtagacgtgtgactgcaaactgtgccttcatcagttcgtgtctgtccgcctgtgcgtgtctgtccaattttccctgtt

SEQ ID NO: 5613 - DNA, 1177 bp, Homo sapiens
ctccatttcaaaaaataaataaaacaggaccaaagtggtgatgagatgggagtgggtccactgagattctggaggtgctctgaaggcacagctgacaggatttgctgaagcattggatgtggggaataagaaaggagtcagtggtttcaaggtctggcccaagcacctggaaggatggagccgctttaactgaaaaaagggttgacagtgagaggaagagatggggcttggggggtcagatgcccattctgaactcagtaggtgatggtgttaagatacccagcagttcaggggagtcagcagcagcgtcacgcctatcctccatgaaacatcacctctaggctggtctgaatggcagtgggatgtcagaactaattaaccttagtgtcactatagttggcattcgacccccacactgctaaatttgactgccttttttaaaagtgaaaaaaatacatatatcttgagacagcctggcactccaggctagaatgcagtggcgtgatcttggctcactgtaacctctgcctccccggttcaagcaatcgtctcttctcagcctcctgagtagttgggactacaggggccggccaccacgcttggctaattttaaatttttttgtgtgtggagacagggtttcactatgttgcccaggctggtctccaactctagggctcaagtgatcctcctgccttggcctcccaaagtgctgggattacaggcgtgaaccactgcgcctggccaaaaaaatttttttaaatcacctcatggcagaagttaggggaagaaagtttagttctgtttcaaatacaacagttctgtttctaatatatatatcagcagccaccttttcaaattgtaatttaagactcttaagttctcccttctctaccaacggggtggccctggaaggggctctgggtccttaatgagcctgtaattttccagtgcaggaactggggtgtggtggtcccaagcctcaggccatgacctctcttttctcctgcccctagtgagttattataaagaccacatcttgtgttaaaaatcgcagtgtgggctgggcacggtggctcatgcctgcaatcccagcactatgggaggcggaggtgggcggatcacctgaggtcaggagttcgagaccagcctggccaacatggtgaaaccccgtctcta

SEQ ID NO: 5614 - DNA, 1517 bp, Homo sapiens
cttctcaggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacaggtgaggttctgtggcgtggaaaggagtttctcaggcaaggattccttatttcatccagaacatgagggggatggtcttaggcttcttgaactgcagttgtcattaaattatagtcatatagcaggaccgcagtccagcatttgttattaagtgttaagtgacaaggattagaaccttgactccaagcctaaactgaagagtgtttttccagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggtgagtaggccccaccttagggtgaacactgggggcgggctgttgcagtgatgtaaaatttcttggcctgaaattactgtgaagagtaaaaccgagctttttaacactgagtcagcagctgagcccagcagcttcttgtgactagagcaggccctgtgagtgctcacaaagtggttgtgtgttctaggagttaacaccgtcaccaccttggtggagaacaagaaagctcagctggtggtgattgcacacgacgtggatcccatcgaggtgcgtttgcctgttgactgctaacccaagggcttctggcagtaccaggaagagagagtagacctaatgccaagtcagtgatgggaccgaagtgggtgagggcagtactgacacagatccaacacatgcgtggctcttgcaatgatgtgaatctctcactgaattcaaccttgaagtgcgaatccatgagctttttaaccctgagcaattgttacaagctaactgaaatttgctgcttttggtcaaaatacagtcttcagctaatgctttcttccagctggttgtcttcttgcctgccctgtgtcgtaaaatgggggtcccttactgcattatcaagggaaaggcaagactgggacgtctagtccacaggaagacctgcaccactgtcgccttcacacaggtgaactcgtaagtacacagcctggccccaaacttccccccagttcatttaatccatgcctcacagttgtttccttttgccttaaaggccaatcttttagtttaagaaatatatttatctgaacttttgccaatgatggttaagaatttcttcacctgaataaaccatgtggtcagcattgcatctgaggcaaaagactgtcttgagctaaaaggtatttttgcattctaaaagggaaactaaggcaaaaaacccacttttgtttcccctcctgccttttagggaagacaaaggcgctttggctaagctggtggaagctatcaggaccaattacaatgac

SEQ ID NO: 5615 - DNA, 1517 bp, Homo sapiens; identical to SEQ ID NO: 5614

SEQ ID NO: 5616 - DNA, 1517 bp, Homo sapiens; identical to SEQ ID NO: 5614

SEQ ID NO: 5617 - DNA, 1517 bp, Homo sapiens; identical to SEQ ID NO: 5614

SEQ ID NO: 5618 - DNA, 2676 bp, Homo sapiens
tccctacttgcaccagcagccgtctcagcagtagctacatcagcctgatggatagagacttcatgacgtgcagcagctggaacttttgtttataaagcatctcttttcctcacatttattttgaatttcttacgtttcaacctatgcagattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgtatgcagtgtgatcctatagcgttgcccagcctgaatggggctcccctcaggatgccagtgagcgaggttacttctctaggcttctctgaagaccactcagaagccatgtccagagagaattagtccctcagagtccctgctgcttcctgggtgtgggggacagactccctcagccctgccttagagggcagcagatgtcatgagacaaggataagtgggtagagaagacact

SEQ ID NO: 5619 - DNA, 1179 bp, Homo sapiens
cctggagaaactcagcaggggcccttgccaggggccccagcaggggaggcagcaggctggacatttggagcatgtctgtatggtgtgaacactcactctcttgtccatgggcaagttgctcacccatctgtgctcagcccatctgtaaaagggaaatggactccaagcactttactcttctgtttgtcctcagtattctcatgtctagaatgaagcaaggttatggttactaccaggatggagtttttttatagagaacttaaaggttgatcataatgaaagcacacatttaaggccaggcgtggcagctcacacctgtaatcccaacactttgggaggccgaggcgggcagatcacttgaggtcaggagttcgagaccagcctggccaacatgacaaaactccgtctctactaaaaatacaaaaagaacaacctgggtgtcgtgacgcatgcctgtagtcccagctactcgggaggctgaggcaggagaatcacttgaacccaggaagtggaggttgcagtgagctgagatcacgccactgcactccagcccgggtgacagagtgatatggctcaaaaaaaaaaaaaaaaaaaaaaaaaaagcacacatttatatggtgctttcccaccaggcacagctctgagtgctgtacatgttctaacacaaaagccttcctaacattcttaacaccagatttctctccgttcagggtccctgcgaccgcaggctcagctcgaggacctgcagaaacagggaaatgcctcctggggcactcctctcaggagtaggagccttgggtcagaaaggtctccctcgtatccagcccaaatctgccttgctttaacgtctagccattggtcttagctctgtgctttggggtcagggagaagggatctgctccccttccccgtggatgtgggagagatccaaaggcagccgccatgccccaaacagccactcaccaggagcagcgtaagccttgctcctcctctcagttgctccggggttgctaactcagagaagggaaataaatagtaacaaaggcgagcatttattaagtacttatggtgtgccgggcctcgaaacatcatcggatttcattctcagaccaaccctaaaggtgctggtgttaactccccattttaaagataagaaccagccgctcaaccaggataagg

SEQ ID NO: 5620 - DNA, 1369 bp, Homo sapiens
acatgcgttgtgttttttcagtaaacgttctgtatctttttgatattccatgacccagtgcacgctgtggcctgtcaccgccaccgtggccccgccagctggcctcccctttggcccacgccggccgcccccattctctgctgcgtagatgccctggcccagggccctgactcctccattcccgccagtagctgttcctagtgtattttcgtctttctggaaaacagcattgagtggttgttttctgtgtaaagagccgtttgtgtcttgggagtttgtggcccacatgccgatagcacggtcatcgcacatgactctcccgtttgtctcagtgtccctgcaacaagcagcaccgcagactgtaataaaaggtggggttttgtgaatggttgtggcaagtgcgtccttgtgaagctcgtctccatgtggctttcttggagaaaggctcccctggggcaagagggtggaaggtttctttggacaggaggtgctgaggctggctgcacctgctctctgaagacgccttcctctctaggttcattgttcagtgttgctgggggcggggaacgggggtggggaggttcttagttgcgaaggagccaagctcctgatggacttgcgttgggatgtgggggacacctgtggcatggtaaggctccctgagtcccttactccaggtcagatgccagtgggactcatgcgccctatgagggctgcagggccagtgctgcccctcggactcctcgaggggttgggtgctaagcgcgagcctcgccgtccctgctggagccctcgcctgcctgcccctctgcctgtgctcctggcagtgtggcttcccggtgctcacctgcacagcagttaacagcagaggccgagcgggagcctctggggagcgaggctgaaacctgaacctgcccatggagacagttgtggtgagggttgccacacacagtgagggcggagcagggtggctgagggcacaggtgcctgggtctgtcccacggggcagggctttggggctgtgatgctctgggaagccagcttgggtcctgggtctacagagggccctggccccggagcccagccagctctgcctctctcagggcctggagtcctgggggagctcagccagctctgcctttctcagggcctggagtcctggatgaatcctgcaggtttttggttgcaccggcccagggaggaagcggggggtttgtcaggtgggctctcctggaggtcctcgagtggcaggggtgaggaggggattatctgaggcatctggagatgtatatcctgtggtttcccctgcccctctgtttccgatgaggtgtacggatgagtgacctgcactaagaagtgagttgccaca

SEQ ID NO: 5621 - DNA, 1199 bp, Homo sapiens
caagaccacgcagagcttgcgaaaacggggctgagccggcgcggcgcatgcgcgggcggcgtcccgcgcaccacagggtcctgaacacccgcagttcccggggcagggccgcgtccggaagtccgtggaacggatcttccgatccttgttctctgattcgttaccaaccttccacttccgtagacagttcttcccgccttccgccgtctgctaggcgtgtcgccgcaggaggtgcgcgcccgccctgttttgtttccgggggaatctacttctctgaaggacgctcgggacttccgtttgttcccctcagcttctaattggctacttttatgaatatattagggcacgaaaagtggtagatttttttcttacacgttcaaattttaaaaaagacgattaattgaatgcgaacatttgtggtttcccactgaaccgtgacatttttataaatgtacctccatggatagcgaacaagaagtcaccctcaccgaaaggcgagtggagctttcgtccttaaataaagtgcgcagggaagccgaggcgtgttgtatgaaaggagagaaggttagcactccccttgacaaggatggaagaggccctcgggcctgacaacacgcatacggttaaggcattgccacctacttcgtggcatctaaccatcgtttttttttttttggtgttttgttttttatttttcttcagacggagtcttattctgtcgcccagactggagtgcaatggcgcgatctcggctcactacaacctgcaccccctggattcaagcgattttcctgcctcagcctcccgagtagctgggattacaggcgcgcgccaccacgcccgactaatttttttgtaattttagtagagacgaggtttcgctatgttggccaggctggtcttgaactcctgacctcaggtgatccgcccgcttcggcctcccaaagtgcggggattacaggcgtgagtcaccgcaaagccccggggcatttttcgttttatcttttatcttctttccttgggacacgggcgcgggtcgcacttgtgcacgggcgcgccgttccgccgctgcttggggcttttccgttcatcttcaccgcccgttcttggcattgggtcgtgttcgcgtctcgacacccgacagggcccgtctcccgagggcgcctcggtcgccgcatgaggcacagggcggctcggcg

SEQ ID NO: 5622 - DNA, 1227 bp, Homo sapiens
cctcccccgtgcctccactctgcctcctccagccgccacgctctggtctggagggtaaagaggctctgtgtttacagacacctcccgcccggcctccggcgccagcggaacatgagtcaagcatgacttcgtctagaaggtgattgtgctggcaaagcataaatcccggcccctcctgccccccagcctataaataaagcgatcatatttataatgatgctgggcagagctgccaggcccttcacagcttcaaagtgcttcacaaaacactcgctaattaattctcggctgccctggcggaggaggcaggtgccaaggagcccagctccaggcacctggggagaactggcagcaaggcccctcgctcagggccacccttgtctggggctccccatgccctggggctacctctgagcaggagaaaatccctggcaccgggccgggctggcgcgtggggtgggaggctccggtgacagctctgagcacctccaggccccccgtgtgctggcgcttcctcttggagccatcctgggggtgggcgctgtcattttcatcttacggatgagggagccgaggcacagagaggtcaggggacttggccggggccacacggctgcttgggctgtggcaggctagcaggctctgtggggctggggttgtcggatcccagggcctgcagctttaggctgctcactgtcttgagcgctcagccctgcccctttggctctcagagcctcagcttccccactgggaagacagcagtgccagctatgtcttggcactgagactttagaattctgcccttgctgcccatccttagggtctcagggacctgggccagtggaggtgccgtacccctcagctcagatgctggctgagatctgcgtgtgcgggggcttcctgccccgggggctgctcagcgtgggtggggtcggctctataggctcaggaccctgtatggagggtcgtgtcagtagtgaccccgccccggatgagcaccgccctctggagggctcatggaagtcccatgtgggggctgaccggagccttctgcagcctctgccagacccttgccatttgcccaccagccctgctccccatcctgcccccacccaccatcaggtttccagtagggccaggcctgtgcatgccgactgcggggtccctggctggctcctctgcctggttggtgtatcctgaagctggggatgggcctccccgcctgag

SEQ ID NO: 5623 - DNA, 1176 bp, Homo sapiens
ggacacacccagacatgtgggagcaacagggcctgggtggaggactgggggactggggtcttgccgggaaggtgcagggaaggagagagggaggcacggggcagacagggaaggggcggaagggtggggctggcgggcaatgggcactggagatggaggcaggctctgccagccacgagggcggggaaggtgaagtggagtcagcgtcctctgccagtgcctggaatcctgcaacctggaggcagccttgcgatgagctctgctgcaggcctgtggacgcgagccccactgcttcatggtcgcccactccctctgttagagtctgacctgagtccatttgtactggcagcttccacaacacccactgagacccacgccaacgcgccccgcccacgagaacccaggtcactcccgcttggtgactgcggaagaactttccgggtgtcacgttggtccagtcccaggtatagtccagacccagtgtctgggaatcagtgggcttcacaggcacacaccatggggtgtgcaccccaaagcaccgcagcttgtcacaagtcgggggaccctggggtctcctctctctctctcccccgctccccaggctgtccttctctcaactaagtttccatctggattccagcccacccccatgcacgggacgcaggagctctgggtgcccaccactccatgaagggtgattgtggtgatgtatttgaccttctggcagcaatttaatcaaatctggaaatctgggccggcacctggttcgggactcatcccctgttgctaggaaacccaactcctgcggatcccaccctgctccatccggagacagtgggagagaccctcctgcagctgaggccagggctggggaatggctggagatggatggggacagcagtggcctttgcactggctgacttcacagcagaactcccacgagtgccgagaaacagcgtgtaggggcgctgctctccctacaagcccttccaggcgctgcaggtccgcccctggccctccccccaactccccctccacctctcacaccccctctacccaccctctccctccccctcctccacctacttccacagactccaatctgtttctcctgctccaggtcacttagaagcttgtggcgcatccctcggtacctctctctgcctgcgcaccata

SEQ ID NO: 5624 - DNA, 1180 bp, Homo sapiens
acctgggggtctgtctcccagaaggccctggccacctcctcaggctcttcctcctacccagcctcctggaaaatgttccaccacccacaggggtcccctccttctcccatctccccaatagcagggtccctccagggtgggctggggtgcctggaggaggtgtcggaggcagtccaggcccaagcacttcacaccctgaggcagctgccctctccaggcctccacctttcccactgaggtcttgccccgtcccctcctctgctcagtgggcagtgggccacagcagtggtgacggggaagccactggggtggccgggggggtgtgccccctgtgggcctggcagctgctgctgcacctggctgtggatgggaaatgggccggctgtccaccttgacccttccctgcactctgcctgggcctgggaggggcaggtcaccctggcactggagacccaccatctccccagaaggaagaggccagctcacgggactccatcattacccaccatgctgagcaccaccggacccgccgtagaccctcagtgggggcgtgcaacggagcaggcaccacccgcctggcctcactgtcccctcctgggagtggcccccgcactgtgccacagcctcagtggcaccctccctctactggcacccgcctgtccctttgctggtgccacccagggctggtgcccagaggacccacctgcagtgggagcaccacgagggccacgcagatcatgatgaccaccagcagctgcgatggccagatcttgggcgtgacgtcaccgtagcccacggtggagaaggtgacgatgcagaagtagaaggaggtcaggagggacaggttctcgcccgcccgctccaggtgctggatgccgcaggtcctgcaacccctggcagtgaggggcggcctggggcccaggagctggggggccgtggcccctcagagatcctgcctgcccacgggaccctcactgcccaggagactgagctgtgcatcaccaggcgagccccgccctcctgacagctgggtggcatcaggccctcagccctgcccatctgtccccaagctctgccggagccacctcctgcctgacgctggctgacaatgcagcttggccacagcatggcggcctctgttcacggcgaattccccggagcctccctgcctgccgggtgg

SEQ ID NO: 5625 - DNA, 2558 bp, Homo sapiens
tgcctggctccctcttctgtaaagaccatgggtgttcaccctctgttatcacttctgattttcatgtcagaaagaggatgctgggctccctccccgggctgatgccagccctgcccacatgctgtctccgctggtgtccccaggcactacatggtcctagcctgtgctggtttcccctcagccccattaacacactcagggctcccatgtctaccttcttactgctgttaagttaggacagtcatcctttgaggtcacggtggaggtcacgaaatgatttcagttgtctgtgttcacagagtagtctgagatgctacagttagttgcctttgtaagtacagaagacagtagaattattgaaaagcctagagccttttcacgttgttagttgctcatttaatcaatcaatcaattattttttttgacacttggtctccctgtgttgcccaggctggagtacagtggcacagtcatagttcactgcagccttgaactccttcctttgggtcttgtgtgtggcactcacctggtcatcccctccctgtcttagataacatccctgaggacctcagagaccctttctacgttgaccagtatgagcaggagcacattaagccgcctgttatcaagcttctcctgtccagcgagctgtactgccgtgtctgcagcctcatcctgaaaggggaccaggtggccgccttacagggacaccagtctgtcatccaggccctgtcccggaaagggatctatgtgatggagagtgatgacacccccgtgacagagtccgacctcagtcgcgcacccataaaaatggtgagtggtctgcggtggccgcccccaggggccatcctctggagccgtgggctctcgtgtggcgcacctggtgcatggatggtgtgaacacggtgtgcggcgaggtggtggagacccgtgcttttgcacactggcgttccttaggaaactgcatatcttttaaagcacatgactgttgtggagaatggggaaaagagagctttcattgagctctttttctcattgggaatgctctgtgaatgctgagattggagtgaggcctgttaataaaaatacttgaagcagactttttacagatgagaaatgtaattgttgcacccattctgttaggttgtttcatgcatactttgtgctaaaataactcagtctgcctttttctcccccaagtatcccacccccatctttctctgaagccttgctactggtgtgccttttccagagcgttctgggtcagggccattctcggtgcctcctgcactgcctttgtttggttgctcccatggcgttcccggtgagactgcgggtgccgtgcggtggttgaagagagtgtcattcctgtcgaatgaggaagctgcactaaggcgtggtgcagctgtagcaggtagagctctggactaggagccagaggcctctggtgggcagttggcctggggcaggtctcctgtctgccttcccacaaccacgacctgggagctgcaccgcctttcctgggagtcccacagggctgttgaggagataagaaaggacagtgtgagacagtgcactgtgggccacagggctggcctgcctgcctgagaacggactcctggttccagacggtcttgaggcttgaccagaaatgccaggcttggaacagtgatggtgcgggggaggcaggtctcaaatctgagtatctcttcagacggaaagggcgagggatgaagaaattaggccagaatgctgagtatgagcaggttccctgcatcagaacctggtaagaggggtgggtttgagggattatagctgctgcctctgcccctagagtgcccacatggcaatggtggatgccctgatgatggcctacactgtggagatgatcagcatcgagaaggtggtggccagtgtcaagcgcttctcaacgttcagtgcctcgaaagaacttccgtacgacctcgaggatgccatggtgttctggatcaacaaggtgagtgccctgcctagatgtggtgtgtgactctgcttctgtggccggtctccttttcacttgagagcagcacaccttgtctgtcacgctgagacccagcccttcatttgggaccagtcatattttgtgtccagaaatgtgtctgctgtagttaaaaagaagcaaagcaagcaggtgtttctcccgcaggccgagagtagagggtgatgaatttatatctgaaaatgcagcacatgtcggtactttgagtgcctttaaattttttttttttttttgagacagggtctcactttgtcccccaggctggagtacagtggcacgatcatggcttactgcagccttgacctcccaggctccaagtgatcctcctgcctcagcctcctgagtagctgggatcacaggcacgtgctactatgcttggctaattaatttttttattttttttaatttttagtagagagggagtctcactgtgttgcccaggctggtctcgaactcctgggcccaaacagtcctccctccttgacctcctgaagtgctgggattacaggaatgagccacc

SEQ ID NO: 5626 - DNA, 1099 bp, Homo sapiens
ctgtaagttatcctggcttgaatccaggcgccccagtttcctctgtgttgccacattcgtcaccttttgaaaaacttgatattttacagttccttctgaccactcatccacaagccccccctgttcggcagcctctctgcggggtgggggccctgcccagagaccgggagggtcatttgccgtcgggggtgtccatgagcgaggggccgctcaggctgccagccgcctccatggcacagtctgcagggctgaagggtccctgcgcctgtgtgtgtggaccttcctcgcccgcgcctcatctccccattcttccttctctctcctgttctttgattcgggttttacttcctccttggaggtttctgtctgtctccgacatgctcagatggcagatctgctccatctgcatgctgtcgtctcgtgtggcactgatcgtttccttggggtgtgtgacattgtgctgtggcctcacctgcggagctcgtgttttccatggagttccatgtggccaggctgtagacatccacctggggtgattctgagtttgcttctgctggtgatgagtggggcccctgccccaccatgtcccgcagtgtaacccccggcttcgcagctcaggtcttccctgcacagggttccgtggagacaaatgcttttctttgtttcttttaaaatttaatttaatgttaagttctgggatacatatgcaggatgtgcaggtttgttacataggtaaacatgtgccatggtggtttgctgcacgtgtcagcccatcacctaggtatgaagcccagcatgcactagctatttttcatgatgctctccctcccccagaccccctgatgggccccggtgtgtgatgttcccctcactgtgtccatgtgttctcatttttcagctcccacttataagtgagaacatgaggggcttggttttttgttcctgtgttagtttgctgaggacagtggcttccagcttcatccatgaccctgcaaaggacgtgatctcgttcctttttatggctgcatagtattccatggtgtatatatcccacattttctttattcagtctatccggtttcttttcttatccgtgggc

SEQ ID NO: 5627 - DNA, 1177 bp, Homo sapiens
gagagagacaagtaaatgggggccgttgggacggcgggtgcctggagggcagctctgggctcagcgggcagtgcttagagcacaggcccctctgttgggggatggggaggagagcagtctgcccttgggagcgtaggccccagggagacttctaaagccccccctgtcgtctgctcttcacccagcaccacagaggcacctgctgcacacacaagcatctcactcggcccacggagggggccaggcttcctttgcctgaagctgttttgggaagggtctccacacaggcactgatctcccaagcttttgtcatgatgtcttttaccatttgataattttaaacattgtttttaaacccaaaacatttagtggtccgttgcctctgaagatgtaaacaaacaaatacactatttctgggaacatttatattgagattctttgtggctattggtgtgtctcacaggcaaaatttgatttggctaaaataggctcagatgtatttgtgtgcccgtgtgtgtgtgtgtgtgtgtgtgtgtgtgtgtgtgtgtatgagagagagagagactttgacggttgtagatattttttccgctttgcctactttatgttgtataatcatgtgtttactaacaagttgatgacatggatgtattcataagaccatgtaatattgatgtgattgttgtcgcttgagaaaaaaaggcaacagctgattctttcaacaactgtcacagaatggctgggctgagaacgctgcccagggccctgcagctggcgggagaggtgtctggtgggagcggtgtctggtgcgtcagcctgctgcttcgtgtctcactcgagagttgcttctggtttcacactttttaacccctctgtgctttagcagccgtgaccttgccttcattgcttcatccagtgcaggcctgggttattgaagacaccaaagtgtttctcttccagtttgaaaaccaggcaggtttacacgtgggtttcagtgtatttgcctttgaacccttcaaactaaactttagccttttggctggtgttgaatgtctttagctggggtgacctggagtgacctgggacggtgttgtggtttaccgtctccagcttcagcctttccagaaacccttgtggagggcagtgttggctgcaggtttcatcatattgcagtttg

SEQ ID NO: 5628 - DNA, 1131 bp, Homo sapiens
aaaacagggctgtccacagggccctcggctcagctcaagggtctgaatcccagctcttttttgctccagcatgaccttgggtaggtcacacatgtctctaggccccactctcctgtgccctgggccgagtccagcagaaaactggaagcaggacgggagccctagtcctgggctgtgggggtcaggtgtcgggaattccagttgtctgtcagacagctgtccgtctcctgggctgtgggggtcaggtattgggaattccaggcagcatcggggacccgggaggtgccatctccaccaacattgcgtctcttgttaactcgttcagctgtgagcccagcatttgcagacctggaagaggccaccagccgtgagatggacaggctggggccgggcaggggctgccagcgccggtcgggaggtggacggggcttggaaccatcacaaacacccttcagccctggggcccggaccaggccctgtgaggctgggtcacggggtggacctgcttcagctgggccccttggggggccacaggagaccacgccctccagcctcccttgtttgggtgtgtggactgaggcccagggcggggttcattccttcgagttcattcacacagcagacaccggtgagggctgtgtagggcatggacacagggagctcatggcagggctgacacagggtgtggtgggcacagggacaggaggcacgggaggcttcccgggatgtctgggaagtgttccaggccaaggctggggaggctggcccagggcaggtgacggacagaggcctggactggggtagcacccatgagaggggagaagtccggggcagtcggcgggtgccgagggtgagtgacacgtcctgggggaggggtagccgggtgccgagggtggatgacacatcctgggagaggggtagccgggtgccgagggtggtgacacgtcctggggtaggggtagccgggtgctgagggtgggtgacacgtcctgggggaggggtagccgggtgccgagggtgggtgacacgtcctgggggaggggtagccgggtgccgagggtgggtgacacgtcctgggggaggggtagccgggtgccgagggtgggtgacacgtcctgggggaggggtagc

SEQ ID NO: 5629 - DNA, 1179 bp, Homo sapiens
aggccgccaactgcactgtgtccacccagtcctccaggatcgatgaccagcgctgcccgccacctgacgtactgccccggggccctaccatgccggacgaggacttcttcagcctcattcagagggtgcaggctaagcgcatggacgagcagcgggtggacctcgccgggggcccggagcagggggcaggcggcccgcccgagccccagcagcagtgccagcctggtgcgagctaaggccctgtgcccaccgccaggcccaccctgcccccactcctggacgccggtctcacagtcacagccacgtcctcccgaggccattgccgaggacaggcactgggcatgcagccccacggcctccccgacccagggcgacaggctcaggccaagctgcccgtggtgggagggcgtgcttccatcccgggctggcccccatggccctcagcttcctcccttctgcccctgccgcaggccggacggggccttcggcatgtcggccccgacctggtgctgtcagactcccgcatcctctcccccaagcccttcccgttctgccctgccctgccaaatgtgaaaccctgctgtctcccccaccctccccaaaggtgtctctgagccgcctcttggggccaccaaggacagggccatgttctgtccccccagagctggtcttgggatggccgtgtgacaggcatgctccacccctccagcttcgtcctggggcagggctccctccaagcctgtctccccactccccggccagaggtcagcaaccacagaaggccccccagaccacgcatggcagaccaggctgcagtggcagccctgaggtgccccccgccgagtcccagggccctgcaggggcctcgacaggagccgggcctatctctaaagcagagggaatggctgggcatgaacttcgacattccaaaaccccaagccaggaaaaagggcagggcctggtcctagggatgcttactggcagcaagagcagtgcccagtcagggtgggaggtagcaccaggctctgtgaccctcacccaagtgggggggtggtcagtggaagctggggaggcttcactcagctcaaccctgcagaccccccatatgagaacccccctcctcccaccagctgggggagatgacatcactgctctctccatggggagggggctcacagg

SEQ ID NO: 5630 - DNA, 1127 bp, Homo sapiens
gtgaaaccatgtttggaaccctggaaagcatgtggagctggggcccccagagaggcctcctcccctggtgccagggtgcccacttgcagcagctgggaggctggcctccctgagaaaccaccagaagcaggcagcctcagctggacctgtgggcctgtcatagggagtgtggcagagggccttccatctctccccagggttgtgtctcgcaagtccctgggctgaagtgtgggaggaagcaatgtccaagagttggggaggaccccggccagccaggggaagaggccctctgtgccccatccatgtacagcctcctgccctgcctgggtgtgatggctgtcccatgggggagtgggaggcccaccagagggatggcttggatggggtcagagcccccgagggagggagtgcacagtcacgtgtggccccaggagtgcctggagcagctcccgcctgagctgagggtgccctgtcccaagtgggacactcacccacagggcccctcctcactcccgtcccttccccgtccatcatggctcgggggtgtcactcttgtccccactgcctggattttctttcagggagccccagactctggtaaatgctctgcttcctcctgcctggatacttctaatgaccctgacgacctggacgtgctcagaacccggcatgccaggcacacccggaagcggaggcggctggtgtgagcagcaggtgagtcctgagtggggaggccactgccctacaacccaggggacagagtggtgtccagatggcagggggccttggcctctgctcggctctttggcgctcacagcaggtgtgctgggttaggtgggcaggtccagggtcatggaggccctccagggggagaagcatttaacccacatccttcctgctggccacccatgcctcgggccttggcaccactgtgcccctgaccataggctcattccctgcctttggggtctgggctcctccctggccgctgtgctctggtggtgccctgttcccgtgcattgctgcgtcgtctcccagcttgtaaaacgatcaccatccccaaccgcagccaccaggctggctcttcactgctggagccctggtgccctggcctggcccttggcgca

SEQ ID NO: 5631 - DNA, 1460 bp, Homo sapiens
atccggccagcagaatttatgcaaaggtaaatccacggcactgtgggcgatggctctgtgggacgtttctgttccggcctctgcagcctcctttggaggaatcgtgcatgagtgtggcagagcaggcaggcgtcagtgctggggagcagctctgggctcagaagctgctgggctccttccggtagagagattgggcctttcttcttgttgcgaggcagaacacagaaaggaagatgcgctccgagtcagaagcatggcctccattgttttttttttttttttttttttaggaagcctcgaggcattccctgggacttgaccacaactccccaccctcccaaaccggcgggtatggcctggagtatcagcagccatttttcgaggatccgacaggggctggtgacctcctggatgaggaggaggatgaggacaccggatggagtggggcctacctgccgtccgccatcgagcagactcaccccgagagggtccctgccggcacgtcgccctgcagcacatacctttcctttttctccaccccgtcggagctggcagggcctgagtctctgccctcgtgggcgttgagtgacactgattctcgcgtgtctccggcctctccggcagggagtcctagcgcagactttgcggttcatggagagtctctgggagacaggcacctgcggacgctgcagataagttacgacgcagtaagtgagcctcacggcgccctctggcacagcgcctgtccgagcggcttctcccggggagaacctggagccatcctacctcttgggtggcctggtttgatttccaggacaaggcgatttgcgtgacagcctgctatccactttccctttgactttgcttctggttacacgtgggaatagaaccggctaaagaggactggtgagctagaagctgtgaattggatgcagttgggcacttacagggctgtaccctcagtaaaggcaggctgcagtcgccagcttgctaagtattccaagaggaggaaaatttttaaaaaattataatcacctaaaaggttataagctctgaataaaaaaaaaaattttttagctgggcgccgtggctcacgcctgtaatctcagcactttgggaggccgaggtgggtggatcacctgaggtcagcagtttgagaccagcctggccaacatggtgaaaccctgtctctactgaaaatacaaaaattagctgggcgtggcggcaggcgcctgtagtcccagctacttgggaggctgaggcaggagaatcgcttgaacccgggaggcggaggttgcggtgagccgaggtcacgccactgtactccagcctaggcgacgggcgaaactctgtttcaaaaaaaagaaaaattattttcttcctgagacagtgtctcactctgttgctcatgctggagtggagtggcacgatctcggctcactgcaacctccgcctcccga

SEQ ID NO: 5632 - DNA, 1223 bp, Homo sapiens
gaatcagtgtgaccaggacctatgggagtgtgggggttcaagagatgagtttggagagggagacagaggccaagtcacaccccgccttcggaccaggttaataagggatatggcttttatccaagacttcggtggtgctgttggagggcagagctgttaagtgctttatgtgtacaaactgcacttagagtgagttactgttaataagccctgtttttacagagatagcaactaagacccaaaggacggaaccagcttgctccaggtcccgtggctgagcctttgttgtcagcctctgctttgtcttccaaagtctgtagaaataagtcctgtagaaaggcagatgctcacttttaacccagacaaaacataactaaccgcacctaacaggtcatcacaggtttgttgtctcaagcctgttgtaactgggccgctttctctgttttaggtttggacctcctgcgtacagacggtttagtagtggtggtgcctatcccaacatccccctctcttctcccttacctggagtacccaagcctgtttttgctacagttgatggacaggaaaagtttgaaaccaaagtaaccacattggataatgggcttcgcgtggcatctcagaataagtttggacagttttgtacagtaggaagtaagtactgttgtgttgtcgtgggtggtcccgcagttttaacatgcacatgctttagttgactgttagttgtaattagcatgccaattatgaattgtaccctgagtggaaacaaagtgtacgatttcataaatgttgagctacacatatacctgtgaaaccatcagcacaatcaccctcatgtaattaaatctgattatcatgtcatattgacatcttaaaatgtttctcttgattaaatcttattttgaatatctgatgtaacctgtcaattttctttttactactagttcttatcaattcaggatcgagatatgaagcgaaataccttagtggaattgctcactttttggaaaaattggcattttcggtcagtacccagttttgtaattttttagactatacttttgaaggatgtttgagatttttcttgtctataatggttattttaataaattatcaagttgctaagttaatgttaataaaagacttttaagttaaaagataatttttgtatgtgtgttaaaagcaaaagtagattttaaaaaaaaattgtgtttcagggatagcct

SEQ ID NO: 5633 - DNA, 1178 bp, Homo sapiens
atcagcttcaccttttttggcacttccttcctcttcatcacgtcccacttcacctgtaagttgcttggtgcccgcaccgcaggtgctgtgtgagaacagcttcctctcctgaccgggaccctgtccaaggcaggggtcctgaccgctggcttcatcttccacccagggccgtggggtgggcaccacgcttgctaagatgcacgccaaggacccccggcagaccccggcaccgagggcgtgccgtgctgggcccgtgctctgtcctccgaggcggaaatgtcactggctgggcccggcagcggatgcccggtggggttgcgtctgccgggggtgcgcagtcagggcacagtccagaggtgcggcgctttagggagactcgagcatccggaaccctgtggtccctaccccatttctgttcccacagcaggtgacgggaaggtggcggagcggctgctggactacaccaggactgtacaagccctggtcctgcccagaaatgtgcccgacaccaacccctatcgctccagcgcaggtgagggcgtccacgctgcgtgtgggtggtgccgccgtggttcgcacacgggcgcccgtcgtttttagggcagttctgaagaggcagcgtcctgagctttgggaagcgagggccgaaacgtccagtgcccccagcgcatggcccctcgcggttctttagcacggttagtggggtgggcggatcctgtccactcggcgtggcccactagcctgggtcctggtcctcgccactgcccgccccgccgcctcccctggctgtgtggagaggagcagggacgtggccatcgcctgccatgggcatcgtctgctcctgaggctgctccaggtgccttctggaactgtcccagtgcgaatcccacccctgagggcccggccccaccggctggcgcccaagacccacttcccctgagagccactcccaggccatgttctggggaaggggaaggacctgccgtccctctgcctgtgcccacacatggcccactgtgccgcagcggacgtcaccacccgcttcgatgaggtgttctggtttggagacttcaacttccgcctgagtggcgggcgcacagtcgtggacgccctcctgtgccagggcctggtggtggacgtgccggcgctgctgcagcacgaccagctcatccgggaga

SEQ ID NO: 5634 - DNA, 1201 bp, Homo sapiens
gggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaagcaccttcacctgtggttccctttggtttgctggaagcgagtgagtgcaggtgtccgcaggcctcggcgctgtcctggaccgcacccaggtcctctccggggacctgcacctgcctcgctgggacctgccggactgcggggctgccgggttgggaggggcgtgggagacccgtccgggtccggtgcggcgcagtcctccggccgccaggggccgctgtgggcggggccggggcgcgggg

SEQ ID NO: 5635 - DNA, 1348 bp, Homo sapiens
ttttatttttttatttttaattttttttgagacagggtctcactcttgcccaggctggagtgcagtggcgtgatcacagcttaatgtggcctcgacctcctgggttcaagtgatcctcccatctcagcctcctgagtagctgggactacagctgcatgccaccacgcctggctaactttttttttttttttgtagagacggggtttcaccatgttgccaggctggtctcgaattcctgggctcaagcaatccgcccaccttggcctcccaaagtgctgggattataggcatgagccaccgcgcccggcctgatcagtatgagtctattatggatgttttataactgattgaagtcatgtaacctgttagcttttattaacatctttctctactgtaacgtttttgcctcccagccagaagttctaaattatgccctggatgattttggtgaaaggggaggctgccttactggagtcactctccgtgttgacaggatattcgcggaggcctcctgttagaactggggagttgactcgagcgtgtttcccagtggatggggcggcgtggtgggcagcgctgcgtgattagccctgtttgtgattagcgtgcttgtgttttatgctgaaaatggataaaagcagcaaatatctacaaatacccactaccacagggactttgaaactcaggaaaataatgaatcgctacgtgtctttagtctccaaatggtgaataagtgtgtttttgaggcctttgggttgtttgtgtatctgctgctgcgtgaggacacatggcctgtcttgactcatgtcacgtgagcgccgccgataacccaccaaggtccctgaaatgccttttgcaggatgctttggagtctgcaatgaagaatggcctgtggggtcacgctctgctacttgcaagtaagatggacagccggacacacgcccgagtcatgaccaggtacagtcccacagtggcctggtccagtggcgagccctgctggctccctgtagcacgcggcgtccgcaccctgggggcaggcggcaggcggatctcacttgactgtgctgtgctcccacacgaactcgggcttccttggcctcgaggcttccttgggtcgtgttgtggagagcttaaaaagtttttaattaactgcatggtttttagtacttcatgtaaaatctcagtgaattcctcagtcttcatcttttatagctttttttaaattttgagttttgctctgttgcccaggctgaagtgcaggggcgcgatctcagctcaccgcaacccctgcctcccaggttcaagtgatcctcacgccttggcctcccaagtagttgagaccacaggc

SEQ ID NO: 5636 - DNA, 1099 bp, Homo sapiens
gaatatttcagacaagtgcaaatagttctttcgaaccggtaaaatctcacttagttggggtaaaaccatttgaggcagatcgcgccaacgtggttggtgaagtaagggagacctgtgtccgccagaagcagtgcagaccagctgccgccctgcccgatgcttcccctggcaacctggagcagccaccagacaacatggagaccctctgtgcaccccaggtctgtcccctgcctcttaactccaccacggaagctgtgcacatgcttccgcacgcaggggcaccgcccttggatactgtgtatccagcacccgagaagaggccttcagccaggacccaggggcccgtgaagtgtgagagcccagcaacgactctgtgggcgcaaagtgagctgccagattttggaggcaacgtccttctggcccctgcagccccggcgctttatgtgtgtgcaaaacctcagccacctgttgttcagcctccagaagaggcgatgtccgggcagcagtcacggaacccaagctcggcggccccggtgcagagccgaggtggcattggtgcttctgagaaccttgagaatcctcccaaaatgggagaggaggaggcccttcagtcccaggcgagttctggttatgcaagtttattatcctcaccgcccactgagtctctgcagaatcctccagtcttgattgctcagcctgatcacagctataatctggctcagcccattaacttttctgtgtccttatcgaactctcatgagaagaatcagtcctggagagaggctttggtgggggatagacctgcagtcagcagttgggctctcggtggtgattctggggagaacacttctttgtctgggattccaaccagctctgtccttagcttgtctctgcctagcagtgttgcccaaagtaattttccacaaggttctggtgcttccgaaatggtttctaatcagcctgctaatttgctggttcaaccaccatcccagccagttccagagaacttggttccagaaagtcaaaaggatcgtaaggcaggaagtgctcttcccggatttgctaatagccctgctggaagcacaagtgtggtgttagt

SEQ ID NO: 5637 - DNA, 1220 bp, Homo sapiens
tggatggtggggccacctccacactcaagctttgcccgtccatctgtgccaggcccgggagccagggtgggccagggagcactgtgggggccttgcagagcagctgcttgggaccccaggatccacagcagggtcagggatggcagctggggaagatcaagacctaggggagagctgggcaaggtggctcctgcctgtaatgccaggccttaatgggagggtcacttgaagctgggagttcgaggctgcagtgagctgtgactggaccactgcactccagcctgggcaacacagcaagaccctgtctcaaaagaacaacaacaacgaaagagctgggggatgaaccagagctggccaggcggaaataggccctggcccaagcccagtcggggctctggggagcagaactgggtaagtccctagcttggtgtcactgtccccagctggggtcagccctaggcccgaggccagctgcagcctccctcctcctggctgtcctccgaggccccgcccatgctgggcctccctgcatggccctgccttgggcacgttcaccccagacggagccatccgaccttatcctgccagaacaacacccaccccccattgtttctctgctttcctgtttttcatcttgagcaagtctgccggaaacagattcagtgcccaggacaagtggtctgagggggcggagaccaacctgggcctggagggctccccacaccggagccacgccctctgctccaggacccccaggaccccactgctactggaggtctgggcccttccccagctgctgggggtcctccctctgtagccctgcctggggcggccatccgtgagtggatgccggggaagcaggagaccagggcccacccatcctgaaagaaccagaaaaaacgacctcagctgcctgggctgtgccttgtcctcgttgaggagctggtggccccattttagggaggagtcccctgctcacggcctaagccgggctgcagcccacgacctctgatgggggctctggcttgggcaggtgggggtgtggccaggcgctgccgggaggaggatgtgcccagggcagcctctccctggccgcaggtggacaggaggccacagggagtgcttggagccagcagtggggcctctctgaggggaagctggcccccaagcctgggcccttcacccttcagctgcaggtcagggatgtctgaacccctgtg

SEQ ID NO: 5638 - DNA, 1132 bp, Homo sapiens
atttgggaggctgaggcaggagaatcgcttgaacccgggaggcagaggttgcagtgagccgagatcgcaccactgcactccagcctggacaacagagtgggactctgtctcaaaaaaaaaaaaaaaaaaaaaagtacagtttcgggatttcataaattgggttccctgagggtcatttggtgaatccgggttaaagaaccctggtctgcatcactgtccttgtttgtttttcagatgcagaggccaggatgtgggcccagccctgtgccaggaggctggctggaataaaggtacagatagaggcctcaccccctctgggaccactggcactcagggtgtttgcagcctcagagcccacctgcccccagggccacagctgcatctcctgccctgctgtcattacagggatgggcaggctggcatgggggcagccgctgcccctgcctgggtgttgctgtgtattcctgccggccaggggccactgccaggaccacgcctcccttttcatatcccgattcttaagttctgctattgtggtattctggtggagaaaaaagaaccgcgtggctgtttttgaactgcctggaacctaagaccctgaattcttttcccccccaaggggaaaatctatatggaaaacatttattttaaaatacaggatgaagtgaattaaaagatttaaatgcacatttctttaaggataatatttctgtgttggcaaaatttgagagtaaattggtcttgaatggaatggattgtcttgactcacacattgcggagcagagcccgccctgaagaaaggtgttgctgtggtgggatcttcccacgagggtccttgcctgttctcctaggggatggttgctgggtgccctgggctactggggagagcgtacggggctggagaagatggccattcctgggctgtttcctagggaatgagttgtacatctcatggctggattttgtaaaatcagtttttaaaataccgcatatatctgttttcttactggaacacctttttcttggtctgttgtgcacagcccaggtttggggggtactggtcattgactgtttcagaagccgctgtgtttggggaactgccctggcggcttcagaggtgtgtgtgggttga

SEQ ID NO: 5639 - DNA, 1224 bp, Homo sapiens
ctgccccgtgaacgtttgaatgtttgatagtctcacactcctgttttgtggacaggcatctgttttccttcgctggtatctgggagagagggtgggccctgtgagtgggctttctaactctcgcgctgggctaggctggcctctaggggtctgaagggatagtgggaaggtggagggtgccttcaccaggagcagccttcatgagtgagttttaagaacctgtgaggatcggtcaggtcaggtgaggtacgcgctggatcatgccgtacaccgtgtcaggatcacgcaggacaggactggggaagggtttgctggcgtctcggttaatagcagtaacggcagccgcttgtgttcttgattctttgccaagcattcttgttatttaacacgggaaggaggtgacttcgcctgtgatggacttccagtgtgagcactggccagagtgaccaggctgaccagcaccagccctgatccaggtaagaggtgaggcggaggcttgccctccttccctgcctgccgggtgcgtgtgagcggctgccctgcggatgctgtcctggacctgttggcaccacagacagttgctctgctgtgcctgtggcctcggggcaaagagaaagtggcgatttctacactcagtgctcgggaaccagtgggcactgagaatggtttatggcctgacattacttgcaaccaaagccaggcagcatttggattttcgcttttggaaaccaccttacctggtttgctccatgagggaggggcagcaacatcgctgggaaccctgaggtgtagatatgtataaatgagctgtgtgtgtatctgaagctcgggcacttgtggggttaccaggagtgtgcgtctcactcccaggcctcgttctggaaacgattctgtaggtctgtctgggaggccttaggcaagtttgattaagaacagtcgagctggataaacaggctgttccttgtccagcactagtcatcccaggggggcgggggcggggctgcaactcctgtgcacaaaggaagggccctgggtaggggtcaggagctgccttgcccagagatgtgtctgggtcactttggaaacaggaatcctctccccaaaatgggtagcaatgggggtacagaggccaaagacgcagctgcatgtcctgcagtgcctgggacgccccgtagtgaagagtgatgtggcccaaatgtcagcagtgccagtgtcagactcctg

SEQ ID NO: 5640 - DNA, 1224 bp, Homo sapiens; identical to SEQ ID NO: 5639

SEQ ID NO: 5641 - DNA, 1224 bp, Homo sapiens; identical to SEQ ID NO: 5639

SEQ ID NO: 5642 - DNA, 1209 bp, Homo sapiens
ggctatccccgggtacaggttgatggggacctcggctctttgcaggcaccggcatggcctttggcttgcagatgttcattcagaggaagtttccataccctttgcagtggagcctcctagtggccgtgggtgggtactccagggcccctgcctgggctctttgaggggtgggtttctgctagggttggggctgtggttctgcgtccctgactctgacatggagccccaggtctcggcgggagccccacctgagcccacccaccacgtctgtcaggaagtagcctgtgcccggttctcttagcctgggaagcacagaggccccagccctcttccatttcctgctccacagttgcaggctctgtggtcagctacggggtgacgagagtggagtcggagaaatgcaacaacctctggctcttcctggagaccgggcagctccccaaagacaggagcacaggtgagagagcctgggggttagcgagaagtgaatgccacctctccagcacccagagttttgggcagccaagcctgggtgcaccatgcgataggctagacaaggtccctccctctggcccggcctcctcagcatgtgactgccagatgggttggagctgggggtgggcgcagtagacagatcttggagagctccctttgaggagaaagaaccaagaggggctggggtgcccctgagattgagaggaagggtgcagagtgaagggtgtggcaaggccacagcagccacgtgggcacccgagaggagtgaggctggactgagaagccccgcattggacccaggcctggcctccactgcccgttgtccttgttacggaacccagtttctgccatgataaaatgggcacagggatgcccagccacgatggatgtggttcgagcttgtctctctttgccttttacagatcagagaagctaggagagctccagcaggggcacagaggattgggggcaggaggagtctggaacacagccttcatgccccctgaccccaggccgaccctccccacaccctagggtaccccagtcgtatcctctgtccgcatgtgtggccaggcctgacaaacacctgcagatggctgctgccccaacctgggacctgcccaggaggttggagcagaaagggctctccctggggtggtgtttctcctctagggtattgggatgcatgttctgcactgccagcagagagggtgt

SEQ ID NO: 5643 - DNA, 1166 bp, Homo sapiens
ctcggccgggagaagcgcggagcctcctggctgcccccagccggtgcggccgccaccgtggccgtgagggcgcctgggtcccctctggaggttttgccgcagcgctggccggcgccgagatatgaccagaggcgttgaaagttggcgcgttgaggtacctaggatgggcgaggaaatgaacaagcttcaggggagaagaaatgactgtgggaacaggtgccttgaggtagagggaggggactgggccaggagagaggagccgggtggggcacagggacagcccagggtccctcagagcttcgaggccgggcgccctctgcgttgggagcttggggtccccctgacagaaaacctggggggggcgttgcgggagtgagaggaggctgcagacctgacacagatgggggagcgggcgggaggcccgagacctggggaagtgggaggagcctgcagacctgctccttggttgcctctgctccccaccaacccggctcccttccctggcttccctggctctcccctcctggaaacgtggaggacggccagggcttctctctcccccgtgcctgtggtgggttcaccaaggcctgtgtgagaagctctcggggtctgcccaggtccgagggcagctgtctcagtgctggctgctgcgtccgcacagcttctcggtcattctcgatcctgttcttccagcacctccgcaggctgggtgttcttagtccagtcgggtgccaggtccatccccatctccacccgttctgagccacctcccgcctttgctaagtccgtgctcccctcccagctgccctccctcccccatcacattttcaaaacaagctgggcagtggcctctccaacccagccccggagcaagcaggcccaggcccggggctacccggcacacacgcgttgtgcgtgagctgggatgcaggccccgcgttctgcagaattgtgcactgaagacgccagggctcgcagtggctcacgtctgtaatcccagcactttgggaggccaaggcgggcggatcacgaggtcaggagatcgagaccaccctggctaacacggtgaaaccccgtctctactaaaaatacaaaaaattagctggacatggtggcgggcgcctgtagtcccagctactcgggaggctgagacaggagaatggcgt

SEQ ID NO: 5644 - DNA, 1133 bp, Homo sapiens
ccaggagatgtctgcttaagacaaggctctccaaacagcccgcttcaccggcagccgcagaggcaccccagggtgtcctcggctgccccggtgggcagggagcctggaggaccagccacagggtcgacaccaaggggcacagaggacagtgcggaatgagggtggacacagatgaagccagaggtggttttgtagggatgcggacatggggtgctctgagggaaggcagggacaggcaggggcgttccagtgtggggtgcggtcaagtacctgccgtcagggagagggacgggcgggggctgcaggctgaggggtgcgaaggccctcgaggcacttccctctagctctgcatgcacgaggcatgcttctgctgggttggatgttggaaatgagaagcagccaccatcctcgggcctgggcgcacagcacctttccagggagggacagggcgtcgcagggctgaaactaagccaggtcctcacctgttctccgaggaccttcaattacattctccgggagcttccaaaagtgcccacccacgtgccagtgtgcgtgctgggaaactaccgggacatgggcgagcaccgagtcatcctgccggacgacgtgcgtgacttcatcgacaacctggacaggtgggtgcggtggccctgctcccgagggaccctgcccggtgctccggtgtgcgggggagggtgctgaggcagaggcccagggaggggttaacgttagcatggggcccggcggatgtgggtctcgccgctgagtggggctcactgaagcctgggtctccccgatggcagggccgggaactgtgtgctggggaactgtgtgccagggtgaagtgctggcactgtggggtcacctgcagaagggcactcggcttagctgcttagcagggctcagcagggtcctgtggcctcaggagcctgcaggaggagggagggcagtgcggacccacagctgtgggcccaggggtgatccttggcaccagggcaagggtctttctcttgcatcttttttcctttctgaaagcagacctccaggttcctcctacttccgctatgctgagtcttccatgaagaacagcttcggcctaaagtaccttcataagttcttcaatatcccatttt

SEQ ID NO: 5645 - DNA, 1169 bp, Homo sapiens
aagagcaaggacaaggaggagggcaaggaggagcggcgacggcggcagcagcggcccccgcgcagcagggagaggacggctgccgatgagctggaggctttcctggggggcggggccccgggcggccgccaccctgggggtggcgactacgaggagctctaggccggcgtgggcagtggccgccctggggcggggggcgtgcctgtcactgcctggggaggcatttgcctctgtaccatcgcctttgccgctgccccgtggctgccgtgtgcgcttctgagctggaagaggccgggcattggtggtccccaggctgggccctgcaggtgctgggccttcaggcccagtgtgagcctgctctgcaagaagggaggggacagctggcttcagccaggctcggtggacaccctggccctctcggggcagagccgccagtgtttctcagggatgtgactgaggcccaggagggacctgtgagggtctgtttacagaggctgggcaggggccgcttggctgtggggtgtgcgctgccccggcacctgcttgccctccgcgctcatctggggccgcagcatgcctatggttccgcttccggccgggagccctgaacacgggtgtgcagactcaccctaaagggcggcccaggccccacgctagaaggctggcgagaccgaaggcagcatgtgaggcctctcctgggagtgggggttgtgtttcccacagtggcctcagctgcgcccccgctcaggtgagcccgaaggcaggagccgggaggcactcctcccaaacactccactcagaccataaagcactcctgtttcactctgcgtgtgtctgttcttctgcctgtacctctgctcccgctgccccgggcccaggctgccgtgggttggcaggaggctgcccagcagtggtgtgaggacgtcccaccaagtctggccacaccctgggtacattccagcccacctgtgccagggctcagcagctgcacgcagcacgcttggcgacctcagccccaggaggtggaagtccactctgcaaggctcccaggcagccgcctgcagccctgccccccgccttcaggctcctgccccctccagctgtcagcagcgcccagcctccacccccacagctactgttgccatgagaaccctgcagggcaggcagga

SEQ ID NO: 5646 - DNA, 1099 bp, Homo sapiens
gggcggtggagagcggggaggggggaggccttcgggcggtgggagggggagagagggaggcctttgggcggtgggggccacggggagggtggtcttcggactacgtgcgggacaggaggtcagggctggcaagtccctcaggcctccctcgttgccccagcctcgcgggccgcctaactgccccgttccaagggtgccaccggaccccgctggagaggaacttctccgttggctggatttcatcaccacccattcccgattccacgtttcctttaagcggggctggcggagccgcaaggcggcaaggaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatggtgagggcgggacctgcgggcatgccaggggcacgcctggcgaggcgggggcggggctggcgggacggagacggggctgacgaggcaggggcggggctggcggggcgggggcggggctgcgggccgtagcggactgcgctctgctccgagtcctgcccctgctaggtttgacccaggctgaggtcctgggcgggaagggcgtgacacggcctgacaccctccccagcagtctcccagttcccgcgccctccccggttccaccctccttcgctcattcatccctgtcccagcctcaaggggcttcgtctctcctggggaaggggctgttcagagctgggatttcagaccccttcggctgggagttcctcccgcggcctccaagggcggccagggcacgtcctgaggccgccctcccatcccagcggacatctacgacaaagtgtcgggcgacatgcagaa

SEQ ID NO: 5647 - DNA, 1213 bp, Homo sapiens
aaattagctgggcatggtggtgcactcctgtaatcccagctacttgggaggctgaggcaggagaattgcttgaactgggagacggaggtgacagtgagctgagatcgtgccattgcactctaacctgggcaacaaggaaactgtcttccaaaaaaaaaaaaaaaaagatgctttttctataccaagtgatatgttcatgtggtttttctcctgtacagttaatatggtgacttatgttgatcttcaaatattggaccaaccttgcattcctggaataaaccctacctggttatggtgcactatcacttttatatattgctggatttgatttaaattttttttgaggattttgcatctctgttcatgaaggacatttgtctataattgtcttttgtattgtctttgtctggtttttggtatcagggtgctgtgggcagaaaatcgagaccaggagtgggtttgttgtcatcacaaatgctcgaaaaatgtggaagcagctttggaactgggtagtaggcagaggccagaagagtttggaggagcgagaagaagcttagatgccattcatggagtgtaaagggtgattttgttgagggctcagaagagaactgtagggaaagtctgaagcttctttgagaatacttaaagtggtcatggtcagaatgttggtagaaatctggacagtgaaggccattctggtaagatctcagacagaaatgaagaacaaggtgtcagaaactggaggaatgaccatcctagttataaagtggcagagaacgtggctgaacggtgtccatgcccagtccttcctttgtggaaggaactgggatatctggctgaagaaatactcagggtgtggcatgttttcttctaactgcagagagtaagatgtgagaagagaaatgaattaaagatggaatttataattaacaaggaaagaatagggatcgtaaggattttcagcctgcccatttagggagtaaataagatgtctttaggagaacagaccaagtgtgtggccaagcaacttagtatggacagaacgaagccagaggctgctcatcaggacagtgggaaaatggccccagaggcatttcagattcctggtgctgcccctcccaccacaggcccagagtgccaaggcctttgggaaggaaatatgtcaaaagagaggtgtagggtgtggaccttagagcctgctggccagggccac

SEQ ID NO: 5648 - DNA, 1140 bp, Homo sapiens
gtccaggcccagcctgcaggagggccggggcgggccagcacaagtgtcctcagccccagcagggggtggcacaggatgccccataagcctgacctcccctgtgcacaggcccagctgtccttcaacacggacacgctctgctgaccacccagagctgggccagggaggacacgctccactgaccacccagagctgggccagggactcaacaatggggacagaagtcccccagtgcctgccagggcctggagtggaggttcaggaccaaggggcttctggtcctccagcccctgtactcggccatgccctgtggtcactgcggttgccgcccctaattgtgccaaaggctgacccggcccgggctgcgtacacccttgccctgctttgccttaaagcctcggggtctgcccggcccctcgcccctgcctggcactgctcaccgcccaaggcgacgccggctggaccaggcactgctggcctttctcctgcccggcctcggaaccagcttttctctcttacgatgaaggctgatgccgagagcgggctgtgggcggagctgggtcagtcccgtatttattttgctttgagaagaggctcctctggccctgctctcctgcagggaggtggctgtcctgcgggaagccatcagcttgggccagctggcaggtggcaggaatggagaagctgaccctgctggccaggcaaggggccagaccccccccaacccccagctgccatcgctctcccacccagcttggccccctgcccgcccacctccctgggagccgggcctgtacatagcgcacagatgtttgttttaaataaataaacaaaatgtctgcgggtctgcgtgtgtgggttgggaagggtggggaggatgggcgcatcaggtgggttagcgctccagaaggccctgcccctcaggcacaggtgctggcagggggtggctgggtcggtctggaggagggaaactgaggcagggtggttcaccatggttcactgtccccctcatcccaccctcaggggttgctcccggcccccttccccttagccttcatcttcccgtccacctgccctctctaagcctccttcaccccttgctgcccacgtggggcctgcagcagcctgggctaggctgtc

SEQ ID NO: 5649 - DNA, 1107 bp, Homo sapiens
atggagatggcctacaacgagtacatcaacgagtactacgccaagattggtgagggggcccgtggggcggggaaggcggtgggggccccgcaaggcccagagcacaggccctgagctgtctccccgcaggccagtttgacaagatgaagtccccgttcgagtgggacattgtcacccgcggactggtggccatggcggttgagggcgtcgtgggcttcctcctgaccatcatgtgccagtacaacttcctgcggcggccacagtgagtggggggcggggtggggcgggggcggggcgggagcagggatgggttcgggggtggggcagggtaggggcgggggtgggggcagggatggggcaggagggggtgaggcaggggacagcagaggggcctgcccacccttcttacatgccacagccagaggatgcgaggctggtggcagggaggggcagtgggggtggcgagctgctggacactgtccaccctgtcccccaaggcgcatgcctgtgtctaccaagcctgtggaggatgatgtggacgtggccagtgagcggcagcgagtgctccggggagacgccgacaatgacatggtcaagattgagaacctgaccaaggtgggctctgggcatgtagggtggggcctgggtggggtaggccagggccaggggggtggggccccagcagtggaggtggagcctgggtgggcagggccctgagctctgggggtggggcctgcatggggtggggctgtggggcacgtggccccctgggctctggaggtggggcagggtctgggtggggtggggccagaggggcagggtgggggcaggatgccccgctgagtgggcaggctcctggccaggtctacaagtcccggaagattggccgtatcctggccgttgaccgcctgtgcctgggtgtgcgtcctggcgagtgcttcgggctcctgggcgtcaacggtgcgggcaagaccagcaccttcaagatgctgaccggcgacgagagcacgacggggggcgaggccttcgtcaatggacacaggtggggcgggagccctgggtgggcggggccgccgcgtcctcacgcgctgacagctgccgtgtccc

SEQ ID NO: 5650 - DNA, 1099 bp, Homo sapiens
ccctggaggaagtgttcctcaaggtgtcggaggaggatcagtcgctggagaacagtgaggccggtgaggggcctggaccacttgctcagcccaccccacccacaaggccccagctcgggcctgcgctgtcactcctgcctggtgtctgggggcgccaccctggtcctgggtggaagccaggggacgccccggggttagcctgcggtcctaggtgggtggtcctggtggccagaggtcccggacaggtgtatgagcctgggaactggggtcaagaccggggatgggggtcctgggcaggcctaggggccagtagccctgagtgtcccctcggcccttccactgcggcagatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaaggtgggggtggcagggtgaggctgggacagcaagggagggggagcagggttgcgggggagcggcatgagggcagccagtagggagagggtagcgtgcaaccacctgctcagcctctacctctctgcacagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtaggccaccggctggacaggggtgctgggcttgcctccccccaccgcccgctgggagccctgatgatgcccactcctgagcttcctgactctgggcctcaccccacacctgaggctgggcacgcaccggggttcatccgggagtcctgtctcctcgggtcccagaccccaggcgtgg

SEQ ID NO: 5651 - DNA, 1129 bp, Homo sapiens
tggatccagggtgaggagcaggcccggaagaccggctggaggattcatgggggaggacaggtgtgaggacgagagggcctgcccggcacctgatggctgcccccacccacagacatgatggagcgcgccatcatcgacacttttgtggggcacgatgtggtggagccaggcagctacgtgcagatgttcccctacccctgctacacacgcgatgagtgagtgctgggcgcccggggctggggctggggctggggctgagtggcgcctgagcgcggcctccccgcagcttcctgtttgtcattgagcacatgatgccgctgtgcatggtgatctcctgggtctactccgtggccatgaccatccagcacatcgtggcggagaaggagcaccggctcaaggaggtgcgcgggccgggactctccctggaggcgcgggctggcagggaggggcggcgtcctccccggggcctgccccaagcccctggcccacccgcaggtgatgaagaccatgggcctgaacaacgcggtgcactgggtggcctggttcatcaccggctttgtgcagctgtccatctccgtgacagcactcaccgccatcctgaagtacggccaggtgcttatgcacagccacgtggtcatcatctggctcttcctggcagtctacgcggtggccaccatcatgttctggtgagcgcgggccatggtaggagggacctggggcaggcacttgcccagcaagctcaccccacatcctctcagagccccctggaccctggcacgggcctgcccaggaggccgggcgtgcgggtggatgacggtgcgcgtggcccctgcccacccagcttcctggtgtctgtgctgtactccaaggccaagctggcctcggcctgcggtggcatcatctacttcctgagctacgtgccctacatgtacgtggcgatccgagaggaggtggcgcatgataagatcacggccttcgagaagtgcatcgcggtgagggtcgcgggcaggcgggcggctggggtgccgggccaccccacgtgctgacaccactgccttctcagtccctcatgtccacgacggcctttggtctgggctctaagtacttcgcgctgtatgaggtggccggc

SEQ ID NO: 5652 - DNA, 1149 bp, Homo sapiens
ggtggcaggcagtgaagtgggaggtggtagggagtgaaaggcccggccacctaaaggcacagctggtgcctgggtcaagctgaggcggcatctctctgcctggccttgccttctagggctggggtgcctcggcttctgggctgagtctgggctgaggctgggctggcctgggctggggctggagcggcctggctactctcccttcatactccttcaggctcttgcactcactctgctaaccagctggccagaggtcagaggtcactgcccagagggggtcctttgtcctcccctgggctctgtaggcagtgccacacctgaaacgttttcggggggagagtgccagggcatgtgggcctgcactggctgaaaggaaaggaatgctctgggagttatggcagaaggggtggtgagtggctctttgacctctgacctgctggagtcattcgccccagaacgcttggcctgtagcccagctggggccagggctctgtgccgccttctccctaacgctgcttctccttcctgactttctctaaatttctcctctcggcctctgtctccctccccttctggattcctctctctctctctcccctttcacccccgaccctgccctctcccgtgggtctgccagccttctacacagcggcgcccctgacgtctgccggcatcctgcctgtcatgcaatcgctgtgcccggacggccagcgagacgagttcggcttcctgcagtacgccaactccacgtgagtgcccacccgcccctcggagcacccacccctccccagcccatccagtgagtgacatccgccatggtgcagggtcacgcagctgcttgagcgcctggaccgcgtggtggaggaaggcaacctgtttgacccagcgcggcccagcctgggctcagagctcgaggccctacgccagcatctggaggccctcagtgcgggcccgggcacctcggggagccacctggacagatccacaggtgtgccctgtgcagggaagttggggggcagggctgcgggcaaagctctgctgtcactgggctgaagcccacatccactctgggcccctccacctgcactgagttcccagccacgcacaggctgcagtggcagagctgtggtgttgggctcggctccgagc

SEQ ID NO: 5653 - DNA, 2065 bp, Homo sapiens
gaggggggtgtgccagccaccgtccagctgctcttgttcctgcgacctcttttcaggaggaggaagtgggggatggaggctcctgggctggggaaaagggctaggaggggcctggaacccagaccctagagccagctttgtacctcaggcccctgcctttggcgtggtggacggtggggtatcagcacaggagcggggactgcctcactccccaggtgccaagttggcgggtgggcccaggtggacctgctggcacaggtttaatgtttaacgtgcccaagtcccggcccactgatactggaggctgctgccccaggttgtggagggtgtgcggtgcctggcgttggctcctgtgcccacctgccactgcggctgctggaactgccttgaaggaaggcggacagcctgagggccctgagtgtcaggttaccaaggaaaccaaaccagccaaccaaggtctggagaaggatgatgccccgtgtggcccccgtggccctgcctgcagtgtgcagtgtggggctgggcagagaggaagagtcctggttagccagaggtgccaccgcagactccccaggcagggttgatggccctgctggggttcccctggctccactggcttgctgtgactggggacattccttagctttgaggcaactcagctatatcccagaggggaaactgaggcagagggccattgccccctcgccccgttctccagcaccaggataagactgattagccacatgtgtcagctggcaccgtggcctgggcccctcatcagcgagatgaaagtgtggttaggaactagggaactagggcctggcctgccatccccagcactgccaacctcggcctcctgaggccctcgggtgccacctggcccctgactgcagcccctggtgtggtggctttgggagtgacctgcctgggttctgtgtctgaggccagtgaggtcagcagactccatcttaggtgtcctcggtgcctgggggacaagccagaggctggaggagcagcatcccttccaggctgcacacttgtcagtgccgggttctggggagagccgcacgggaaggagaggtcgctggcggcatcgtttgctgctccccagagacagacctgggcccttccctctgggactcccaatctggacggggttcctggcttgctgtggggcatgttgaggccggaggctgggcttgtggggctgcacggccctgcccaggagaactcagcactgcctggacggcgagactcagcttctgagctgagggctctatcaggcctggaagtggaccctggggaggggtggggcagggtagttctgataagtcctaggactgttcgcttccgggttctgagccctggcgtcagggaggaagggcatgtccagaacaatggccagaaccaggcccggccagctcggggggtgacgggggcgggtggctggggcagcgctgccgtgtgcaggggccgagccctgcggggccgtgagccggccctgccttctgcttccttcccagatgtagccgcctgtcccgggagcctggactgtgccctgaagaggcgggcaaggtgtcctcctggtgcacatgcctgtgggccctgccttcagcccttccaggaggaccagcaagggctctgtgtgcccaggatgcgccggcctccaggtacgagagcaaagggggaagtcgatggggggatgtccctgcatgaacctctccctgtaagaagcggccggctgggcgcggtggctcatgcctgtaatcccagcactgtgggaggcccaggctgttggatctcatgaggtcaggagttcaagaccagcctggccaacatggtgaaaccccgtctctactaaaaatacaaagtagccgggtgtggtggcacacacctgtagtcccagctactcaggaggctgaggcaggagaattgctttaacccgggaggcggagcttgcagtgagccgattcaccactgcactccagcctgggcgacagtgcgagactctgtctcaaaaaaaaaaaaaaaaaaaaagaaggccgggagcagtggctcacgcctg

SEQ ID NO: 5654 - DNA, 1152 bp, Homo sapiens
ttgccgggcgccgccgccctcgtcctgcccaggcccgcaggccctgcaggcctggtccgctggtggcgggggccccgcctcgcccacgatggaataaacaggcctggccggagggcgcagcgcggagcctccaaaaggccgcgccggatggggcttctgccggttcccagaggcgtaccttacattcatggcttcttccgccgggagcgcgtctggctcaggcctccgcgccgcggccatctggctctgggcgggcccgccgggagtctgcctgtgtgcgtctctgtgtctccgtgttcggggctcctgcgggtgtggggctggccctgagtgcccgccggcttcgctgccggtgcgcgtcccggggtcggggcctcagtgctgctctgcctgtcctcacgccttgggtggcgctgggcaccggccttgtgcgccatggtgggcgctgaagttctgggggcacttatggcgcaggctcggggtgctgttctagcttcaataggagggagactgttgcagcctcagagcctccgcctgcatcccctgccctcgagggcactggcattctgtctttgggactgagggctgcaggtggactccggaggagggtgataagcccagggtcctgggacaccctctcacctgcacagatgggtcctgagggtccagagagcagagctccctgcaggaacccaggatgcaaagctgacgtttttctggggggactgaactgggagactttgcgactgcattcgtacagtactcctggcagccctgcagaagaggtgctgtgagcccgttttacaggcaaggaatccgaggcatggagaagttaagtggattgtggcacagctgaggcgctgtcctgggcagcctggttctgtgtgtgtggcctcaaggggccagagtgaggccggcttcctcctgggctcagtgcccctggatgggaggtgggcatgaacaggagaggcttccgagaatcagagtgtgctcagccaggaaaggcggaggccacctattcaggaaacggggctgcagctgctgtgctgagcccgggtgggtggcaggtgccagtcctcagttcaccggcctctgcagcttcgtgtctgcctcaccgggagacctggcagggccctccctaggcaactcctc

SEQ ID NO: 5655 - DNA, 1176 bp, Homo sapiens
cagcccagggcccccgatgcggggtcagtgcgtggggggcgcagggcccccgatgccgatgcggggtcagtgtgtgtggggcgcagggcctccgatgcggggtcagtgcgtggggggcgcagggccccctcgtgtccagggcactttggtacactgtcccacaaggcacctgtctcagaggaggggccctggcaggcagcgtggcaactcccttccggagcccagctccatgctaacctgcccacagcaaccccacagagccacattccctgctgcacctggtctgcaggggtgtcccaggacaggcccaagtcagcccagcatgcagctgccctcctaccctgaagatgggagtgggctttccaggggacataaggatgtcaggcctggacctcctgggcaggaaagggtgcaggtcctgagggcctgtgccccacagccccagcaccaggtggactgcagcgcagtgggtgggccagtggcagccagggagaagccccccgtcagcaggctggggtctgcccaccagggcctccccacgtctgcctttgagggtgcctgccatgccctgggggatcctggcatctttactggactggaagcaggagacagaacagtgtctgtcccggggtgacttcatcaggagaccgcccacatagagctggaccccgcagctgaagcggaaatgtgagacaggctggcacctccggaaaaactgcctttcagccttggtgttccgtgcaaggtgaaaagaaataggtcctcccagtttacagcttgaaatcaggctagtgagtggccctggagaccacgaggggagaatttaaaggccccggctggcagggtctaggtggctggcagaggcacatgcagaccctgcctggagcctgccctaggacgctgggcgggtcagtctccgtgcaggatgtgagcagcgtccctgggctctatccgcgaggtgccagtagcgtgtgcaggtacatacacgtgcgtgcacactgtgatgacacccggaaatgtctcaggatgttgaaatgtgtccttgggggcagaagtgtccccagttgagaatctgccccagaggaacacacccacaccaggcctcaggattttgtgttgatcaagttccaaggaaaaggaacatctcagccgggcgtggtggttcacgcctggaat

SEQ ID NO: 5656 - DNA, 1915 bp, Homo sapiens
gtcatgaccagcgagttcactctggggcccacggccgagttcttcagggagcacaacttcttccacctggaccccgccaacgtggtcatgtttgagcagcgcctgctgcctgctgtgacctttgatggcaaggttatcctggagcggaaagacaaagttgccatggccccaggtgtggcccgttcctgagacggggagggaccgcccagactagaactgggagcgtagttgggggtccacgcgcccgggttcgcggctgccccgaggctgtgtggtcctgggttaggcgcctctttttctgggccttgatcgtcatttgtcacatggtacaccaactgggctgtctggttagtgaccagggctgccttaggcacaaggccggggcttcccccgcctccagcacgtcctagactcccagagcgatccctggcgggagccctcgcgatgcccattcccttctccgtctgcagacggcaacgggggcctctactgcgcgctggaggaccacaagatcctggaggacatggagcgccggggagtggagtttgtgcacgtgtactgtgtggacaacatcctggtgcggctggcggaccctgtcttcatcggcttctgtgtgttgcagggcgcagactgtggcgccaaggttagcgcccgactgcgcggcgccccgcacccgaggctggccccgcccctcacggagccccgcccctccgcccagccctcggaacccatccctggtcttggctgcaggtggtggaaaaggcataccccgaggagcccgtgggcgtggtgtgccaggtggacggtgtcccccaggtggtggagtacagcgagatcagtcctgagaccgcacagctacgtgcctccgacgggagcctgctgtacaatgcaggcaacatctgcaaccacttcttcacccgaggcttccttaaggcggtcaccaggtgtgcggcagcaggtggctgcggattgccggccagagccgcctgcgttgaccagggacccgcggggtcccagtgagctgagtgccctgggccacagcggctgtggtcaggagtggctgtggtcaggcacggctgatgggtcggggtggagaatggatcctgagcttgcaaaggcagaggtgctggagatcaggcacaagccgtgctcagcaggcagctgctgtaaggctctgtgatcaagtctgccatctcctccttctggggacctgccctggtgcccagggtgctacctctgctctggggcttgccagtttgtttgcctgggcagggatgtggctgatggtgcctggcacttggcacagggatgcagggaggaggcctgtgcctgcttctccctggagatctggccctactctgccgcttctgtgccctgtagtgtccttctgccatcctgtcccacccagctgggtgtgctcagaagtggggacagagcccccagcggtgccatatctgatctgtttctttcctcccctctgctctcccgtgccccagggagtttgagcctttgctgaagccacacgtggctgtgaagaaggtcccgtatgtggatgaggaggggaatctggtaaagccgctaaaaccgaacgggataaagatggagaagtttgtgtttgatgtgttccggtttgctaagttagtagtagaactcatttattttccccttcttccttctctcagttttggtggtgggaactgaggcgcagctggtagggaagtagaggcttgagggagccaagggccccgcgggcaagtctcagggagaagaccagagggtgctcttggccctgagggtaagcagcccctgaggtgggggcatagggagtccttggggctgtggacttgggaggacagtagtgccacctcccggaccttccactgcccccacccatggttaggagaggtctcctggc

SEQ ID NO: 5657 - DNA, 1207 bp, Homo sapiens
ccctccccgtgcccggtgtgtagcaggtcctcgggcggtgtgtgggggccgggttggagggcctggtccaggcagctccgctgttccatgccaagtgccctcgcgtggcctcccctcccagggtaccagggccgaggcagcgctgggctcccacgttggctgcccgtgcagctgcaggctgagggcagggcctgggatctggggctgaagagaccctctgattccaggaccacctggtgtgcttcctgccagggacgctggctctgggcgtctaccacggcctgcccgccagccacatggagctggcccaggagctcatggagacttgttaccagatgaaccggcagatggagacggggctgagtcccgagatcgtgcacttcaacctttacccccagccgggccgtcgggacgtggaggtcaaggtgggcctgggcctgggtcagggtccatcaggaggagggtgctggcagggctggccttgccctgagctctgctccgcccacagccagcagacaggcacaacctgctgcggccagagaccgtggagagcctgttctacctgtaccgcgtcacaggggaccgcaaataccaggactggggctgggagattctgcagagcttcagccgattcacacgggtgagcacctgtcctcgccccgcgtggtcacggccaccgggccacaggcacggctgggctgtggggctcaggctggctccgctcttggtggtggctgtgacctggatccgggaggggcgggcttgccgcagcctcggggtggccacactgcagcttgggggccctggcatccccatccccactgagcttcatggttgtgggacccagagtacttggaggggctgggcacccctcattttcatttctcagggcctgtctagggagggtctctgctgtgggcccagcatccccccagtttaggaggcacacgcacccatgactggggcaccatccccactgtggaccaggccctgttttaggtcacgccctccacgccagagtgtcacttcctggctctgctgtgatcttggcctgaggcccccgctgcctccgctcccaccgtctgccctgtgccctgtgccctgtgcggcaactgtgaggccccctgagcccaggttctgggggaggcggtttctgtcgtggtcacttgagggttgttggcatttccaggtgggctccggtggaacc

SEQ ID NO: 5658 - DNA, 1576 bp, Homo sapiens
tctcacgctagggttgctgctgccagtgataagtgtgggcactggcgcgtgtgagaggcacgaagactgcaggggggccgggacgtcgccttttgggccatcacccaccctgcaggttttgatgtgctccagcctccagacgcaggtggccttcgggctcccctcggtcccggccgacagggtgggtggccgtgaggctcctcccagcctctgagtcagcccggggctcaccatgcctccctgcagctcacactagcgttctcctgacagtggatcgagcgggtggtcggctggctcggcaaggtgttcctgcaggacggccccgccaggcccgcatctcccgaggccggcaacaccctgcgccgctggcgctgccacgtgcaaaggttcttctaccgcatctacgccagcctgcgcatcgaggagctcttcagcatcgtccgaggtggtcctgccccggccctggggtccgctctcccgtctggggagtcttcccagggccttccccgtgtctcctctgtgtctgcatctgggctccctgtgccttcaccgtgtctgctctgtgtctgcgtctggggctcccagggcctttgccgtgtctgctctgtgtctgcgtctgggctccctgtgtctgcgtcttgggctccctgtgccttcgccgtgtctgctctgtgtctgcgtctgggctccctgtgtctgcgtctgggctccctgtgccttcaccgtgtctgctctgtctgcgtctggggctcccagggccttcgccgtgtctgctctgtctgcgtctgggctccctgtgtctgcgtctggggctcccagggccttcgctgtgtctgctctgtgtctgcatctgggctccctgtgccttcgccgtgtctgctctgtgtctgcgtcttgggctccctgtgccttcaccgtgtctgctctgtgtctgcgtctgggctccctgtgtctgcgtctgggctccccgtgccttcaccgtgtctgctctttgtctgcatctggggctcccagggccttcgtcgtgtctgctctgtgtctgtgtctgggctccttgtgtctgcgtctgggctccctgtgccttcgccgtgtctgctctgtgtctgcatctggggctcccagggccttcgccatgtcggctctgtgtctgcatctgggctccctgtgtccacgtctggggctccctgtgccttcgctgtcgctcttgcaggggggtgcaccgggcagtgctgggactgtccccactgcggcgtcccccgtgcctggatcagggcaggtgtggcagatgctggacagtgcttctgggtgtccactgctgtgctgccttggccttggctcctgctggggactggcccctgggtgttgctctgtccaccctgtggcattgtggtcaaatgcatcagcacgccagagtgtcggggggatgtctggtgcctagcaggtggtctcatcatcgtcctggggctggcaagcacgtgtcctttcccacaccgcacacactctgcaccagcctgcacgtgcgcacgcatccatgtctgtccctgagggatgttcttcttcttgtagacttcccaga

SEQ ID NO: 5659 - DNA, 1199 bp, Homo sapiens
gactccgagattcgctcggcgcggcgcgcggcgatgacgcacgtctgcacgcgcagccatgacgcgcacaaggcgctcagcgatgacgcgctagttcggcgcgccgtgggggagtcgtgcgcaggcgcggacagcgctgcttccgcggcggttggggtggtggggccccgggcggcgttgaccatgacccagcagggcgcggcgctgcagaactacaacaacgagctggtcaagtgtgagcggcgcagccgggacggggaggtcgggagggccgcagggccgggttcccggctcgcagcggggtgcccctggacccgcctcgctgcgggcatcgcgcggctgagcagagccctccgtgccggaggccgggtgtccgtggcccgagccctcgctggctcgcaggccccgcgccgggcgctcgggggtggtgcctgactctggcttcctcgggtggaaggaggcccgccctccgccgccgcgctcctgccctgggcccacagcgccgcccctcccggcccccaggcatagaggagctgtgccagaagcgggaggagctgtgccggcagatccaggaggaggaggacgagaagcagcggctgcagaatgaggtgaggcagctgacagagaagctggcccgcgtcaacgagaacctggcacgcaagattgcctctcgcaacgagttcgaccggaccatcgcggagacggaggccgcctacctcaaggtggagctcgggaggccaggccgagcatcaggggataggcacggcaggggtgttgccacggcaaggcgtcaggaccggctggggctcccggctgtgggcagtctgtgcctcgctggcatttcgggcaggggcagcgtggccaggcccattgaggaacccaggctgctgtgggagtgactgtggggctgtctgtggggcctggggcatcctgggtcctggtctttatccggttctcgctagccatgtggttatttctgctcagtgtgaagagccaggtcttgggcagagcacccagcacgggccagtgctaacccagcctggctttgagggtggagaggaagtgttttgggtcagattccggagggaagagggccctgccaccccgtctgccagtccccttgggcttccgccttcccccacacaggatcccttggctacagcacccccagccaggtcccagcacctgagtgtgaggac

SEQ ID NO: 5660 - DNA, 1182 bp, Homo sapiens
ttctctgagagcgggtctttcccttatggcggatttagggaaggaggtttgggaaggggagttcagtttagcacctggaggaggttggaacctgaaagagaagacggtctggctgctcacataaatccctctgccctgtcagcctgagtaaaggagaagggggtcaagttttgggaaggacgcccggtccttacagccggaggtcttacgtgtgtgtgtctttttgttgaggtgaatctgattaacgagcccctggtgatatttgtttgtgcaactacaggccaaggagacccccctgacaacatgaaggtaaggctggcctgatgtggctcctcagatccctgccctcgaccctcaccccgttttcattgcctggcgtctaggtgcagtaaatagctctcctttatctcatgcaccttcagaggtggatttgagagaacgtccgtgagtggggctgggggctccggttgccctctctaataaactcgtcgtagccaccaaatagccttattatccgttttaacctttcttatttttccagggctatctatatgtgcatctagtctgggtcttgtgtgtatttctagactgtatgaccctcagggaacgttgctgaattctctgaccatcttttaagcacatattctattcttggcacagtctggtgctggggatccagctgtgaacccagcagccatatttccatcctggcagagttcacactgtagcagaagcagctaacgggcaatgacagtgccagcaaacacctgctgctggggaaagtagcatatgtcacaggagcactgataaggggcatcgagccttatctcacccaaccttggggcccaggcagaggtttctggaagaaaagagtgtaagctgagtcacggaaggatgcgtgagggctagtcaggcaccgaggaagaaggagcagtcagcgcagaggaaaaagatgatttggtttgtgtgaaaagtggaaagcagctcagggtggccaagctgaggagtacactggggcaagaggggaggagaagagaggcaggaagccaggcccagtccaaagagcctgagtaaccacagcaaggcagatgggcttgaaatgaagggttgtcggaactgtaggggtgacacagtcatgttcctaagctagcaaaaccgcactggtctgcaggacagcaggaa

SEQ ID NO: 5661 - DNA, 1175 bp, Homo sapiens
gtccttgggaattggcagtggcccccccggggaggggtttgttaagctgtcaggtttggcccctgacttaattcgtagcagggcaggctgccgtcttttggctttgaagggtccgtttgctctacctccagggtgaattctgtggtcagctcacaccatgtcactcggcttttttcgcatggcggtgaccagtagtgctgtctacctggctgacaaatgattagctgtgttctctcacaggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcaccacctgcctgcgcttcccaggccagctcaatgctgacctgcggaagctggctgtgaacatggtcccgtttccccggctgcacttcttcatgcccggctttgccccactgaccagccggggcagccagcagtaccgggcgctgaccgtgcccgagctcacccagcagatgtttgatgccaagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccacctcgggggctaaaaatgtccgccaccttcattggcaacagcacggccatccaggagctgttcaagcgcatctccgagcagttcacggccatgttccggcgcaaggccttcctgcactggtacacgggcgagggcatggac

SEQ ID NO: 5662 - DNA, 1199 bp, Homo sapiens
ggacaagggttcaggggccgggggtgggaactgggagccaggtttgagttggggctgctacctgggtggggctcccagccttctctttcggcagcccgaacccctggcccagccgcctaccacgtggaggactgcaactcacgcttcccttcggcgcctggcgtggtcatccagggtgtacgcagacccaagcgccacgacacaggccccttctgcacgctctagagccagctgggcacaacctgcttggcccggccaccgagtggaaccatggcctcccccggggctttcccaggcctcccctgggacttggggccccagcctggccttctgaccctctgggcaccccgatgcacccttctggctggccaacccttctatgggctgtggacaaggctggcccagcctggatcccccatctgcccatctccccgctacactgagatgctgttggttttcccgagctctgtggtgtgcagttgtctgtccttcacccgggggcggtcctagagatatggctgccgctgggtcatttccggctttccctgttgaggggtctccattcagctgcccctgaaaggtgctctcttctctagggtggcagcctgtgactgaccctgagctctagcctggagcgagatgggaggtgggctctgtgggacacccccacccagccgtgtcactcaggggcctggtctagctgctgtccacctgagggtcagctgcttgccgagccagggaactgggaaggaggcgtcaaatgccctgagccgccacctccaggtggggtcggcctggccagacctcaggaagggcccagggatctgctcaccagggcccagccccacttcccctaggccttgagctgaagacctggctgggcttagtcacctgtgccctgaacactctggcccagggccctgcagactccactcccggggccttcacctgctgggaccctgcactgcccctgcctgcaacttcgcctggctggggcctcccttgtcatcactggcctgccctcctacccagggtcgggccccaaggctgccaccttgcaggagccttacctgcggtgccgtcacccgcacctccccaggtcctccccagacccaggacccagaccaggcccagagctcaaccccttcaaaaaggctctgggcagctgcttctgtggcctcagcaccaccccctttctc

SEQ ID NO: 5663 - DNA, 1214 bp, Homo sapiens
agagacggggtttcactgtgttagccaggatggtctcgatcttctgaccttgtgatccacctgcttcggcctcccaaagtgctgagattacaggcgtgagccaccgcgcccggcctggtttttttttaaagatagaagaaatagatgtttctgggctgatgggaatgacccagtagggtgaggagtggaggatggtccaggggctgggctgtcactgaatgagcaggtggccggggtctcagcacagcaggggtgtcctcagaggagggctgatgggcgcagatgctggggtgacggctgaggagacactgggagtccactgctgctgcctcccattttctcaggtcttgggctaggaggcaggatagggggaagtggcaggggagaggacgagtagaggacttgactgtaggaggaatggtcagtgagtggacccgggtgcctggtttggtcactgggcagcgggcgcgtcctgtccagggcgcctgcagggggtgccaggcctacgggtggggagtgaaggacagagagtgaggagcccgtgggtgagggactggtgaggtggagggtgtgaattgcaaggactgggatgggaccgtgcgtggacggctgagcctcgggggcgcatggttactgtagcgaaagcctttaggggcagaaagagcagagctgcctgagcgactgggtgtggacgctgctgggaagttagggagaaggacttggtaggggaggaccgagggcccaggcacgggaggcatcgtctggtgaagtgaaacctatggggaatttgggaggagaagtggggaggctgcccacggtttggggaaaacaaccttgctggcaagggctgggggaagcagtgagggtgaagtcctttcagaggctgagaacatgtactgtgtttgtgggtgatggacatgaattctgggcgcagcggcagggctgggttgggtagggaggcgggaggggaggcctcctggaatgggaatgggtgtgattgggggtggccctgggtatcacaggagatggtgatggccctgggagctggggttctggggctcccttcacccctgtagatgggagaaagtgcagggggtgaggccttggcccaggcctcagattcacctttgacccatagggccaggtcttggggcaccccttgagcgagtccctttcctgcagagggctctggcctgaggatttgctgggccagc

SEQ ID NO: 5664 - DNA, 1143 bp, Homo sapiens
aggagttcaagaccagcctggccaacatggtgaaaacccgtctctactaaaaatacaaaaattagccaggcgtagcggtgagcgcctgtactcccagctactccggaggctgaggcacgagaatcacgaacctgagaggtggaggttgcagtgagccgagatcacagcactgcactccagcctgggtgacagtgagactccgtctctaaataaaatattaacttaaataacaaaataaaagtctcttttgtttattgtgaagtgcaacccatgtgtaggaaggaacgcagagcacatgatgcggctcggcacatgatcgtgaacacaccacagcacgccccgcccagcccaccctggccccatcgccagccatgcccagcatgcagcacccagaatgcggggccagtcacactgcctgccatggccacgtggtggggtacgtcctccccacctgggcatcgtcccggggctgatgcacttgctccgtcctcctacagtggacatttgagtgttctcagcctctgtatgcagcacactgtgcacgatggtgggacggttctgagcgcagacgggaacactggcctgtgccacccaggcccaggtggctgcagagacgccatggtggagcctgggcgccccacggtgttttatggttttttggtttttgtctgagacggagtctcgctctgttgcccaggctggagtgcagtggcccgatctcggctcactgcgacctccgcctcccgggttcatgctgttctcctgcctcagcctcccgagtagctgggactacaggcacccgccaccatgcccagctagcttttgtagttttagtagagatagtgtctcaccacgttggccaggctggtctcgaactcctgacctcaaatgatccacctgcctcggcctcccaaagtgctgagatgacagccggctgggttttgttttgcatgagctgcttttgttacatttctcccagggaatctgacattgctgatgctgttgtaagtgatttttgaaatggccatttctgtttattgctgattttctcattttggcttgtgctgagcattgatgccgaacccattggttaattctaacggcgtagttttgatccttcgtggctttctgtgtaatcaatca

SEQ ID NO: 5665 - DNA, 1536 bp, Homo sapiens
ggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccagcaccagggtggcccgtgtgcgtggggccagcgtcgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcggccgccgcgtgggtctgtcctctcagtgctttccaggggccttcctgtgcccagcttctgggcccactcctgtgaggtcactgctgcagggccttcctgcctggacagagttggagctaggccactagaccaccccacagggcatagccagggggaccagcacaggaggggacggagaggagctgcaggagggctggggggaggctgcagtctcggaggggggcctcgccgggtctggaggggacagcagagacagcccgttccccctgccgcctgagggcaccagggagagggctgtatgtccctcacgccacactgtgtgtgcagtcagcagtgtggccacagatgggggccactctctcaacct

SEQ ID NO: 5666 - DNA, 1131 bp, Homo sapiens
ttgggcagccctagtcccccacagaggccaggtgcccactgggtgttctctgccttcggcctgctatgaaaccggcagcggggggcccacacgcggcaggcaggctcactcagtgtctctcctagatcacctgctggctgatgcctactctggccacgacgggtcccccgagatgcagccggccccccagaacaagcgccgcctgtccctcgtctccaacggctgctacgagggcagcctctcagaggagcccagcattaggaagcccgcaggcgagggccctcagcctcgagtgtacaccatctctggggagcctgccctgctgcccagccctgaggcggaggccattgagctggcggtggtgaaggggcggcggcagcggcaccctcaccatcacagccagcccctgcgcgccagccctggtggcagccgggaggacgtcagcaggccctgccagagctgggcgggcagccgccagggctccaaggagtgccccggatgtgcccagctggctcctggccccacccctcgggcctttgggctggaccagccacctctgcctgagacctccggtcgccgcaagaagctggagaggatgtacagcgttgaccgtgtgtctggtgaggggtttgtgtcagggcatagacaggtttgggggtgcatgccgctgccagggtctgacagcagcagccactgtgaggcttggaacagagaacaggtgctcaggtcacagcatgccagcggactcaagattaaaaccggcaggcttctgctgcggcctccacaccctatgagctgtgagctccctcagctcctcagcaaaatctgccaggcctcacagtccgctttcgccctgctagcaccaggtcaatcaaggagtgcttcctggaggagggggcctgggaggatcttaagggatatgtagggaggaagcaccgcttaatcaggagactgggctgccctccgagagtcctggggagctgttggggcccagccaggcagtgggcatctttccccagggttgttgagttgtgtggtagcttgtccaccaggcagaaagtcactccactgtccccacacttgggcatcagggaaaggctgtgggggccctcggaaggggacagccctcag

SEQ ID NO: 5667 - DNA, 1216 bp, Homo sapiens
agtcccacagcagtgagcaggtttcggctgctgcacatcgcaccagcattgggctggattttcagctcagagctgtctcttgagcccagggggcattctagttcagttgtaagaggggcccttattttgtgtgcctctaagaaacaaatgttgctagttaaggcacgagacacattgatctgatctctagttgttgttttttctgagatggagtcttgctctgttgtccaggctggagtgcagtggcgcgatctcagctcactgcaagctccacctcccgagttcatgccattctcctgcctcagcctcccaagtagctgggactacaggcgcccgccaccacacccagctaagttttgtatttttagtagagatggagtttcaccggatctcctgacctcgtgatcccttggcctcccaaagtgctgggattacaggcgtgagccaccgcgcccagccgatctctagcttttaattagaattagacctccctgcttcccacacatggggctctgggtcctttcccacccggcactgccaagcagcaccccctcaggctgagcccctcatcttagcttctcccctgagcctctggtggctgtgatgccagggctgacactggcgcccctggttgagaagggccctgacagccgtgcccatgtggaagatgcatacgaacaggcatgtcaacactggggaccctggcctcttggcgtctggcacctcgatgatctgggttttggaaattacgttatctcccatcgcacagccttccctgccctgcacacgtggcaggacacagagattccactgctgctcgtgctggaggggaccgaggctcagagaggctacccgaggcctccttcagggcagatgggaggtagcatcaggccacaggcccttccccactggcaggtgaagaaggcttggcagttgtgctcaaggggagcagaccttggggttggggagtggactctcactgccttcctcctccttggtgcctggctgggcgtcggtgcctggctcggcgtcggtaccttgctgggtgtcggtgccttgttggcgttggaggtgggctgcccaggcaggctccgttactggtggtggtgttttcaggcccgaccctgctgctgactagtgacaacataaaacggcgccttggctccgctgccctggacaggtgcgtgccgccagccccgactccttcctcccagcc

SEQ ID NO: 5668 - DNA, 1129 bp, Homo sapiens
gtgttgctgagaattggaggttttttaacagctctttcccttgttccttctcaggcccgaatggaagtggatgcagatggaaatggtgctaagatatttgcctatgcctttgacaagaaccgaggaaggggctctgggagactccttcatgagctgctgtggtgggtgtttccaagctgtctctgccccccgccactgggctcctgggtgagctccgatggcacagggcgcctggagccccctgccccgctgaagccctgccttgccttccctgaatctcgcagttatttttgtgtccttcaccactaacccaaaggaacgaatgatttgtatgttgcacttcaaacaccaagtggactttctgctgggagcttgcccaggaccggcagcctctggagggacggtggttgctccccttgctgggttttgccgagcccccccggtgtgcatggtagggaccactcagatggggagctgtctcgaggccatctgcttaggtggttttgcgttccagctttggctgtctgtgctctgaagtccaggggccgggtcctccctgtgtccctgtcctgtttgggccacagatcaggtgcttgggtttctctcagcagcttccgcctgaggtaccctcatccaaaggaccaggggcccgatcagatcacatggctgacatttcttcctggaaggactttggtacctgaccagaaatgtctgtgagggtgggaggcagcgatgcagggttagatgcagggtttgctgtctgtttctagggagcggcaccgggggggcgtggccccgggcttccaggtggtgcacctcaacgctgtgaccgtggacaatcgcctggacaacctgcaactggtgccgtggggctggcggcccaaggctgaagagacctccagcaagcagaggtgggtcttctcagggcctggcgatgccagcagaggcgccttttgaggagggccaccgccaaagctcttgtttccaagagggtctcctgttcctcctctgagccctgatgcttctgtgtattttgggaatttcattgtttttccccaaagcgtggaatcctccttttcttcatgggagcgggaaggatcttgatggtgtgtgtttttgcattgctcct

SEQ ID NO: 5669 - DNA, 1135 bp, Homo sapiens
ccagctcgcagagctccacggacccggcgcgagtccccagccacactccgcactgcccctctaggcgcggcgccgctgcccgcacaaagcttcccgcgaaactgacgtcggcgcgcgcaggcaccgcccccggcctcgcccctcccccgcgctcgccccgctccccagagcgccggcgcactcgccctcctcctattggttgttgcggggcggcgcgcgccggtcggcgccgtgcgcgcctagccattggccgagcggcggcgggccggggggtgtgtccggggctgcgccccgcccctccgctccgctcgctgtggtgcgcgcggtggcggtggcggcggcggcggcggcgcgtggcaggtccggcgggcgcgaggcggcggcggaggcccgagcccggcccagcctcgtcccgcccggagcccgcctggctgctaccccgaccccggctccggtcccgtcctgtcccggcgcgccgcggcctcgccccggcccccgctcggcgcctcccgagggagcggcgctgccggccgagagcgcaggcccggccatgaccgacttcaaattgggtatcgtgcggctcggccgggtggccgggaaggtgagcggcgcggagcccgcgacccggcccgtctcgcccgtccaggcctccgcgcggggccgggggcggttgtgcgggcggcggccggggcgggggcgcggagcccgggatgggccccagcggggcgggggacgctgcgcgggcccggctgctggccccgcgcgggtgcagcttcctctcgcaggccggcgggcacgcacccctcggctctggggtgcacctggccaccctcggccctgccctgccggaggtggaggccacggccctgtcccgagccgggtgcggagatgcgtggctcgagcccgagccgcgttctcccggagccctcccagtggtgtcggcgatccggggcctagcgcggcgtccgggctgccagtgcggccacacggtttaaacacagcgccctttccgaggcagcgccacttccacacctctcgccgaggcgggtctggtgtgggctcttctgtgcctcccagttctcagcagggcttcaggctcgttttaacgctgccaggggttggccacgttaggctg

SEQ ID NO: 5670 - DNA, 1159 bp, Homo sapiens
ttttttttttttttagcttgcttgccttttgttttagcagctgcagtatctcggaagaaaaaacgaagaatgggaacctatagcctggttcctaagaaaaagaccaaagtattaaaacagaggacggtgattgagatgtttaagagcataactcattccactgtgggttccaaggtaagagacgcatttgagtgagttgccacgtgtgcgtggaaatgcgtttctgtgttcagggcctcgttatcagtaatttgggtgacctcagtccccgggaaggtgccagtgccatgaagctcctctgccataggggcagagtgttcgtgtccaagatcattgtgggggactccaccccgtcctccctgccctcctcaccacagcccacctgtctgccgggctcttctccaggtggcaggggcacctcttcgtgtgtccccgcctccccacaggcccttgcacctcccagtcacccaagactcctcagtgaaagcaagtttgttcatgatgcgcactgatcctgccttggggtatacacctgcccgtgttctagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaaggtatgtgttgctgtcttgggtgacagcacaaggaaagagcatcacaaagttggccgtggttctgaaaattaacagtctggtcacttctagaccctgataaaatcccctgtttacaattggcttagatttttgtattttatttttcttgatttattagattattttcattcaagaagtatttatgtttctgtacatcattcattgaagtaaacctcttttttttttctgtgttttctttctttcttttttttgagacagggtcttgttttcacccacgctgcagtgcagtggcacgatcatagctcactgcactcaacctcctgggctcaatgatcctcccatcccagccccccgagcagctgggaccacaggctcacgccaccatgcctggctaatttttaaatttttttgtggagacgggga

SEQ ID NO: 5671 - DNA, 1778 bp, Homo sapiens
gggtgaggaagctttggccttgccttaatttatctggcttgtgggaggtgccggtgggattcgacttggagccttggttctgttccctccccaggtttgactatggagagcgcttctgggacatcaaaggcaagctcttcagctgccgctgcggctcccccaagtgccggcactcgagcgcggccctggcccagcgtcaggccagcgcggcccaggaggcccaggaggacggcttgcccgacaccagctccgcggctgccgccgaccccctatgagacgccgccggccagcggggcgctcgggagccagggaccgccgcgtcgccgattagaggacgaggaggagagattccgcacgcaaccgaaagggtccttcggggctgcgccgccggcttcctggaggggtcggaggtgaggctgcagcccctgcgggcgggtgtggatgcctcccagccaccttcccagacctgcggcctcaccgcgggcccagtgcccaggctggagcgcacactttggtccgcgcgccagagacgctgggagtccgcactggcatcaccttctgagtttctgatgctgatttgtcgttgcgaagtttctcgtttcttcctctgacctccgaggtccccgctgcaccacggggttgctctgttctcctgtccggcccagactcttctgtgtggcgccgccgaagccaccgttagcgcgagctgctccgttcgccctgcccacggcctgcgtggctggggccgagtcccaggggccgcacggagggcacagtctcctgtcaggctcggagaggtcaggagaccgaccccaccactaactttggagaaaatgtgggtttgctttttaaaggaatcctatatctagtcctatatatcaaacctctaactgacgtttcttttcgaggaagtggcttggtgggtgcagcccccgccggttccgttgacgctggcaccttctgttgattttttaagccacatgctatgatgaataaactgatttattttctaccattactgaacattaggacaaacacaaaataaaaaacaaaacacagacaacggtgctgattctggtgtggtttctactcaccacgtgaaataaactatcaactgtataaagagaacaaagtgattttagaataaaatgcaggaaaaacttttttaaagatgttagtcttgtagcgtgaataaatttgccatcaccttttgtgtggtggcctggcaggtcatatacttttttttggcatatacctttttaaagactgtaattagtgcagtaacagtggggttttttttgtgcaactcttctaaaaacattcataatgcagtcatgtttatttttttctgttaaaatgtttttgacagttttaagagcagtcttttggctctgaccatttcttgttctgtttccaatgaaatcaataaaaaaaaagaagtactttaaatggggtttttattatgacaccatatttcagggtctctgcagaacttgcaggtccccctggacccggcccagctctctgtcccctgtccaaggaagtacagcttccttttcaccccagatctgtccccgaagaggggacgttccaggcagaggttaggggagcctgtgcatttgcgcacgtgtcgaatgagtctgtgtgtgtccacgaatgcatcgtgcacgtggtgcgaatgcgggcacactggtgtgtgtgtgtgtgtgtgtgtgtttgcatgtctgtgtctagcgccaggtgcccagctctgggcgtcattctggaagccgacaggg

SEQ ID NO: 5672 - DNA, 1113 bp, Homo sapiens
ggttttagagttagggttagggttagggttagggttagggctagggttggggtcagtggttaggggtcatggttaagggttaagggttggggttgggggttagggttaggggttagggtaagggttaaggctaaggctaggactagggttagggtttgggttagggtttggggttagggctagggctagggctttgaataaacttatatggtagccaagttgtggttacagtgggccttgggtgagaccaagttctatgcctacttcaagtgtgtaccagcatagtctcagtggtcgtggcctcaggggtgcttatgttaccccaactccagctccacatgcctcagcagagaaagagagactgctggtttcagagaaagaaagggaagagaacaagatctctacttgaaaaatcaagagaagttttcttgatgttaatccaaggccaccaaagcagtacctctacgtgtttgctactacgtattgggcttgggacctaagtctctttgaacacctggaaagtgttcccaaaaataatgggcaccaacaagcccagactgtgaagactacaataaagactgacctcttcaatgcccacatatagatgaacatctataagtatcaaggccatccaggaaaacatgacctcaccaagcaagctaaataaggcaccaggggcaaatcctggaaaaatagagatatgtgacctttcatacaggaaatccaaaatagctggttgaggtaattcaaagaaattcaatgtaacacagagaaggaattcaaaattctatcagataaatttaacgataagatttaaataaaaagaataaagcagaaattctgaagttaaaatgcaattatcatactgaagaatgcatcagagttacttaaaaaaattgatcaaggagaagatagatttagtgaacttgaagtcagactatttaaaagacaaagtcagaggagacaaaaaagaataaaaaataaagcatgcctacagaatctaaaaaatagcctcaaaataggaatctaagagttattggccttaaagaggtggtagaaaaagagataagagttaaacatttattggcccggtgcagtggctcacgcctgtaa

SEQ ID NO: 5673 - DNA, 1215 bp, Homo sapiens
agcagcaagcttaataggatgttacccgacactttgcgagactggcagctgatttgatccagatgtctctaattcttttttctttttctttttctgttttttttttttgacagagccttgctccgtcccccatgctggagtgcagtggcacgatctcggctcactgcaacctccacctcccgggttcaagcgattctcctgcctcaggctcccgagtagctgggattacaggcgcgcgccaccatgcccagctaattttttgtatttttggtagagacagcatttcaccatgttggccaggctggtctcgaactcctgaccttaggtgatgtgcctgcctcggcttcccaaagtgttaggattacaggcgtcagccactgtgcctggcccagatgtctctaattctaacatgagatgtattgcaggatcatagcagagtgagttgctgatgtatccagaaggaaacgagcatggaacactcacgacagctgtcctgagaagtgtgtgtgtgctgtgcttgaatatctcactgctcatttatacacaggctttctggtgactgagttaacagtatctgtttcataaataatgtagccctctttctttctttctctctctctctttttttttttttttttgagacagggtcttgctctgctacccaggctggagtgcaatggtgcagtctcagctcactgcaacttcaccatgcctggctaattttttctttttttttttttttgagacggagtttcgctgtttttgcccaggctggagtgcaatggcacaatctcggctcaccacaatctttgccttttgggttcaagggattctcctgcctcagcctcccgagtagctgggattacaggcatgtgccaccacacccggctaatgttgtagttttagtagagacggggtttccctatgttggttaggctggtctcaaactcctgacctcaggtgatctacccgcctcggcctctcaaagtgctgggatcacaggcgtgagccatcactcctggcctaatttttgtatttttagtagagagagggtttcactctgttggccaggctggtctcgaattcctgacctcaagttatctgcctgccttggcctcccaaactgttggaattacaggcgtgaaccaccatgcctggccagctctatttctttaagcctacatgttttgcacttgttaaaagtatttgaacata

SEQ ID NO: 5674 - DNA, 1233 bp, Homo sapiens
ataccccaccagaatgtcacaatcattcattgctccagctactgagtgaacagggtgcaagacagcactggcttgggttgtatttttgcagccagttaactttgcatcaggtctacacagtccttgcagcctttgatttctccagttgtagagatttgaaatggggtgcccgggttcctctcgtttttccttcaatctacctagcatgcattttacacacattggaggagtcgtatgcactgtttttctgttgctgatggaggcaagcaggccttctaattagtctaacttaaacggatgggattcacttaacaaaagcaagaagaaaagcacacgaacaggtgtcttaatgcatttggatagtttctttgcggggtgtgtgtgtgtgtgtgtgtgtgtgtgtgtgtgtgtgtgtgtgtgtgtcttggtgaaggtgaggggctgtattttcaccaagccttttcataatcaagtttgctttgcaaaccttatggccttgcaccccgcagaacagtcccttcctaatagcagggatgctctgtcatggttttctgtaaattatcgtgtgttgggaagttctgttgaggcttagtttgatcttccatggtggacacgtctgttctgtatgtaaaaggcattacaattgtgttttagcagatgagacttgaagcctttccacagtccttgtgctctgagatggctgttgagctctgctcaactgtcgtagctgaattctttctttgcgctgaacactgggcagcctcaccatgttgccaacgtgcttctggggcccctgtcactgccgccggatgccgcgcacacaggcagagtgccttggcaggtttgtgcaccccttggcgagccagaactgggaaccccgcggggtgaccccttctcatggggggtcggggaggggagtgcctatttttaatcctgtctgtttgttgcacaatggaaatcactgtgatttgtacatatgccctaggaaaattttactgctgtctaatttatgtaataatactgttgattccaggtttgtttaataaaactttgtatcttttcagaagtctgagtttcatctgcttctgtctccaaacaagctgtggcttttctcctttggtctaatcgagggatgggcaattatctgtaggggccacatggcagatattttctgcattgtgggacacacagtctctgttgcacagagtgcaaaaaagctgctataattaggca

SEQ ID NO: 5675 - DNA, 1163 bp, Homo sapiens
ttcatcttctagagatctttcatcttccagagataaccacgaataatacttttgtataactctctttagtcttggttaagtaaactttagtgcatggttaagactgtgttggtggtagattcctgtctagtctctgattcacttaacacacgtcataaccacttttcatcactattaaaatccttcatgggcatcatctggatgcagcgattttgcatgccctggagaacataggtcagctattttgcctcaagatgggactaaatttgaagtgcaagttgaaatacagctccaggtgggaccatatccagtctagctctctgctctcctgtccctagcctgctgtcctgcccttctcctgagaggtctccttcagaaactcatgtccattgatgatttactgggtaaagaaaatgtggtgcatatacataatagaaaactacacagccgctctgtctttctgtgccaaggcggcgcgtggtccacgccgagcgacagagattctcaggctatgctctcaggatgaccgagtgggagacagcagcaccagcggtggcacagacccttgacatcaagctttttgggaagtggagcactgatgatgtgcagatcaatgacatttccctgcaggattacattgcagtgacggagaagtatgccaagtacctgcctcacagttcagggtggtatgcccccaaacgcttccacaaagctcagtgcccaattgtggagcccctcactaactccatgatgatgcatggccgcaacaactgcaagaagttcatgactgtgcgcatcgtcaagtatgccttcgagatcatacacctgctcacaggcaagaaccctctgcaagtcctggtgcatcatcaacagtggtccctgggagggctccacacgcattgggcgagccaggactgtgagacgacaggctgtggacgtgtccccactgcgccatgtgaatcaggccatctggctgctgtgcacaggcacttgtgaggctcccttccggaacatcaagaccattgctgagtgtctggcagataagctcatcaatgccacctagggctcctctaactcctatgccatcaagaagaaggaagagctgcagcatgtggccaagcccaaccactgattttcccggctgctgaccaataaacctgtct

SEQ ID NO: 5676 - DNA, 1159 bp, Homo sapiens
tgagtctgggattttggagtggcttagttgggaggttcaggctcaaagtccctcatgagcttgaagtcaggttgtccatcagggctttagtctcgaaaggttctatgtgactggaggatctgctggcaagatggctcagccacatggctactggcctgccttctcagttactcatcacatgggtctctccacagggctgcttgagtatccttacaacatggtgctggctttctcccaagtgagttagccaaacgaatgcaagaaggaaactcaaatgtctcttatggcctacgcttcaaagtcatatgccatcattacctcagtatcctattgcttatacaagtcagcccagtctttaggggccatcttggaggctagataccatactgatattatagccaagggggaaaggatttcagctcacttttaggctattgcagtgactttgaaaataagtacacaaagcaattgtatattttgaaagacaataaagcctatgccattcagagtcttcacacataaagcatatcggccaaagaactttggagaatgtcaccaataaaaaaccacatgcagcattaacttgactttggactttgctagctcggatgcttatatacatatcatttctaacttagaactggcttttcaaagtatgacagtcaaacttggtgttatccaactaggatttgaaaagtaagttattgtgtaacttttaaaatctttacattacatgtcatcaagaaaattcaaaatggattaagccagtgttttctaatagaactacatccagggccacagatacaagctgatcatgtaatttcatgttttcttggagaaatgggtgaaagtaattttaatagcataattattgacccagtgctatggcttgaatgtgtccccttggaaattcaagtgttgaaactaaatgaccaatgtgatagtgctaggaggtagagttatataaaaagcttcacccagcactcagctaacttgctcttccaccttctgccctgtgaagatacagtgttcctcccctcctggggttgcagcaaaagatgtcaacttggaagcagagagtagccctcaccagataagcaaacctgtgatgccttgatcttgaacttcccagccaccagaactgtaaaaaaattcattt

SEQ ID NO: 5677 - DNA, 1222 bp, Homo sapiens
tagtgttgttgtgaacatttaagcacacgtttttgtgtggatgtatgcaaagtcattttttttgaaagccacttactacacgattggctaacttccatcagagaaatgttgtttggtggagttaaaaacagattatctgtgtactatattaagttgggtgaggaatgatgaagtgtaaattatacttacataaatattataatgctgtgcagaaactcttaagctatcattcttttagaaaatgaattttatgagcttgggacctttttgttaaccaatctgagaaaagtctgttgtcagtgtggacatattttacctttaaatggaggaggggagagaatctttcaaaaacattaatatcagtgagattaatactaatctgtcaagatgacccagtgaacagttggctatcaaagtattataagaaggtttttaaaaggaaagtgtctattttgtaaagatcttgagtaaattatgcttttaagtatgttttgatattcccccccctcctcccaaagtgtagcatgcctgagcgctgtcatgtttaggaggtgatgggttggggttagagggtgattgactgttagcgaagtgggttgggatgaacaagtgcacttgagtacgcgctgcacagtgtaggcatcaggccacgtcagtgtgtctctgcatttgggcagatgccaggcctattgcaggcagcataacatctaggaacgggtttatggatgaacctgggtaactctgggagcacaaacccagaccacacccatcgggagagattgacctgagtgatgcgctaacgcatatcattgagatggggccagatatcttgcttagatgaataattggagttcatgtcaaccatctgtcctttcccataatttaaagccaacttctatattttccaggttcatactttttttttcattaattgcatgtaaagttgcggtgaacaccttctttcttgacttcctgtttaaaaaaattacagttcttaaaattataagcttattcaggatggagtggtcagtttgtagaaaaactagctctttagatcttttaaaagcactacattaaaaaaaaaaaaaaaaaaaaacatcggacgtggtgggtcacacctgtaatcccagcactttgggagtccaaggtgggaggatcgcttgagcccaggagtttgagaccagcctgggcaacatggtgaggccccatttctacataaaat

SEQ ID NO: 5678 - DNA, 1238 bp, Homo sapiens
agatctgtaaatgcgtgtatggcagtgtgtatatttagcagttgcatacacagatgtacttatttataggtatacatttgtggacaagagttggttatcactaaaatatcaagtccatgattttggatcttgtacactctcacagaacaccgagggacacggtggaggcacgccggacccgggctgagcttggtaaccatctggaggggactgcagaggttgacacccaggactagagctcagtagaggggccgtttcctacctgcagttcccttggaagagaaggggtgaagcttaccatgttggtggtggtttgtttcctggggctgctgtagcaacgtgccaccaactggctggcttaaaacatgtatggtctcccagttctggaggccagaagtgcagaatcaaggggtccgcagggcccagctacctctgaggcctccaggggaggatgcttcctgcatccccttgctgcttttggtgttgctggcggtccttggcttgtgggcacagcactttcctctctgcctcggtgactacatggcctccctgggtgtctctgtcttcttgcaaggacaccagtcatgttagattatggctccaccctgctgcgatttgacctcattttactttaactaactatctgcaatgaccctttttccaaatgaggttctgaggtgctgcacgttaggactttagcatgtgatttctgcggactcaggtcaccccataacagtagtcatgccccaccccatcccactccacccttctcccaattcccctggtatactccagggtggctctgtggccacacatgacccaggcccactggccattagacactttggcagggtggccaaagaaattctttgtgctgaataaaattaatgtgtaaatgcggcggtgctccaagggcagtgttgcgtgaaagggcaatagaaccatggctcctgataaacagaagcctgttaagcagcaaggtcaaaagccagatgcagaagtcagaattagccgggtagactttttatttcactttcccccccttttttttttgccagtggactgccaactgttctcttaacagaagggcagtttttgagtaaatgaagcaggacttgatctgggttgtcataaattgtctctccctcaagaggtaacttctcgtgtttgccagttcagaggtgtagggagacatctctgatgtgtagatgtcctagtttggggtgcagggtggcttt

SEQ ID NO: 5679 - DNA, 1141 bp, Homo sapiens
ccctgcgcttaactgttgattgaccatagacgtgtaaatgcagacgttgcctgccaacgatccgggcatcaggctgagaatgtgcgctagggttgcaaggcatctgtttggtaaaagccatgtaacagggaggacacagtcttttcagcctgtgcccagtttctccgtgtctctactaaaatccagatgtgctgagctgcaacctcagcctcagcaacatcaccgtgggaaattactgtttggcattttggtatttccacagagggtcagctgcgtccaccgccttgccctttgccattgctgttgctaaagcacaccatgccttgtccttcttctcattcttgcagttcttcctcccacgacctgtccagttcctgggagcagacgaacctacagcgcaccttagatcacttcagctccttggggagcgttgacagcctggaccacccctccagtcgcctctcggtggccaagtccaacagcagcatcgaccacctgggcagccacagcaagcgcgactcggcctacggctccttctccaccagctctagcactcctgaccacaccttgtccaaagccgacacgtcctccgcagagaacatcctctacactgtgggcctctgggaggctcccaggcagggtggccggcaggcccaggccgcaggcgaccctcagggctcggaggagaagctcagttgtttcccgcccagggtccccggtgacagcggcaaaggccccaggccagagtacaatgccgagcccaagctggctgcccctgggaggtccaattttgggccagtctggtatgttcccgataagaagaaagcaccatcatccccacctcctccccctccccctctccgcagtgacagctttgctgccaccaagagccacgagaaggcccagggccctgtgttctcagaggcggctgcggcacagcactttacggccctggcccaggctcagcctcgtggtgaccggagaccagagctcaccgatcggccttggaggtcagcacacccggggagcctcgggaagggatcgggaggcccgggctgcccacaggaggcccacgcagacggcagctggccgccctccaaggatggagcttccagtaggctgcaggcctctctgtccagct

SEQ ID NO: 5680 - DNA, 1142 bp, Homo sapiens
cctttgtaaaacatccatgatctttgattctctgaaacctactctgttacacttagtggctccagaatccaaagggaacatagtcaccacctgtgttctcaacattgaactgctcctgaactccgtttttcttactcatcacacattctctcaactcttcaagacacatgataactcaccgttcggtgccactcaaaaagcaggatcataagggccagtaccagtgggataatgaattggctcaagggacagtagccatccctccatttctgttttctttgcctttgaaatattttcagtaatacctgaccacacatcattgcctcatctctttcttggagagctcaagctatacccttcgcctcaggagtgtcagcacagtttcagtacaatatatatggcacatgccacactactgagagcaccaagagagaaaagcaaacctctctagggctgagggagtcacctcaactgaatgatgattacctacctgtggactataagctccagaggtggcttctgattccagtttacttagctaatcagaacatggtgcactttctctctctctctctctctctctctctctctctctctctcattaattttcatgtctaatccataccagaaaaaaaatcaggcctgtccttaaattacttttgtactaatattacgactgttactactgttaccataactatgagactgttgctgctgatactatcaacttagtgctgatacttctgctactgctactactgtggctagggatactatgactatcatagccacagttgtcattctggtagcttttactctatggcatgaaatcagcaagacactttccatacattattttatttaatctttatatcagctcttttggataatattagttatccctacttgagagaggagaaaatcgaatcttagggaggttaagtaaatttcccagtgtgacagagattgtaggtagtatagctgtggtatttgaacctagatcagtttggcctcaaagtccacacttttaactgttacagggccccaagctggaaaattcctcatgagctgatagcatctccttccaaagtactggcaaatgttgctaatagatttcacctctcttcctgcctaagcccaga

SEQ ID NO: 5681 - DNA, 1213 bp, Homo sapiens
atgatcgccattctaactggcatgagatggtatctcattgtggttttgatttgcatttctctaatgaccagtgatgatgggcattttttcatatgtctgttggttgcataaatctcttcttttgagaagtgtctgttctgtcctttgcccattttttgatggggttgtttgttttcttgtaaatttgttcatatattcttaactttgcaaagtctgcttgagaatttttggaaagggagacatactctagagaaattccagtcctttatagtacatgtaatattattatgagattcttctgtacattaaaactcaaatacttttctgtgtaactttcacccatggattctgcttcaagtctgatctactaggttggtacaaaagtaattgcgatatttgccattactgttaatgacaaaagccagaattacttttgcaccaacctaatatcttcaacatggcctcacatgggagaacatggctgatcattaatttatccattcgatgagaatttattggtcatctagtctaagccacatactgttctaggtgttgaagttaacagaatgaacaagacaaagttgttgcctgcatagaacatatatcccatcaaatatcttctcatagatcttccctcattcactctaaacatgctcagtaccttcttttttctcattgaaagtttttaaaaattaaaaactatatatatgttatctagaacacagtgggctacaaacactcctatgcaaatgtatttataattatcatacttacaaaagcaaaaaagaaaactctaaatatctaagatggtgtaaaagtttgacctcaattttctgtgtgtgcatgtgcatgggcttgcccataaatgcacatggaaaaaagactgaaagaaaatacaccaaagtcttaacaacagttatttaatggttggttaacattaatcatgttttctgtgttttctgtcttttctataacaaacatcttacttttaaagtgtaatgtgcatgtgtactctgtacggggcattgtaggaggccctgaagtaaatgtacaatcaccacagtggagcatctggtcagggattgcagtgtttataaattaaaatgagtatttacatgcatgtgcatgtataagtaactgtatgaccaattcttcattttccatgactcactttttatcccatgtgtttcacaccatcatccacataagttac

SEQ ID NO: 5682 - DNA, 1182 bp, Homo sapiens
ttgggtaatttgtctgatcataaatacatatacactaagacttaatgggaatgaaggtcatccttaaattagctgtgcgagagaaggaatcttcactagagtttgactcatgataaatgttagaatttccaaaggttagtcatgaaaagtgttagaacttataaatagattacaataaaattttgatatagaaatcaagaatgtgacagtccctggacaaacctgaataaaatattaaatctaagtaccttgctatttataaagtttttataactcttatatttcctcatcccctaatatctttattttattttagtttttactattttcattactcatttataagattgagttttacaaatgacaactacatgaaacaaaaggacttaatttatttatttcacattcgattttttcttgtctactcctcctataatgctccctttcttttaggttgctgctaaatgggaaaaacttagcttagtactgatagatgactttattggaagtggaactgaacaagtactcctactttttaaggactccttgaactcagactgcctgacttcatttaaaataacggatcttggaaaaataaactattcggtaagttctatttacttattatatggtattttaagaaccattttagaaaatttaagtgctcaaaagctttgacctatcatttaaatattggtggttttatacttaaaattttgaactttaaaaatatatagattgaatcttttaaatatatacattgaatctcctttcaacaaatgttatacaaattgaccatgcttttgatataaatttgaattgtagtacatttggtggtcacttaagtgacagcagtactataaattaactttatttttgcttctgaaaatcacattttataccaataaatataatattggattaaataaggaataaaatgaagcaaaattgctttagtaaaggaagtaacagctcacaatatcttgagatattggacataagggaaattatgcccctgaagtttcagatcaatacaaaatctctctaagcctcagttttttcatttgtaaaattagcataattttaattttctccagttatgggattttaggattttttaaaaagctaatgagagcccaggaattcaaggctgcagtgagctatgattattatgttgcactt

SEQ ID NO: 5683 - DNA, 1187 bp, Homo sapiens
aatctgaggagactgcataaaatggaaatttaggagggctattaaaatattaactgattacaggaagtgcttaaaagacattgataaatttagtttgactacaaacaggtggagttttgaacattagaaaatgctccacagccgggcatggtggttcacgcctgtaatcccagcactttgggaggctgaggcaggcagatcacttgaggctgggagtttgagaccagcctggccaacatggtgaaacccctgtctccagtaaaaatacaaaaattagccgggtgtggtgatgcacgcctgtaattccagctacacgggaggccgaggcaggagaatcacttgaacccggagagcagagtttcagtgatctgagactgtgccactgcattccagcctaggcaacagagcgggactcttgtctaaaaaaaagaaaaaaaaaaaaaaaagaaaatgctggatgtttaactagttgtcaaagtaagtcagtcattttaaaggtaaaggtaagtattgtgaggctatgtaattgtcctctaatgacaccctgaagaaaaagagttaacagagctaaaataagactagtagaattctcattttcttattcaaagaaagtattcatttgagactcatctgaaagtactcactttatgcttttcaaggatcttcttaatttttaatatatttgctttttccaacaatgaagagccttctaaactgactattgaatagtaattttaaaaagtgtgcaatagagggagagacctttgacaacaatcttttgctaaggcaaaaagttctctgaccagcccacagctggaatctgtgcatcatatgataaaaaaaaaaaagtcaaaagaaaataaaaaatacattgtcagaaaaccagtagatcccacagatactagtaccaaatctcttccctgcagctgtgctggaaattactttacacattaatgcagagatcaaaaggatagaaaagtttacatcctgtatccttgtagcttggtacagtttatcagcttgaattctagtcccctagaaggcctgatatcaagtatactgttggtgcttagaaaatatttagaaatctaaaaacatttgtttgtgtttagtgaaatgaactggcttacaaaggcagtaaaatgttttgaattcatttaaataactaatgattcacgcttagtttg

SEQ ID NO: 5684 - DNA, 1223 bp, Homo sapiens
tcacctcccctctctgtcctgttatctaacccaaggattttaatgatcatcataaattcaggctgcttcataccaaggagggtttttatctttggagcaatgtaaaagaggatgagataatgcagtgagacattttctttttggaagaattcatgcagacaaagaaattacattcttcttgttctgtgttactagcaccttttctatgattttttatgacattttatgatgaaaaatttgcaatgtttgtaacacctgagcatagctactggttcctaaagttgtcttccatagaggattgaaagcataaaaagaggatcagtgtttttgtaaatgtttctaattactcctcacaacttgtgatggggaagaaggctgtatgggcgttggtagtgagcaagttagtttatgatttaaatttgatgaggaaaagtcatatggctgggaaaagattcagcgatattgttcataattctctgtatgatttggtcacagacatgtgggacacaaggatattttcttacaggagaagctgtatagctcatttccacttacttgtgagagctttgtttttttgtggccatgctgctctggtagtgtatttttttttttttaaaacgtgtagttagatagacttcttcctatccttcagggtagactagttcaaaatctattactagactatcatgatagaacaagaaaccctgaagtgtgaatccatcattatataaaaagacaaccccctttcaagggggttgtctttttatactggaatgtcttcattaattaacttggatttgagaatggcctctcaaatagtgcttgaccaaaggaaaaatatgctggtttttctttccttttaatcgtttctttagattttgaaataaaacaaggaaatcatgaaaatgtgggagccgtccagttctccacatgggcacttttacctcacatttacctgttgatgtgttctgtactagcccaggtgctgcatataaacttgtttaactgcagaaatgaaacccaagcaatatctttgtttcagcaactcccaaggattccaacagtctcaaagcaagaccaagatccaggtagtgttcgtttaatttctgctttaatgccctttgtgccgtgcccctgcctagaaataagaaccacaaaccaaaacccaacccatgatttcctcttcctttagatgtaaagcttaggatatgagccatttcgct

SEQ ID NO: 5685 - DNA, 1197 bp, Homo sapiens
ggactgtgctccaggaattggtaaagagcttccaggttcagcagaggggaggactgctggccagggcctttgatatgctgcttcagtgaggggatccattgccgccaccctgcttgctgccttcctgggtgccactcccccagtgagtccaacatgacatgctcctctcaggctcttgaatgctgctctgagcagtgtcaccctttacactagaaagctgtcagaaactatgggggaaaaataaaacaagaaggaaatagaggaggtgctagaagaggaggaagaaaattatgtggtggagaacattgttgactgtaactggtaaagagcaaagtggagcacctcctaaagtggaagagtttcttagatgaagatgactcttgggagccagaagagaacctggattgtgcgacctcattgctgagtttctacagccacagaaaatagcacctgagacagatagatcagaaagaggcaagtgcaaagcttattctcattctgaagataagggagaggagagcaaaccagagaagaaagaagagtcagaaaagccacgaggctttgctgggctttggagctgagcagattattggagctacagactccagtggagagctcatgttcctgatgaaatgggaaaactctgatgaggctgacctcgtccccgtcaaggaagccaatgtcaagtgcccacaggttgtcatatccttctatgaggaaaggctgatgtgggcattcctacctcaggagggcaatggcaaaaaaagatggcaagaattacttctcctgagcaccagcccctgtcacatctggctgggagtttcaagtggggagagaaggggttaagacttgtgttgacatcacagaggtggcttgagaagatgtcctttgaagagccagtatagtctctgtgtcctgcagcaggccaagtgcttcaaaactgttcccagctgtgtagcttgcacatggttccagtggaggggaagcgggataagtgtttcaaggcaacctttgttgcactttgctgagaaaagcaaagggctttctatgaaggagaaaacttgcagaattgggtgtgtgagagagcaaaaagatcctcaaagagcatctccacaaccctcagccttcttcccaatagtgtcaactctgcgtttttagagtgtagcattaggtagtttttggctattactggtgtat

SEQ ID NO: 5686 - DNA, 1190 bp, Homo sapiens
aatccagagagtgaagctgggaggtgaatgcgtggcaaaaactcatggaaaaaaaaaaaaaaagcagtttcaaggactatgctgcaacccgccaagcagtggctttcctcaagctgctgtaaccagctgcttctccctgctcctcgaacttgcttgagttccgagggaagcgcctgctttttgggtgcgtggccagggtgggtggtggccaggattcgaaggcgacagtgaaggggagcgagttcccgggatggaacttgacgtggaacccggggtcccatcgaggggctccccacggcctcgggtgcttgggctgcgactggtttttcatttggcgtaggcgtggggggtaggaggcaaagtgccaagggctttcccgggctcacagtgtctcatggtccgccactgcctgcggtggcgctcggcttgaccccggctcgggccccgcacgcggcggcggtcaaagggcgtgctcgcggcaaccgcagggcacgcgggccggccgcgcggggggcggggcggcagtggcggttgcggggcatgcgcggctccgcgcgcggcttctcaaacatggcggcggcggtgtgaagctcggtgccggctcgcgcgatcggtgggacagaatttcgttgttttcaccgacgagactggaggtacgtggtgattccgggccccgtaaggaatggagaggcggaggtgtgtcccggaccccgaccgttgtccgtgggcgggcgggtagaagccatcagcgcgcgtcccgtgcgaggaacgcccccttacgatcccgcctatgtcccatctcagttcggcttcgcgatagggtatcccgcccccggcgccttccgcggacgcccttcagccgatctcgcgtttcccctcacgccgccccggggccttttcgccgccgcggggtttgggcgcccggccgatagcttccacccgtcccctcgcctgcagcgccgacagcgccctccggcgcatcctccctgccgtgggtagggccgggctggggcctggggggcatcacggtgggtggcggggcggaggaaggaggtagactttgcctggtctgggctgagataacttttggagtttgggagggaaacgtcggcccggaaggatgcgcctgtggcggcgtgcgggcgcaaatcctggtgccaaggtgcgcgccgccgggctcctggcggggg

SEQ ID NO: 5687 - DNA, 1315 bp, Homo sapiens
tattattactttttccctcacttcagaagaaaggctgcctttgagttgaccaaccatgttgaggtggtagatgggtgctaaactcactgtagtctgagtaattgacttccacaagtcatccccactgttgagcctttcaaaatgaagtctcagtatatttacaaattaatggacatcctctctggggattagtcatattctaattcaacaaagacattgtttgaagtttgtttttgtttgctaaatgaactaaaaattatgagatttgcacctaaaggtactgaggtaaaggagagccaaaagtggggtagtcaatctacttattcagaatgagtcgataatttaaacatgtctaatagcagagacagtatattatagaaatggcattacattctctgagatctgcttttactgaagtggatcaatgatgaaactagccaaatctgagcatcagaaggctttccggtctacctgatgcatgatctctacagttctgagaagcagaactataaaacaatgtaaaacaataagggcatatgtctggtgtgtgtgtggggggtgtgtgtgtgtgtgcacgcacacgtgtttataaaggtagcagttgtaggaatgaatgagattgggggtgagggggtgcatatgtatgtctatgaaagcctaatcatttctgggcaatgatgtaaaggttttacgactgacctttgtaactatgaagttttctacacttgacctgagctcagaaaaaagaaagaaagaaagaaatgtcatcatagagtcttagttctagctctgccgttaactaacttgatgtttatcactcccttatgtttgtttatagttttactatatgtatttattcccaactggtgcaactttattctcttgacagttttatgtggactttaagttgctgttatcaaaagttgaacaatattccatacccttttcctttctccccgctagagtatgctcaggtaatcaaaatgttgggaaatggacggctagaagcaatgtgtttcgatggtgtaaagaggttatgtcacatcagaggaaaattgagaaaaaaggtaggtgtgatttgttttactttaatataaaattggttaagggggaaaatccctctacagtttttaactgtccatggacttcatttttggaaattcccaaaagacttaccttggtaaacagtgatttacctataagtaaaatagcaaggtctgtaatggtaattttatacaggttctaatgttaaagaagcatttgtatcacttgtattgtattcctgcccaaaaagtccaaattgagagacattctg

SEQ ID NO: 5688 - DNA, 1315 bp, Homo sapiens; identical to SEQ ID NO: 5687

SEQ ID NO: 5689 - DNA, 1196 bp, Homo sapiens
gttctccaaaagtaaatttcagtaaagctttttctttcggtttttttctaatttagtatattttccttcaattgtgtattagtaatatacagtataattctgttaaaaaaaaaaagtcacccccggaaaagtcagtgttaaaaatcttctgcataattgtttctatggctaattatacaaccagacatatcaagggcttaattacatgcttcaatgacttagctccattaaaatttcagagatgacgcaaaatataatgaatacaattatgtatttcatattctgtgtgtgaagtatgtttcttcttgtttttgtgcacatatgtttgtctccaaacaaccaattttcaaaaaatatctaactagctttttaatatatataacatatagagcaagtgaaacaactgcttatttattggattttcacttttcaaaagattttttgatgacatgtaaaaacagtgctagagctgttaattgcttcagtttcagtgcccatgctgaagtagagtttatttctaaaaccagatcctaaagaaataaattgtagatattttgaaaatacagccttcataacattgaaaatctggaggactgactgtgcaaagtggtgggaatagacataacaaaaggagaccttccctcaaacctttaccctactttcgatgggcagaatattgacctggatctatagatggctgttgtgagacctcggttcttcttagcttaaaagaatttaaacaagagacacacagcaaaggagatatagtatagagcaatttattgcaaaggacaaagaatattatgaaagttaggttcagaacagacagtacaccctgagagaggattcagggtgagctgctcctaaggatgagaccaccaagactggcactagggagactccctttatgagagtcttacataattattcataaaggagtgggaagaggtgttgctattaagcatattcttggttgtcctctgggtgcacatgcatagtagctgtacatacttgttcatacattgcatgtctcattagcatcttaaatctctatccaggggtgtgttgcttactgttataatgaacaaagggtcggtctgaggacaggtgtaatcaaaatgcatgtgctccctgcaggggaaattccttactgtagatagctgtgtttgaatgagctggactacagtgtgagtgct

SEQ ID NO: 5690 - DNA, 1197 bp, Homo sapiens
taaaggtaagaggtttaatggacttacagttccacatggctgaggaggcctcacaattatcgtggaagataaaagaggagcaaagtcatgttttacatggcggcaggcaagagagcttgtacaggggaactcccctttataaaaccattggatctcatgagacttattcactaccatgagaacagtatgggggaaaccgcgcccatgattcaattatctccacctggccccacccttgacacatggggactattacaattcaaggtgagatttgagtggggacacagccaaaccatataattcaccctttctctgtccttttctgtcatcgttttcagtgtaggtgtttggccaatacagggaagtaacaggtataagaaaggttatgacaggattccttggtcattcatgtttcttagaatgccactaccttcttttggtggttgaagcaaattctggtttgaatggaaagtatggcctcttagggctatcagagcttactcagttctagatgtatcgtatttaccttgtatttgtttggcatctcgctgaactcccatgcactatgggcctgatggagtcctgtgctcctggggcattgtgaatgctgtgtgtaaatggggctcctaggaacaacagacacatattgtgcacattttctctgctcacacacacatgttccattgtcccctcatgctccactcaaaaaatacaagttcaaagataaaaatcattaagaatttcaagatagtggcaggagaagattaaactaagtgcaggacccttctctctgtggggcctgtgtgactacacaggttgcacacccacgaagccggccctttctatatcaggcaaagctgctggacagcctgaagcctcatgagcatgccatgtatgaaggagcccagcttacagcaggctggatattgccaatagtgtaccagtgcaaaatggtttccctgaaacctttaatacacttacttatttcaaactcagttgaattgatatcattgagacagctagatctcttagagggctcccagtgccaggaggagtgcctttcagatgggtctttgaaacctcagtgttatagctagaaccaggtactcatcattgaatcaatctctctatatctcttaacattttttccttctcataggatttccagcaggagagctccagaagcctttcttttgg

SEQ ID NO: 5691 - DNA, 1151 bp, Homo sapiens
agttcgttaccttagtaggtaacggtaaggttattctctttttttttttttttttttttggttatgaaaacttagggactaaaattaatataaaaattggcataatgttggattgaatctacattttggcagaagttaaacattcccacataatgtcaaaattatacatcatgcagttctgtttttttgtttgttttattttgttttgtttttgagtctggctctgtcacccaggctggagtgcagtggcgtgatctgcaacctctgccccccgggttcaagcgattctcctgcctcagcctcccgagtagctgagattacaggtgcgcgccaccacacttggctaatttttgtattattagtagagacggggtttcagcatgttggctaggccggtctctcctgacctcagggtgatcagcccacctcggcctcacaaagtgctgggattacaggcgtgagccaccttgcccagcccacatcatacagtttgaaatgaaactttgccacaaccagcctttgctgtagcacacacatatatcactgaacctgtttgaaataaagttttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatatttttctccccttgctcttcctggcctgaaacacgggaaaccagagtcaaaagttatctccctctccctgtgatgccttgagatttttttctgcgttgtttaatgcctgaaatccaagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaatgagtgagtccttttgatttttaacttattccccatgtccctatacttcgtgtgcttttccttttttt

SEQ ID NO: 5692 - DNA, 1162 bp, Homo sapiens
gctactacttttcataaagctcttgcacaacttttgttagatatttttgttagatactgtgtaatttttgttgtcattgtgaataggattttcttttagttatagttgctattattgctgatgtataaggatcactgttgacttatatgtattgatcacgtaaccttgctgaactctcatcatatttcatagattctgaggtacacttttcccccctacatcttcacatatctgaagtcaaaatagatctttgatggtgtcccataatcactgttgtctaggcagcagtcatgatgtagttatcattgcttgcacatgcacaaacttggtcagggctcttcattttgtcatcactttaaatgagtatgtgcattgctgtattgttatttcatgccaaacaataaaactggaggcggaagaaattgcaaagtgggtgtctgccttgaaagaaaatcccataaataataatggatcattttaagaagtgctgcatcaccaacactcttattggcagagcacaatattgttagcaacagttgaacagttttgagtggaagagcaatccatagtaggaccttgaatgtgaagttgtaggaataccttaccaatttattttgcttcttttttttctgtcgcccaggctggagtgcagtggcacgatctcagctcactgcaacctccgcctcccgggttcaagcaattctcctgcctcagcgtcccgagtagctgggactacaggtgcacgctgccacgcccagctaattttttgtattttagtcgagacaggttttcactgtgtttcccaggctgttctcgaactcctgaacccaggcaatctgcccgcctcggcctcccaaagtgctaggattacaggcatgagccactgtgcccggccaatttcttttgcttctgtatacacaagatatgataaaagtctgtctaaataagtctgaattgtcttgataaatctagaatgaaaatcctagataataagaaaatactgtatcagtttaattggcaatgtttttttcttagtcatgtaaaataagggtacagcttacaattggtatcttcagagtcagtgaaatgtagtagtaataacagttcatgccgggtgtggtggttcacgcctgtaaccccagcactttgggaggccgagacg

SEQ ID NO: 5693 - DNA, 1411 bp, Homo sapiens
caatgttacccaggctggtctcaaactcttggcttcaagtgatctgcccaccttggcttcccaaagtggtgggaatacaggtgtgaagccattgcacctggctatatatggattttattagtgtgcctaaaattttactttcatgtatgtattttttctgtgactgcctcaattgctttgttctcctaatttttaaaaatctattgatttgagatgattacaaaagttcttgggttaaaaacatgtgattcaaaaatagattccctctttatttctttaatctatcttaatgtttaagaaaactgaggagctaatctgttttcccagtagaaattaagtaacatttacgttaattgtagtcatgcatacttacctgaaatttgtcattttaattttttttttaaggagctgatggtacacacatggatggtgatcaaattgttgtggaagtacaagaaactgtttttgtttcagatgttgtggattcagacataactgtgcataactttgttcctgatgacccagattcagttgtaatccaagatgttattgaggacgttgttatagaagatgttcagtgcccagatatcatggaagaagcagatgtgtctgaaacggtcatcattcctgagcaagtgctggactcagatgtaactgaagaagtttctttagcacattgcacagtcccagatgatgttttagcttctgacattacttcagcctcaatgtctatgccagaacacgtcttgacgggtgattctatacatgtgtctgacgttggacatgttggacatgttggacatgttgaacatgtggttcatgatagtgtagtggaagcagaaattgtcactgatcctctgactaccgacgtagtttcagaagaagtattggtagcagactgtgcctctgaagcagtcatagatgccaatgggatccctgtggaccagcaggatgatgacaaaggcaactgtgaggactaccttatgatttcctgtaagtcttggggtacagtgattgtcaaaggtgtttttgtaggctgcctcttctaatttacatcaggggtgaaattttcttgacttaaatgtctgtaaaagtaaatctcatagacctacctgcattgttgtttccatttgcagcctacaagataactgaaaattaagaaaagtgaggccgggtgtggtggctcatgcctgtagtccgggcactttgggaggctgaggcaggtggatcacctgaggtcaggagttcgagaccagcctggccaaccaacatggtgaaaccccgtctctactaaaaatacaaaaattaaccgggtgtggtggtgggcgcctgtaatcccagctacttgggaggctgaggcaggagaatcgcttgaacccgggagccggaggttgcagttagccaagattgt

SEQ ID NO: 5694 - DNA, 2064 bp, Homo sapiens
atttggattcgtgaacatattacaataactgtctttcccaacagataggaccactaactgaaatgtttgttagaactaagtcctgcaattggaaaagagagaatcatcaaaattttaaattagttaattagttgctggctggtgaagttatctttccatttgatattagggagatgaagatgaagaaattgatggagataccaataaatacaagaaaggacgtaagaaagcagcttatgctggaggcttggttttggaccccaaagttggtaaggctgggcagtgaattggttttctcccagtattaaggaatttcttaatgtggatctaggcttgagaaactagaagactgaattatatcttatagatcagcgaataggtctcatgacttttatctttcgttcacgtgaaaatcttggttgccagtcacctgacatagacttaatgtgaattttgttatgctgtgttccaataaaatattatttatagacattgaaatttaaatttcatatagttttcatatgtcatgaaatattgtttttgatttttttccagccatttaaaaatgtaaaaaccatacttaagctcatgggtggtacaaaaataagtaggttggatttggtctgtagccgtagtttgtctaatacatagatagctgtccagtacatagatagctgtttgtcctgaccagttcagttgacagcaaagttgaaggacgtgcagacaataaccaccaaatttaactttaataggagaatatctttttccctattgtcatgaatggcaaagatgttttgtggtacacagagctagaaataatttttttttctttttttcttttttttttttggagacagagttttactctgttgcccgggctggagtgcagtggtgcgatctctactcactgcaaccttcacctcttgggttcaagcgattctcctgccttagcctcctgagtagctaggactacaggtgtgtgccagcatacccagctaatttttttgtatatataaaaaaacatttcaacccttcccaagtgtacagttcagcagtagtgttaagaatattcacattgctgtgaaggaattaatgtgaattttatctaataagttagttctgagtaggaaacatttttgacaaaagtgattttgttattagttataatgaaatggagcagtagtacttggtgttatgtaggtctgggtttgaattcagtgtgatcttgggctgcctgtttaacctctgtaagcctcagtttcttctgtaaaatagagttaagagtaatatctaccacacagggatttaaggataaattagtatagtgctggacacagaataaactatcctatatgtttgcaattattattgtcttaatagtggacatttatttttattcagtttcttctcaaggtgaagataactctttgtaaatgtcctacagaaatatagtagctttctgttcttcctttgcaagtaaaaagggtgggtcgttccactactgacatttatatatatgtgtctcttgtttgattttagctcagtttttgtacaggtaaatgtgccgtccattttattttttgaagctgttgtaaaagaataaattactctaccaggcgcggtggctcacgcctgtaatttcagcactttgggaggctgaggcaggcagatcacgaggtcaggagatcgagaccgtcctggccaacatggtgaagccccatctctactaaaatataaaaaattagccgagcacggtgttgcgcgcctgtagtcccagctattcgggaggctgaggcaaggggactcacttgaacccgggaggcagaggttgcggtgagctgagattgcgccatggcactccatcctggagacagagtgagactctgactcaaaaaaaaaaataaaaataaaaataaaccactcacttggttttatttggggtggggggtgggagagtaggtaggaggattcttcaaagaattcttgctttgaaggagagttgaacatttttttttttttaatggatgtgacacgtctcagatagctgattgggaaggtatttgc

SEQ ID NO: 5695 - DNA, 2064 bp, Homo sapiens; identical to SEQ ID NO: 5694

SEQ ID NO: 5696 - DNA, 1196 bp, Homo sapiens
atcacttgaacccaggatgtggaggttgcagtgagccaagagcgcaccactgcaccccagcctgggtgacagagcaagactccatctcaaaaaaaaaaaaaaaggatctgtaagctggttctacctctaagtacatcctgcggctctctccttctaccattttcacttgctgccaccgtagttcaggtggtcctctcaacaggattcctagacaagtcttactggtttttctacttctagacctgctctgtctgttgcagtagccactagccacgtgtgcctattgaacacttgaaacgtgcctagtttaaattgagatgcgtcataagtatcagatatacctcattaatattcatacactgattacatgctgaaaggataatattttagatgtactggattaaatgaaacattaagatttacctgttttattttaggggttttaaaaatgtggctactagaacattgaatgttctcagaatggcatatatggcttacattatattattatatttctactgggccgcactgtgtctaagcagtcatcccccctttgatttatcctccacgctgctgtcagaattatcttgctgaaaaacaaagtccctgagctaaaaattctttgaagtcttttgggataaagtttaagattagcttaacacaccatgccttccctaaaggcattcagtttcaaaaacttttgaaacactgtgctgtccacagtgtccggttagattcagctggtaggttgccagcttccaactcctgatctaaggactgtctgtcatctctgtggcacctctaccctcaaatatttcaatagttgttagacaattgatgcactataaatagattgaagtagagttgagcatatgagaaagtaccctgtatcaattctacattcatgctaaataaaaagttttatacagacccttaagggacagctacattcctaatactctgttgaaagttatccactgagctgcgcacctcttcctagtaggccatatgtgttagtgggcactctgaggagattgaagtggcttcgaggacccagcccccactaagagctgacggcgagtgaaccaactgggaaaagaaaccttcatgtgttgacagtatcagaaagattcgatggaaagctactaaatttgaaaaatcgatccttataagataatctttcttttggagtgggg

SEQ ID NO: 5697 - DNA, 1218 bp, Homo sapiens
tgatcttggctcactgcaacctccgcctgccgggttcaagcgtttctcgtgcctcagcctcccaagtagctgggattacaggcgtgtgccaccacacccagctgatttttaaatttttagtagagacaggctttctccatgttggccaggcgggtcttgaactcctgacctgaagtgatctgcccatcttggcctcccaaagtgctcagattacaggcatgagccactgcacctggcctctggttttattttcttacaatggtcttgtcattgtagtataaagcttataagggtcacatgaaacattttggaaagtatttttactaattatattatgtggaagaacttataaaagattggtgttatttcattctcattctatggaaagttcattactttaggaatcagcatagaatatatttataaacatagttttcagtgcagagacaatttttaggagacatgaggcaattgagatttcttgttttcttgttaagctctgtttttcttggcacttttttattttgtgtaataccaaatttattagcataattttcctatataattatgtctgtttccaggatatggagtgaggatttcctttacattgccgatattgattattttgacttttttctttaatcccttgccaggatttatacattttttaaccctttatgaaaataaaaatgtttaatatgttggttttctttttgtaattaaaagtatatctcactgatcttatattgttttattcctttttgcatcttttttagagttcccatctgttttcttacattacccacctgtctttccattagagtccttagcatattaatcataattattttaaatttccagtctgaaaattccaaagtatctaccatatcttaatctctttttgctgcttttgatactctgtctcttcaaactgatttttattttaattttttactttcagtatgccttgtaattttttgttcaaagtgagtcttaatgtactgtatattaatagaaggaactgaggtacataggcctttagtttaaggttttttgttaatatggcaaagtgttatactgtgtttactctttgctgttgtcacaagatccttggggtatcgatttgccagccggaaacctctgtggccagtgatgcctttgcccaaggattgcttgggcctgctgggcccacttggcccggcaggctgcacttggctc

SEQ ID NO: 5698 - DNA, 1167 bp, Homo sapiens
gattagtggcactgctagaggaatattgaaagtagaaagaggcaatgatgaacatttggataattttaatactgctttaaacagtggagggagagttgtcagaaggactgggaaaggggaagagataaaaatcctagggcctctttggagtagagtactctgatgtctgtgtacaggatggagaaatttcctacatgaacaagtagcagtggaaggacaattggggaaattttagtctgggagccaccttggctctccaagtaatttaaataatccaaatgtggatagagagatggacacttcagcaaagtaaattacagtcaaggatccatctagaccaaatgatatatatgtgtgtttcatatttggagaagttatttaatatagttaaaacatatttacattatatgaaattatagttgaatgcaggagttttcctagctaaaatgtattgctctctagttaagaatgattcatgagtctatggccataccactctgaacatggctggtctcatctgatctcagaagctaagcagggttgggcctggttagtacttgaatgggagagtgcctgggaataccgggtgctgtaggctttttatttaaataaaaataataataaaagaaagatgcatgatggtattgctgatacgtttaagaactttggacaagagtatctaagcaaagaaccagtaaggttgatgatactcgggtttagtggcagaagcactgatcctgtggtcagattcggcacttaccttatgatccaggatgcagaattcaatttattggtgtctccctttgcctgtaggcaactatgaaatatatctcaagctttctcaaaagcaaaacgttaaaaataaatgaaatacatacccttgtttgaatagaagcttccacaacagaaaggtactaaatgcaaatagtgtggtgttatattttggctactgaagagcgccatatgaacaatatttactgagtgcttcccgtattctaagtgctttacattcaatgactcagttaatcctcacaagaactccacaaggaaggtactataattatccccacattataaatgaggaaattataagactgaaccaaagttttgattctagtgcccattggtgggttccagaggagctttctcacagatgattacagcaag

SEQ ID NO: 5699 - DNA, 1246 bp, Homo sapiens
ctgcaagttgagttaaggttgctaatcagatgaccttacgataggaaaattatcctgaattgctgctcggcggtcccacgggtctgtctcttgcttcaacagtgtttggacggaacagttccggggactctttcttccagcttccgaccgccctcctatttcctctccacttgcaacctccaggaccatcttcttggccatctcctgcttctgggacctgccagcaccgtttttgtggttagctccttcttgccgaccaaccatgagctcccagattcgtcagaattattccactgacgtggacgcagccgtcaacagcctggtcaatttgtacctgcaggcctcctacacctacctctctctgggcttctatttcgacggcgatcatgtggctctggaaggcgtgagccacttcttccgcgaattggctgaggaaaagtgcaagggctacgagcgtctcctgaagatgcaaaaccagcgtggcagccgtgctctcttccaggacatcaagaagccagctgaagatgagtggggtaagaccccggacaccatgaaagccgccatggccccggagagaaaactgaatcaggctcttttggatcttcatgccctgggttctgctcgcacggacccccatctctgtgacttcctggagagtcacttcctagatgagtaagtgaagttcatcaagaagatgggtgaccacctgaccaccctccacaggctggccggcccggaggctgggctgggcgagtaactcttcgaaagacactctctcaagcaggactaagagccttctgagcccagcgacttctgaagggccccttgcaaagtaacagggcctctgcctaagcctctccctccagccactaggcagctttcttaactaccctaacaagccttggatcaaatggaaataaagctttttgatgcaaaaaaataataataataaataaaaaaggaaaattatcctgaattaccttgtgggcccaatgtaattacaaggtcctcctcaaaagtgcaagaaggagagtgtcagaatgatatcatgtgaaaaagactagactatccattattgactttgaaaatggcctgaaccaaggaatgaatgcagatacctcttcagaagaggaagaggcaagaaaacgaattatcccttagagcttccagaaaggaatgcagccttgccaacaccttgattttagctcagtgagatccattttggacttctgacctcagacctgta

SEQ ID NO: 5700 - DNA, 1221 bp, Homo sapiens
gaaacagaattactattcaacccagccatcccactattgggtatattcccaaatgatatgggttggatctgtgtccccaccagatttcatatcaaattgtaatccccagtgctgtagatgggaggtgattggatcatggaggtgttcttcatgagtggtttagcaccatccccttggtgctgtcctctggatagtgagtgagttctcatgagatctggttgtttaaaagtgtgtagcactttaccccttgctctatcacttgctcctgcaatgtaagatgccttctcttgccatgtaagactccttcttcccctttgcctttcaccatgattggaagctttttgaggtctcccccgaaacagaatccactatgcttcctgtacagcatgcagaaccgtgagccaattaaacctcttttctttataaattacccagtctcaggtatctctttatagcactgtgagaacagactaatacagaaaattgataataaggagtgtggcattgctataaagatagctgaaaatatggaagcaactttggaactgggtaatggacaggattaccctgtctaaagtggcattcagccacttcagattgagcagtaacaggtctgtgatgctcttagatgtctggggctgcatgcatgccacagtgactggctgtcttcttcccttggtggatgcttgcttcagctcctcttgtcattggacatcagactccaggttcatctgcctttggcctctgaggcttgcaccagcagcttgccaggggctctcaggcctttggctgcagactgaaggctgcactgccagcttccctggttttgaggctttcagacttggactgggccactaccggcttctttcttccccagttgcattcagcctattgtagaactttgtaatcatgtgagataactctccctaataaacttccttttatatatacatatatcctattggttctgtccctctggagaaacttgactaatacaccaaggaaatataaattgttccaccataaagacgcatgcacttgcatgtttattgtagtacaatttgctattgcaaagacatggaatcaacctaaatgcccataaacagactggataaagaaaatgtggtacgtatacaccatggtatattctgcagccgtaaaaaaagaatgagatcacgttctttatagcaacatgaatggagctggaggccgttatcctaa

SEQ ID NO: 5701 - DNA, 1134 bp, Homo sapiens
ggtatcgtggaaggactcatgaccatagtccacgccatcactgccacccagaagactgtggatggcccctccgggaaactgtggcgtgatggccacggggctctccagaacatcatccctgcctctactggcactgcgaaggctatgggcaaggtcatccctgagctgaacgggaagctcactggcatggccttctgtgtccccactgccgtgtcagtggtggacctgacctgccgtctggaaaaacctgccaaatatgatgacaccaagaaggtggtgaagcaggcatcggagggccccctcaagggcatcctgggctacactgagcaccaggtggtctcctccgacttcaacagcaacacccactcttccaccttcaatgctggggctgtcattgccctcaacaaccactttttcaagctcatttcctggtatgacaatgaatttggctacagcaacaggatggtggacctcatggcccacatggcctccaaggagtaagacccctggaccaccagccccagtaagagcacaagaggaagagagagaccctcactgctggggagtccctgccacactcagtcccccaccacactgaatctcccctcctcacagtttccatgtagaccccttgaagaggggaggggcctagggagccccaccttgtcatataccatcaataaagtaccctgtgctcagccaaaaaaaaaaaaaagagagagaaaaatcttggcttacattttgactttgtgaaaattactttacctctctaaacctagaattgcccatctgtaaaatggcaatgatgggtcaggcatagtggtgcatgcctgtggtcctggctactccggaggctgaggtgggaggatcacttgagccaaggacttctgggctgtagcacgctatgctgatcaagtgtccacactaagttcagcatctatatggtgacctcccaggggcgggggaccacgaggttgcctaagaaagggtgaactggcccaggttggaaacggagcaggtcaaaactcccgtgctgatcagtagtgggatcttgcctgtgaatactcactgtgctccagcctgggcaacacagtgagaccctgatctcttaaaaagaaaaaaaaagataaaaaa

SEQ ID NO: 5702 - DNA, 1157 bp, Homo sapiens
accttcaactttattaggtattgtccagttttcccaagcatttggactggtttatacttccaccatcagtgcaagtgtcgtctccacaaaggcgctccttcttgcttcctcctagtataagtagctgttatgccacttatgaagaaatgtttgttagacaaatgaatcacagtcactagactgggataatttcctattttaaaattcttccctcttgatttttctttcttttctatattgtagaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttataggatgacaaaccagaagattcgaatggattgaatgttacctgtgccagaattagaaaagggggttggaaattggctgttttgttaaaatatatcttttagtgtgctttaaagtagatagtatactttacatttataaaaaaaaatcaaattttgttctttattttgtgtgtgcctgtgatgtttttctagagtgaattatagtattgacgtgaatcccactgtggtatagattccataatatgcttgaatattatgatatagccatttaataacattgatttcattctgtttaatgaatttggaaatatgcactgaaagaaatgtaaaacatttagaatagctcgtgttatggaaaaaagtgcactgaatttattagacaaacttacgaatgcttaacttctttacacagcataggtgaaaatcatatttgggctattgtatactatgaacaatttgtaaatgtcttaatttgatgtaaataactctgaaacaagagaaaaggtttttaacttagagtagccctaaaatatggatgtgcttatataatcgcttagttttggaactgtatctgagtaacagaggacagctgttttttaaccctcttctgcaagtttgttgacctacatgggctaatatggatactaaaaatactacattgatctaagaagaaactagccttgtggagtatatagatgcttttcattatacacacaaaaatccctgagggacattttgaggcatgaatataaa

SEQ ID NO: 5703 - DNA, 1214 bp, Homo sapiens
tgttaattcttaagcaagaaacttttttcttgatgagactcacagatctacacaaactacaaaagttaattttcttgttacacccactgcactctgcaaccagtgttgcctgcctcatggcagttggatcagctcctttacaaaaaagaaaaaaaaaaaaccaacagcaacaaaacagagcccatccatgtcagccacaccaatagtttcatgttaattctttgccactggagtcaattttgctatgagcaatgtaaggctggtaacctttaaattatttggttgatgtggaaaattggtgatgtaacactgtttctagatttttttcattgcctttttattctgatattaggttaatcactttgaagctatagttatgctgtaacatttagcatggcttcacaccaagttagtgtagccaatgaggaaaaagttaccataatgacagcagttgtccgagaagtgacagctgtattactcagagcttttacttcttacacctagaatattaaaatataaaacaaggggagaaatgtgacagtctattttcagttgcacatatgttccttatatataatgtttgacagttcaatctctgggtggaataaagaacacttacgtatcagtaatgggaatttttaaagatttaaaacaaatatgcaaaaatttgctatgccaagatgctggagcataatataagactgtatttggtgtgcttgttttgtttctttggtagagtttattaggtgaatcttctaaaactttccttctgttggatcccagtgacgtggaagtcatcagaaccccacggtacttggagtacctctctgcaccaagatagctggctgattttctgctcagtcacaattttacttgaaagcaagaattgtcctagctccttttccattattccaaaacgtttaacgttcaaagcagggtctcattaaaaaagaaactactggttgatataattgagatattacaatttcagaataaacatttgattaaaaataaggaaatcctcagttcatactgtatttaaaagagaattggtaacttgaatgtgtgtaattttttggaacctgtctaaaaaccaaatacccctgcaaacagatacagcccaccctattctatttaaatattttgctgttttattttatagaaattattttgctgaattcacaaatagaatttgatttaagaagaactttttg

SEQ ID NO: 5704 - DNA, 1099 bp, Homo sapiens
tttcaacgtttaggcagatcattaattatgagctagccaaatgtgggcatactattacagggaaagtttaaaggtctgataacttgaaataggtttttaggagaattcatctacttagactttttaaatgcctgccataaatgaaattgaaatggtagaatggctgaccacagcaatgaccagccctcattagggccctggatgatttttggtctaataacgcatgctagtgttgatgttttttggtcaagagggtatgaacaggaagaattaaatgcagcaggctttattttaaatgccgattcacattactctgttcaagctgcgttgagatgttaaactggcttactatagacttcgtaaaaatggctccagaagagtaacaaactgaaatctttgagatcacacaggttggaaatatgtacataactgcacaaggtgtcaattctgctctacagtgcagttttagtcagttttagttgcataggtttccattgtatttatagtctgtttatgctaaatctggccaaagatgagcattgtccaccactaaaatgcctctgccactttgaattctgtgctaattttgtggccagaatgcggtgatcaaaacgctccatctttttacagtggcataggaagacggcaaaaatttcctaaagtgcaatagattttcaagtgtattgtgccttgttctaaaacttttattaagtaggtgcacttgacagtattgaggtcatttgttatggtgctatttcaattagtctaggtttaggcccttgtacattttgcccataactttttacaaagtacttcttttattgcacattcagagaattttatatatatgtcttgtgtgcgtgtccttaaacttccaatcttactttgtctcttggagattgttgaacgcagcttgtctaggaaggggatgggactagattctaaaatttatttgggaccatgggaatgatagttgggaagaaaactatttgcacacgacagatttctagatactttttgctgctagttttatgtaatatttattgaacattttgacaaatatttatttttgtaagcctaaaagtgattctttgaaagt

SEQ ID NO: 5705 - DNA, 1166 bp, Homo sapiens
tgaatacgtatatacacgtatacgcatacgtatatacacacgtatacgtgtatacatatatacatgtatatacatacgtatgtatatgcgtatacacatatatgtatatatatgcatatgcgtatgtatacgtatgtacatatctatatgtgtattccttttccaggtgtgcagtttattcaaaccactgatttctcatcgtctcccgaatgtttttgtcagattcagttatattagagtcattgaaagaattttttgtttgtaggatggccatttgatatacaatgcctggggttttggattaaaaaaataaggtagttaatacaatgtattattttttggtaatgtctttaaggttgtaaacagctagagcctgcgtaattagagttcttgtgatatagggtgatcttgaacagtgctcttgaatgctgacccttaatcttctggtaatgtaataattcaagattcttatttttaaaatttcagtggagttatcgaaaactaagcaaaatattttaacagaaattaacttgtgacttttttagtacatttttgaaaaccttttgggtttttttttttttaagtagggtaaggatttgagttaaagtagaatatatacgaatatataccataaatgtagtaagtttaaatatagtagtactaccaagtatagttatagtaataatgctaggggactggggaatcttatctgcgtcagggaactattgctaaaatacacagttttgaacaaagtatcttatttttaagtttttcttaaatactcttattggaaatttttttggtaattctattagtagaaagattatacaaaatacttagaagttatagattgtatatcacttaaaaatgtatgtgcttttttccgtaggacatattagcattaaaacagttggtgttttaaatttttttgataatagaagtagtttaagatccattgaaacatattttcttaaatttggtttgctggcgtgtttggtaggggaaattattaggtcagttctagaggtggcttttttaaattgtaatatttggatgttgattaaaaacattctcatttatgtgtgttttttgtttgctggcacttaaaggcatacaggttgagtatcctttatccaaaatgcttggaaccagatgtgttttggatt

SEQ ID NO: 5706 - DNA, 1183 bp, Homo sapiens
ttataaaggatgagtttgtccccctctcttgctctgtctctcctctgtgatgcctcctgctatgttatgacacagcaagaaggccttcatcagatgtgatgtggcccttcagtcttggacttcccagactccagaaccatgacccaaataaattctgttaactaaaaattacctagtctgtggtattctgttatagcagcatagaatgaactaagacagaaaattggaactgagaagtggggcaattgttataaaaaatacctgaaaatgtggaagcacctttgaaattgggtaatggttagaggctggaagaatttagaagagcagactagaaaaagcctagattgccataaatggagcataaaggtcatttctggtgagggctcagaagaagacaagagctgtagcaaaagcctaaatcttcttagagattagttaagtggacattttattacatcattcttgcattgctgtaaagaaatacctggctctctgctcctcttgttcgacagacaaccacatcttctcttgcattgccagccgcatccatgagacaccatggggaaggtgaaggtcggagtcaacggatttggtcgtattaggcgcctggtcagcagggttgcgtttaactctgttaaagtggatattgttgccatcaatgaccccttcattgacctcaactacatggtctacatgttccagtatgattccacccatggcaaattccatggcaccatcaaggctgagaacgggaaatttgtcatcaaatggaaatcccatcaccatctttcaggagcaagatccctctaaaatcaagtggggcgatgctggtgctgagtacgtcgtggagtccactggcgtcttcaccaccatgtagaaggctggggctcatttgcaggggggagccaaaagggtcatcatctctgccccctctgctgatgcccccatgtttgtgatgggcatgaaccatgagaagtatgacaacaacctcaagatcgtcagcaatgcctcctgcaccaccaactacttagcgcccctggccaaggtcatccatgacaactttggtatcgtggaaggactcatgaccacagtccacgccatcactgccacccagaagactgcggatggcccctctgggaaactgtggcatgacggccacggggctctccagaacatcattcct

SEQ ID NO: 5707 - DNA, 1213 bp, Homo sapiens
aaggtagcagatgacccatttctctcctcaaatccagccccagtctcatcctcgacctcctatctagctctacttcccttgggcccagggccatcttaggccctgctgtgagtccagatggttcctgggtcaggtctttccccctccttgctggcccagagcccaagaggaagcagaagacggctggcctaagccttttggtggccccattcccttcagcaatccatctaggtcatcttcctgtcgatgccagcatccctgggctaccttgtttagggttgttcaatgaatagcagggactcatcacctcagcagaggttggtcctaggccctcagccccctgattcacttatttctgccataagcactttttgagcatctactctgtgtcagtcactattccaggtcctcaggatatagccgtgacctaaacacagaaatctaccctggcggagctgatcttctagttgtggcggtgaggagatagacagtaaagactaaagaaaccaataagtaggtggtgtcatttctgaggaggtaatgagtgctggggggataactggcaaggtgagggagttcgggatggttgagattttaaatagggttattcacagaggcctcatgaaaaaggtgacctttgagcaatggcccaaagggagaggggagtgagccatttcgaaatttaggggaagggtgttccaggtaccaggaacagccagtgtaaaggccccgaggtgggactctactgggtgtggttgcagaacagcaactaggaatgatggcgggggggtgtgggggtgggggggggccgtgggcaagaggcaataggggcaaatgaggtaaagaaacacctgtgggccacattgaggactggggcgtgtatttggggtgatgaaaaatgtacattcttgagtagaggagaaatgtgacttggcttgtaaaagtctagattggaccctaggggtcctaacctgatcaaaccgttctggcagccctgagaagagctggtgtacactgagacccccccgccctccacacaatcccacccagtggttgggtctgggcaggacaccctgacacacgctcccctccccccccccacctgggtagatgaatgggatgatgcagtggttgtcatgacgatgagtgctagagaagtcaggaagagggtccctgtggccacagggaatagtctgccttggcctttgagggt

SEQ ID NO: 5708 - DNA, 1165 bp, Homo sapiens
ttcctccctgccccacccacctacctgcttacccaccaacagccatctgctctgctttcccccacaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacagccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctcca

SEQ ID NO: 5709 - DNA, 1150 bp, Homo sapiens
ccatctgtgacctctccctctttttgcccccagtttccatccagtggcagcgcccaggtgcacatcccttctatcagcgtggatggcctctcgacccccgtggtgctctccccagggccccagaagccatgactactaccaccaccaccaccaccccttctggggtcactccatccatgctctctccagccagccatctcaaggagaaacatagttcaactgaaagactcatgctctgattgtggtggggtggggatccttgggaagaattactcccaagagtaactctcattatctcctccacagaaaacacacagcttccacaacttctctgttttctgtcagtcccccagtggccgcccttacacgtctcctacttcaatggtaggggcggtttatttatttattttttgaaggccactgggaggagcctgacctaaccttttagggtggttaggacatctcccccacctccccacttttttccccaagacaagacaatcgaggtctggcttgagaacgacctttctttctttatttctcagcctgcccttggggagatgagggagccctgtctgcgtttttggatgtgagtagaagagttagtttgttttgttttattattcctggccatactcaggggtccaggaagaatttgtaccatttaatgggttgggagtcttggccaaggaagaatcacacccttggaatagaaatttccacctccccaacctttctctcagacagcttatccttttcaaccaactttttggccagggaggaatgtcccttttgttcttccccctgagaagccattcctttgtctgccaacctccctggggtcctgcctgtttcctcccaatggagggtttttttggggggtggtccccgtctggggggcccctccagccagtactccaggtctccctgtctctcccccgctgccattttgatagtataatctatttttaaatggggcttttcaataggggagagggagtcatctcttcctatatttggtggggtgggtgggaaggaagggatttgggggggaatcttcctgccgcctcccccactccaagtgtttatttttgataccaaacatgaattttcagttccctccctcccagccccccaatttcctgcgggc

SEQ ID NO: 5710 - DNA, 1227 bp, Homo sapiens
tctgccggcttatctggctttcagagccctgaaacaaagagaaacaggatctgtccctacccagcacagcaaatggttgtagtaattgccaaagccctcgtaaagccctccggcttgaggagacagtgtatagtcatgagttctgcctctgtgcccttgctggccgcttcccctttgccttctttcctggaactcagggtgtggggactgagcctgtaggggccagcaggccctcctgctgtggccactcccaagtgtgccctcttccctctctccagatcaggtgtctctagcacaggacttggcaccaagctccatgctgagacaccaggctatgtgggcccccaccttgtttcccagcctgtaccttggaagccgaaggtgctttcatcagaatcctaaaatggccgttgaaggcgcctgggccgcagcccagcagtagctggagaggcaggcagagggcagtggttctcccaaataggagacctggggcctggccaggccagggtttgggcctaatggctttgactgaattacccccatcctcctcctttctggaaaagggagagctagagccactcactgtcattctgctctgaccttgaagggggcggtgttggcctggcttctggaatggactgagtccatcgtggaaagggctgggggcaggaggaggtggggaggggcactgcctgcggaaggtaggattagatcattagctcagtgacctcctagggtttcgatgtgctgtgttctcatcctacagttggtttggtaatgatctgcaagtcccggagagcaacagcaaagctctgcctgatgctctcattaaaatctatgcagccaagctcagcactttgtcacagccggccttgcgaagcctcctcagctcggggggccggggacccagtgagctgggaggccctctgggctccacttatgcatatgcaccaaaaaaaaaaaaaaaaaaaaaaggcttctttagacccagagccctttaagatgataaaggacccaatgcaggtaatcctgtttttggactcatgtaatgtagaatgctaaatttagtgattatttaatctgggcctaagctagtgagagtgtggaacaatggcccataatgactcctaagcggtgaagccagggggcctcctcccttcctggttcaccccgcccaggggacctgctcccattcctatggccctggggcccagcttccaatagtgt

SEQ ID NO: 5711 - DNA, 1221 bp, Homo sapiens
agaacaatacagccatcaatagccaaatatatattcttttcagggagacatggaccattatcctagatagaccatatgttgaaatcatacagagtatactttctgaccatgacggaattaaattagaaatgagcaataacagggcatcaagagaaagaggccatatttttgaagagtaaatgaaagcaacaggagagggagctatgtgaaatttttaaaaattgggatggaagggatatatgtgcttccttctacaagttatagggcacaaatttctcataaaaatgagcaacaaaataggatcaaggtcaaatccttactaaaaattataatttttaataaatggaagagtaaatgtcatacataataaatagcagaaatttatgattagatttttatattctacacaatattacatatgtgtatatatataaactaagtatttaatgggcataccatatcgtatattatgatgaaaaagtatcaaaaagagcttcctatctgttttctctccatcctccagtgctgatcatgttgccttgaacaagattgtgttgttacaggtatcagtgtcatttgaggatgtgactgtggacttcagtagagaggagtggcagcaactggactctactcaaagacgcctgtaccaggatgtaatgttggagaactacagccacctgctctcagtgggtaaggacaaccatcctgtgaagttgtgaggagcctgttatgggttaaattgtgcccccaaataaaatatgttgaagtcctaataccccagccccccagaatgtgaccttatttggaaatagagtctttacagaagtaatcaagctaaaatgagatcattagggtgggctttaatctaatataattggtgtccttataaaaaggagaaaactggacacagacacatatacacatacgcacgcacacacacacacaaacacacacacagagggaagacaatatgaagatacacagggagaagatggaatgtgactagaatgatacatctgtaagccaagaaacacttgaggccaccagaagctaagagaggcctggaacagttccttccctagcaccttcaaagagagtatggccctgctaacaccttggttttggagttctggcctccagaactgtgagacaataaatttctcttgttttgagccccctagtttgtggtactttgttataacagccctaggaaactaatac

SEQ ID NO: 5712 - DNA, 1194 bp, Homo sapiens
agagacaattatgacaactgaaatgagacatgcacataatataggtgagacttggatatcggcattgagtgaacctgtttgtcacactctgtcatgaccctctcaccttttctggcaagactgctctgcatttctgctgccctcatacctcacccagccaacctaccaaacattcctagctaggccttccttgctctcaggtgcatatcagagcaagtttgctagggggtgggatctgaaaacccatctcctataatcttctactcttgtgtgggatggaggaaatgaaggtgtgtccctgttgtccaaccctcagcatcttcatcagctctaggaggtgagcatgttgtcagctgttacttcatgacatcacaattctccccctcttgctgttcccagatacacaaggaataatttctgatccaggatcgtccttccaaatggctgtatttataaaggtttttggagctgcaccgaagcatcttattttatagtatatcaaccttttgtttttaaattgacctgccaaggtagctgaagaccttttagacagttccatctttttttttaaattttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccagcggtattttctaattcagatcatcaaactgattatatagaagagttggctttaaaatgtttgcaaatgtctttttttttttaatactggaagaaaaaatattctgttgtgtctcatacagtgcttaggatgtctttcacag

SEQ ID NO: 5713 - DNA, 1115 bp, Homo sapiens
ccatcgagcagagctcacatcctgtgcgcagcatcttctgtcccctcatgtccttccgccagggggcctgcgtgggtgagtcctgtagggacaggggatctgggtggctggggaggggcaggaaccagggctggtgccaacctggctcagacatcacgacaccgatgccctgacttcctggacctcatgacccctcctgccccaacagcctcactgtggaactcacagctccaaacagctcagagaactcacagtttgcacttgatctcggccaaaaggccgagaagtgatgaaaactcacactttgaacgcactaactccccaaacagcccagagacctcgcattctgcacacagtaccaaaacagccaggtgacctcccatctagggatggggccccctcaaacctccccaagccatgctaggacctcacacctcggacatacacccttcaacacctcagacacctcagggacttcccaccaggggcaccccaggcgcctcccgatggcctctccctctcaccccgacagtgacgggcagtgaggacatgtgcgtgcacttctttgatgtggagcgggcggccaaggctgctgtcaacaagctgcagggccacagtgcacctgtgcttgatgtcagcttcaactgcgacgagagcctactggcctccagtgacgccagcggcatggtcatcgtctggaggcgggagcagaagtagggtcctgtcggccctgctgctgtcctccatcccacccctcttactccagcctcgtgttgtaaataaagtttcggtggtcatgctgagggccggctcccagctctgccggggacggacagggcagagggcagcgggcagctccaggaacacggtggaacggggttcattgactcatttgtgcattcatgcatcgacggattcattcattccacaagcattgattgaatgtctgctgggttacaggccctgccttaactgttttacacacttatgcattcgatagacattagtgagccctgaccgtgtgccaggaactgttctaggcactggggatactgctctgacctaaactgatggaaatgcctgccttcattgggcttgcatcatagcggagacag

SEQ ID NO: 5714 - DNA, 1396 bp, Homo sapiens
ccgcctcatgtgtgaacatgtacagtagaggggtctcaggtgggctgggccatcttgcaggtgaagcacctggaagtgagcagtgcttccatggcagaggacctctgccggaagagcgccatcattgagacctacgtcatggacagccggatcggtcagtgtcccctccccggccctcagccctggtccagccttcacctggccctccctctccattctgtgctgcggcttctctcctctcctctcggaactcagcgaagctactgacaagaccatggcctgtggaggggagaacaggaaagcactgtctcttgatctcgcctcctccctcttctctctttctctgtcatctctccactctccattctccattgtgtctctctgtccactttctcctttcctctccctgtgcctcatcttcctctcctctctctctcccttctctcttctccgtttctctttttcaccccactccttcatcttgtctcgctgtctatattgttttccttctctgtatcttcattgcttttgctttctttcaaactttctccttcacagatttttctttattaatcagaatcatactgaccaacatgtgctgaggactttctgtgtgctctgtgcttcacatacagtcatgtgcatctttccagttccacaagttagttatcctcatttctcggggccatagagctagtgagtgacagagctaggttttgtatgtcaaagcctctgtcctacatgacatggcttttcctgctgccttctcccctggtattcgtctccctcttttctcctctggctctgcctggctctcctctggctctgccgagggggtggttttcagcctgggcccttgcagatgtgtctgtggcagcaggccacacagaccgcagcgggctgggcagcgtcctgagagacctagtgaagccaggcgacgagaaccttcgggagatgaacaagaagctgcagaacatgctggaggagcagctcaccaagaatatgcacttgcacaaggcaagtgtggcctgccagcctacccatctgttcacccagccacctgcctacccagccacatagcccctgggtcatctgccagtccccttgcccacccacccagcctgtcctcccagctatcctcctacccactcatcaactactccatcatgctctcatcttccaccctctcatcaacttattatccattcattccttccatgtacccgctcatccatttatctacacattcacccaaccatttgcccatctgtccatctacccaatctactacttacttatctcattgtctaccccatgtcctgccacccatttcttgacatatcattctcttatctactcatcaattgccccttgtgttacctttcacccacccagt

SEQ ID NO: 5715 - DNA, 1213 bp, Homo sapiens
cttggggcgcgtcatggtggagctggaggcgctgctgccgcctcccggagcggtccccgggggtgccggggtgtgggtgcctgggggccgcccgccggtgctgcgcgggttggtacgcgtgctgaaccgctccttcgagaaggcggtgcacgtgcgggcctcacacgacggctgggcttccttttgcgaccacccagcgcgctacgtcccgcgcagcccgccgtgggcaggagcgggaggaacaggagcaggagatcccatcctggatccggggctcggcctgggtcccggccaggcatccgcctcctcgcccgacgacggcggccgcaccgaccgctttgccttccagctgccctttgctgagggcgcgggcgatggggcgcgcctcgacttcgtggtgcgctatgagacccctgagggcactttctgggccaacaaccacggccgcaactacacagtcctgctccggatcgcacccgctcccacacccactgatgccgaagggctgccccagcagcagcagctgccgcagctggagccacagcccgagtgccagggtcccgtggaggctgaggccaggcagctgaagagctgcatgaagccggtgaggcgcaggtaatgtcagccagcgccacctccgccaacgcagggctgtgtctgggatggaggacaagcattccggcccaggaacccctcaggcctgctctccaggacagggaggagggtgcattgagtcagtcagtcaaagagtgatggaggtcaaacacgtgctaggcactgttttaactggggttttattcctccatttattgagttccactgtaaagccctgaacaagacagacatctaccctaccctcaaggattcatacaggctcctatgggagacagtttgaaaaaacaagcaagcaagcagataggataaatagggacaaagttagctgctgaagggagtaaggggatagattgggagggaatgactgtgtcagacatgctgttaaagggagggcctttgaggaggtgagtcccgaatgatgataaagaagagttatgcagatacggtggggaggtgggggagagtttgtaggaaaaggaacagggaggacttttctgaggaggtttcatttaaactaagtcctggatgatgaataacagttatgtgcatatatggaacaagggtgttctaggtagaggaaacagcaagtgcaaagtcc

SEQ ID NO: 5716 - DNA, 1151 bp, Homo sapiens
gtagcaaggaatgatttcttccagcttccttgaaatgaataattagtaaacttctaagcaaagtcaatgactaggagtttcacatgtttgtgaggtcctaactaattctcttacccagatgccacctccatgaatgatggtgctttaggcttctggaatatgtaaaaacagcaaagggaaccaagtctagactgcatactggtaaaccagggaagactcagaactgcatatgcatcctcatgcattcctttgtaaagaccaccagtactaaaataactggacactcattgtacctcccagcgataagtatgtgtaacaggccagtgtgttgtccccatgatcatgaattaggcttgggatgcttccaaatatattcaaggtgttggaacaggataggcagctgtgactccctcaagagtccttagaattctaaataaaatgcagagccatcctaagacacaggggtatggacaaggcctggtgacaccaaaggtgcttgtatccaattgaaaaggtgcctgtctcaatttcataccacctttattgcagttaaaaaaaaatcacactctggggacacttggtggaattacagagccaccatcatcattccaaccactatttcattttctgtagttttacctgtgtgcaattactccccctccattctgttccacttcttactccttagtaccaaatcctctgtttgggattgagcgctgctcctggttaatcattcctactacaaaaaaaaataactcccagggctagttaaattgtaaaccaaggctcagcagtctcacaacacatggaccagaggtgacacacagccatttcctttgccatgtggcccagttgctgctgccatgcctccatttccacactggatgcctacggcagtgagatttcactgccggggtaagagttcagcctggatgattttatagctctgttcctagcacttctcatcatccttccagcccagaatcagcggtcattctgcatattcccaccaaccctctacccccaaacacttcagtgtacctcattttaagagttgctgatccctgattctaggacgtttttacccatagttcttgtctttccaaaatctgaaattcttttttttgctcagaactgggtagccaagggtt

SEQ ID NO: 5717 - DNA, 1202 bp, Homo sapiens
gtgtgttcaagggctgggtgatgtctggaggggtctgaggtagggctgcacatgcttcaggtacaagacagtgagggcagagacagtttggtctcctgggaagggctcagtggcaggcagggacagtgtccagggcttctggagttccccggtaatgtccagggcttgggaggacagagccctagataaggagggaaaacatagcagtggaaggctccctgcttcccaccccctcacccagccccagcctctgtttccccaggaggggctgccatctccgccacggccagatcctgacccagaccgggctacctaatttgggaggcccagtggaaaatgaaaacacgagtctccttgtcaaaaactatgaaggatttcaaaacaacaacagcagagcatggagccacatggggagccctggtgagcatcagactgcattggttgcacaccccagaagctgtccgtcagaaaggctttgggtgggtctccgtgttggctgccgctgtgatttctgcttctctggtgcttgggtccatgcttggccacactgacattctgggactctgacagaaatccagttccaaagttttactggaacacacacacacacacacacacacacacacacacacacacacacacacaatggagtccccttccctttatgtctcctggtttgtggtctgggctgtggaagagatgagggatgcctgggactccaccacccctggcgtcataaatttaatgctatttggctggaacctccccggacacccttgtgcacatagcgggcacatgcctgtccttggatcagggtgggggtagtcaccataagccacaggagtgagtttgaacactgtgtgcagagggcacttgagatacggaagttccaccggaaaggaacaggaagcagccctcagaggtggggtgctggccaggtcacggcctcctcaggcctccaggcttgctggacactctccctttcacatcaccttgctgcggtggggcctcaccagggacccactccccctaccctgtaggggcagcgctgagagcacctgggaagagaggaggagagcagggaggtgagagcaccctggtgggaaatgggggcggactggactgcgcgtcctgcagaagggtcagaccggccaccctggagacggccaccacctcactcacatggcaaacaggagacctag

SEQ ID NO: 5718 - DNA, 1202 bp, Homo sapiens; identical to SEQ ID NO: 5717

SEQ ID NO: 5719 - DNA, 1191 bp, Homo sapiens
ccagccggcggctactgggcatggacgaggtcaagggtgaaaagcagctgggccgcatgttctacgcgatcacactgctctttctgctcctctggtcaccctacatcgtggcctgctactggcgagtgtttgtgaaagcctgtgctgtgccccaccgctacctggccactgctgtttggatgagcttcgcccaggctgccgtcaacccaattgtctgcttcctgctcaacaaggacctcaagaagtgcctgaggactcacgccccctgctggggcacaggaggtgccccggctcccagagaaccctactgtgtcatgtgaagcaggctggtaggcagacaggcagagagaaggtcatggccaccgtgatggggccaacagcaagggaggggtaggggcccatacaggagtcctcctttctgagctccagccccagcccctcgaaccacctgtaatctaggcacctttgccaacacctcccaaggatggaggactgggcgagggactgggaaagaggcatatttagttttgtggggcctgtctccgctgcctccttctccacttctacaatctcattctctctctctctctctctgtctctctctctctctctctctctctctcagaagtgacaattcagaaaaagaaaagaacactgagaatgcaggtttttctactaacagctgaggagacaggctttcttactttaatgtctctccttctgacactgtccagaagggggaatttgtcctgtaaaatagacttccagagctcttttgccccctctgctcccatgcaccctccccttccaagtcctttagcaaggcctggatgtttagggagaaagtggtccaaggctgctgacaagagggaccaaagggggtgctgggttcccagggagcagggatgtttaattactatgtcatgtgcaatgttgttttaggccaacccttgccccaagcccagtctcttctccctccccaccatgtccagacctcccaaatggttcttgtgcatctgttggagaagtcaagggagtagggagaagggccccaaggatgggcccaggttaggtgaagagtaagatgtgagctgaactcctcgaactgaagagacccacacttggtcacattctctcacgctgccttcaggatccccagcccccaactcttcttcctgaggatggaaatcc

SEQ ID NO: 5720 - DNA, 1163 bp, Homo sapiens
agatgataggtatgagccatggtgccccgccttatgttttgaggagctatcaaactgtttgcaaaagtggctatgccattttacagtcctatcagcagtgtatgaaggttccagtttctccatatcctcatcaacacttttcgtttgtcttttttattatagccatcctagtgagtatgaaagtggtgtctcattgtagttttgattttcatttccctaataactcatgatattgaatgtccttttatatgcttgtatatctttggagaaatgtctattcaaattcttagcccatttttaattggattatgtgtctttttattattgagttgcaggacttctttttttttttttggagacggagtctcactctgtcatccagggtggagtgcagtggtgtgatcttggcttacttcaacctctgcctcctgggttcaagcaattctcctgcctcagcctcctgaatagctgggactacaggcacacaacgacacacctggttaatttttttttttttttttgtattttagtagagatggggtttcctgtgttgcccaggctgatctcgaactcctgagctcaggcagtccacctgcctcggcctcccaaagtgctaagattacaggcatgagcccctgcacctggccagaacttctttatgtatctggatataagtcctttgtcagataatatgtttttttctttttttttttttttttttttgagacagagtctcgctctgtcgcccagggtggagtgcagtggcgcgatctcggctcactgcaagctccgcctcctgggttcacgccattctcctgcctcagcctcccaagtagctgggactacaggcgcccgccaccatgcccagctaattttttgtatttttagtagagacggggtttcaccgtgttagccaggatggtctcgatctcctgacctcgtgatccacccgcctcggcctcccaaagtgctgggattacaggcgtgagccaccgcgcctggccagataatatgaattataaatattttctcccattctgtgggttcttttcattttattgatggtatcttttaatgtacagtaggttttaatttcagtgatgtccagcttacctattttgttgtcacttgggcatttggtgttatatccaataaatcatcgc

SEQ ID NO: 5721 - DNA, 1960 bp, Homo sapiens
aggcagaggcagccagacagtggagaaaggaggagagtacagaagtaggcaaggagcgaaggcacatgggactgagcatatcctctcacacccagagagaaccattgactgggctttgggcaggtatgtagggaggagggtttgaggcccctggtcctggggcactagacccctcttaattctctccttacaattttatttttctttttctccctcctccttcagcaaggggactgtgtgatcagcaaagtcctgaccttcgacctcaccaagtacccagatgccaaccccaaccccaatgagcagtagcagtatttttgccctcccgccctgtctggatccctaagctgtccctctcccaatctctggatatttgactcccaaccttccccctacctcctggccctttttggtgtagtcatgggatttaggcactgctaatcaagcatgaagaggaacagaggtgatgttaggtctggagcaaaaattcctgaacgacagggagtattctggcctctgaaaggaggtgctgagctgaacagggccatctgttcatcacacacacccccttcctccccctcatcacccataatcgtgggccccttgggcctcttgcccactgtgtgtgtgggtatgtatgtgtgtatgtatgtatccgcatgtgtgcatgtgagtatgtttgcaaaataataaaggatattggagacctgttttagaaggagcctaggctgaatttgattccaagagagcttaggatgacagcacccctgagctgggcaaaggtactcaggacctcataggagtcttaggcagttacctgaaactgccttcattcactcatttgtgtattcattcatttatgtattcatcagacacataccgaacaccctctatttgtcaggctctgtgcttggaatacagagttgaatcagacatgatctctaccctcctagtaaggagatacagtgggttcatgaatgactatagttagctgaatgtcatatgtactttgaatttgagaagtgggtgatcccctctaggcttcctggaggtcacatttaagctagaccttgacaaattggtaggatttggtcaggcactaggagtggagcatgagctctggggacagacagttatgggttctggtcccactttttatcacttactagttgtttgaccttgggcaagtcatttgaccttctgtgcctcagtttcctcatctgtaaaatggggctaacaatattacctacctcataggatttaatgatgtcaagctcctcactggaggccttatcccttcgtggagcccactaggtgccgacccctcagaatataaccctcatgcctggacccctgagagcttctgatcccagctattagggacagaagaagcctccaaatctggaaggtgctgaatgccctgctgactgggaaagtttcagggcactgatggggtctacctggtaagcggagggcctgaggaaacctgtagcttcaatcatgtctggtaaccgggtgcctgagccccaatctgggttgtgaggaaataggggagaggtatcctgggccacatcccagcctaacacctgtgaggttcattttaggaactaacctcattagctataaggatcatgcagaggcagcaaagccgggtgcgatgagctcagcctttactcattcacatacaccatcacactttaattccaatctgtatattgctttttaaaagttaagtccattctaattacccaaatatgcatgaattcattctccttttgagaagttagattgttaaagatagtctcattcagctaccaaccactccttgatccttcccttcttagtggctgttgtttgttgtacttccgtttagactttgttttaatgcttgtacgtacatatgtgaactcattggaaatattgtgtgtttaatgcaaatgatatattgaattgtttagca

SEQ ID NO: 5722 - DNA, 1100 bp, Homo sapiens
aagctcaaaagacctcagcaagatgccctgtggcagcccaggagataggagagagaatattgggctttccctcttcctatattttatatcttgccttcctctttctctttctcccaggttcctccggtttaggctcagctagcagcatccaggcagctgttcggcagctggaggctgaggctgatgccattatacaaatggtacgtgagggtcaaagggcgcggagacagcaacaagcagcaacggttagcatgatgcctgtggcccctcattcatttgtctctccactcatccccccaccatgtcatcagtggggtttcattgcctttaccttgtatgcttttgcattaagtttgctatatgaatgcttctggacaaaagggttactttctgttggtgttttcctatttgttgattggtttgttggtttgatttgatttaaagcttggccatcataccccactcccagctatccagtcaacagtggcgcttttgcaaactgcctgatgctaagtgttgtctgggttctgaggggttatggggtgaagttttttttcagtcccatggaacaatgcaggtacatcagaaacatctcaggaatcctaccattgaaagtcccccaagcttggtacatatcccacacagccacttctgtctgtggctgctccctccaccctgccctctgcctttattctccataatcccttggcacctaggcactcaggcacttttaggaggaaaccttcaggtacttaagtagccagctcagtgttggggtcccggcattgagtggctgcagtaaaagcctggcatcacatgtgtatgctgtggcactccctcattgttttcctgtccttgcaacatgtaagttacctttccaagatccaagaaaggtatcctaagacccgatatttctttgcgtataattactattatacagtatggttttattgagtaggcagggaaaagccttgaacttaggggcagtgactccaggaaggtagaaagggaaaataaagctgttattctggagtattttttctgccgagtctctttcccattacacgaaaagatgtcggctttttaaataatcccgctca

SEQ ID NO: 5723 - DNA, 1127 bp, Homo sapiens
aatttataaagaaaagatatttaagtggcccacagttctgcaagctttggaagcatggtgctagcatctgctgggcttctagggaggcctcaggaagttcacagtcatggcggaaggttaagtgggagcttgcatgtcacatggcaggagccaggaggtggagggggtggtacacactaactcactatcatgaagacaacactaaacaatgagggatccacccccatgacccaaacacctccagcattggggattacaattcagcatgagatttgggcagagcaaatattccaaactgtatcactgcttaaggttgagtaaaatgcctcttctctgtgcctccttagacctcctcatgttggccaattattttgttgctggtactagttgtggaaggactgttccataggtctttaacttaatccttctgagctttgaattgaagcaaaatgattttcacacacttttcaaattacttacaggcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacaggtagggtactggcctcacactccagggtccagactttgcacccaatggagtgtgatgcttacggattttctaagctcacataccactgagtccctggtcacattaaccaggagacagtttagatttcctccttctcttagtatttattttttttctcctgaggaaaactggagtatagtcctgatgctctgcacaggtaatactcctttcaagcatgttgatgagtattctcagtagcctcctgctgcctcagtggaggcaaactgtcctcagttactttctggttaacctgtaaagagaatggatattgtgaaccagatttattctccaacaagagctttctgaaaccttagtcacctacaaaacttttgttttcacttgcaaataaaatgtataaggggcattttaaaaatt

SEQ ID NO: 5724 - DNA, 1275 bp, Homo sapiens
agcatctagcatgtgccatgtgcctaacacagctttaaaccagtggcaaggaaaattttgctggctgaggatggagaattgatttcacaggtgatgcttaagaatctcaatcacagaattcctgtggtttgacaatataagtttgagataatttctggatttttagtttagaagaatttttattagataactctaaaaatgaatttttctgataaaatggattctggcaaggatagttctcttgtcttcgtagatcttagaatgtaaccggagttctccatctaaagacctagctctaggggttttatggtgtctattggtgttagcacatatatctagatgggtatgacaatgaactacagcacttttagctcagagtatgatctttctcatatgggcaagggtgggacgtgaacttgtctaggtgtcatgctcagcaatctcttgtaacaaagctcagttagaaagcacccatgcggcgcttctaccttattcttacatcctctttttcctcccctctccagtgcgagttatatcactgggtggacctgttggaccgcttcgatggaatactggcagatgctggacagacagtggagaatatgtcatggatgctcgtatgtgataggccagaaagagagcaactgaaaatgcttctcttggctgtgttgaacttcacagccttgctcattgagtacagcttttcccggcatctgtacagttccatagaggtaggggaggttaaagcctgtgtaccctgttcttgactagaattgtgtacatccagaaataaggaaattgctatttctattgcttctttccttttcattgtggagctctgggtttttcattgtcaaagataatagtagaatgtttcttggatatagatactatccttcatagggttgatgggaagattctgtactatcacctttgctttgccttttcaagattcaagaaatgaatgagaaatgttatatatgtattaaagtatttaaggaaatttgcatgaattgatttttgccctaggttgttagagcagccccacattacttttaaattcctagaaatagtttgattttctcatcacattaatgtacttactactcctctaagtgttagtgtgctgctttaaagtctctctgtactctgccacacccatcccaaaatatatattcatagcatcctttgtgtccttgaagagtaaggtaggtgcagcaatcagtgagctttttaattggttaaaaatcactgtaagaagaaattattttcttt

SEQ ID NO: 5725 - DNA, 1156 bp, Homo sapiens
tctattccaaaactgtccacatatctttctccacaatcactatcctagcccaagctctcatggtctcttgcctggactgtctaactggtctcataactagcttcctagatggccttcttgtttccagttttgctcccactaaaactcattctccacacatcagacagagtaagctttaaaatacaaaattcagatcacgtcactcccagctcaaaaccctccaatggcttttcattgtacctcgaataaaagctaaatcccttccatggctgacatggccctacactagcttactccagaacttctttcctacctcatctagtaccagtctttcctcttgctgcctccagttggacttctttctggattcccttaaatacaccaagctcatctgtcaccctgggatgccatgcctctgggtcctcatgaaatgactgatgtcttcttgtcattcaagctcacctcaactctcacctccatggagaatccttccctgactaaactatttcatcttgttctccaccctcaccccattacactaccctttgtcctttttttaaaattgttttcaaagtatttttgactttgtgaaatgacttttgttcatgtatttatttgattgtttgtgactgtcatcctctctctaaaatgtgagatctaggagagcagggaccttcttcaccactcagtagccagcacctagaacagtgcctgacacctcactctcctgatttaaggactgaacataggtgagacagggagaatgagagcgagtctagttccaggcaagtagaaagtggccagatcagggaagaaggaatagcagaggaaatgggaacacactctcattcatgtttttgccaccattatcaacctgtaggtcattactataatgaatgaactcccacaattttcagtctttccttcagtatattattaattaaattccaagcaattctagattgtatctaccattttgctagggctggacagatccactaaagtagttctccatctatttttcattattgccccctaaaatgttaatatcacaggtatattatatatttaataactatttgcatatttgcaatttatacctagaaagagtaagtataaaagttactctttttattcgatacagggttaagaataa

SEQ ID NO: 5726 - DNA, 1194 bp, Homo sapiens
tgctgtaaaaaattagcacagactttgtggcttaaaacaacacaaatctatcatcttacacttctagaggtgagaggtcccaaatgagtttcactgggccaaaattggtgttgtcagggttacactctctccagagactctaggggagaatccatttccttgcctttttcagcttctagaggctgcttagattcctagaataatggcttctttcctcatcttcaaaataactatgtagtatcttttttttttttttttgagacggagtctcacacactgtcgcccaggctgttgtgcagtggcacgatctccgctcactgcaacctctgcctcctgggttcaagtgattctcctgcctcagcctcccaagtagctgggattagaggcatgcgccaccatgcccggctaatgttttgtatttttagtagagatggggtttcaccgtgttggccaggctggtcttgaactcctgacctcatgatccatctgcctgggcctcccaaggtgctgggattataggcgtgagccacgacgcctggccaacaatgtagtattttttctcttttctgaacctctcttccaatccttatatcttctctgactctgatcttcctgcctctcacttaaaaggactcttgtgattactttgcatgcattgggatcatctaggataatctccacatctcaatatgtttaagttaatcacatctggaaagttcctttaaccatgtaaagtaacatattcaaaagttttggagattaggatctgtagatctttgaggatgggaggcattattcagcctactgcagatgtaatttgataaatttttgcttggaatttttgcatctacataaggatattggtctgaagttttcttttgtttaatgtctttatctttggtatcggggtaatgctgacctcatagaatgggttgggaagtgtttcctgtttttggaagagtctgtgtacaattggtatcatttcttaaattttagagtttaccagtaagttttatttgtgggaaggtttaagactacaatttcaatttttaaaatatatatagggctattcaggttatatttcttcttgtgtgaggattggtaattagtattttaaagaaagttcttcatttcatgtagtttatcaaattaatttttgtaaagttgttaatatcctcttatcattttgtataa

SEQ ID NO: 5727 - DNA, 1171 bp, Homo sapiens
acattttggtttaattgattttctctgttttctgttttctaattcattggtttctgctttatctttattgtttcgttttgcttattatccaaaaagtttatgatttttgtattacttagaactgtgttatttaacttccacatatttggacattttccagagatctttctgctattgacttctaatttaattacattatggtaaaggaatgtactttatatgacttgaatatgttaaaacatatcaaaacttgtttcatggcccagaatatggtctgtattggtaatatgtttcatgtgcacttgagaagaataaattttgctgttgttgagtagtcttctataaatgtcaaccaagttaagttggttgatagtgtttttcatgtctactatatccaggctgactttatgcctacttgttctatcagttattaagagaggactatcgaagtccccaatgataattgtggatttgtctgttattttttgtagttgtatcagtttttatttaattgattttgaacctttcatgctaggtgcatagacctttaggattgtcatgtcctcttagttaactgaccccactatcattctgaaatgaacttccttgtattctttgttctgaaatgcattttgtctagtataaatatagctgctgcagcttttttgggctagtttaactatggtatatctttttcatccttttactttttatgtatttgtgtgtttatgtttaaagtgcatttatcataggcagcatatagttggttcttgcttttttatccaatttgacagtctctgccttttaattgatgtttggatccatttacatttaatgttattatcagtatggctaggtttgagtctatcatcttgctatttgttttgtatttgttccatgtatgctttgttcccttttctccctttttctgccttcttttggattactgttttttttaatgattccattgttttttcttccttgatttattagctgtacctcattgttttattatcttagtagttgctttagagtttatagtataaatgtttaacttcctcctcctggctttcatgctagtgtcataaattttacttgtagattttataaaccttaaaatacattgttgttatttttgtttatactttaagtcctcttttaaagagattta

SEQ ID NO: 5728 - DNA, 1175 bp, Homo sapiens
tgtattgaatgatctccagtactacttgaaatattttctggattgctagcagtgcagatgctatattgaaaacattcacatttgtgaatgtgactcaagacttagaatcattatcaaatggatttttagtctggcatccaaatagcaaatggtcttacagcaagagcaacagatactggtaagttgcttattaagtcagtttccaatactcacacaatgcaattagctgagaagtattatatctttaaagttataatgccataataatgctacttatgaagcaatgattacctttttccaattcctttctgttaaataacacctaaataattttcagaaagcacaatctagtcatttgaaactttgtgcaggaaaaaaaaaaatcataagagcccatgaatcagttgagcctgttcttgtagctaagctaattttttctccattcatgaagagatacattaattatgtagcaaaccattaattttcaaggtaaagtctactaagttgtacttctcttttagtttggatcacaagactataaattatatcctgtaacatctgtgtggtccgtgcccctcccacatttataattaccactactgttaaagttagcttcagagtaacgtatccaagaaattcagaattactctaatatttacgaatgtgatttaagaactctcctacatcaatctcgctacatatgtaagaacacaaatttgtttaaattaccatcctgtaactaattcatgctgtataaaaacctcaggggcccttatcttgaatcagaaacttttgataccaaaggcatagttaaaatatttagttggccctaaagcacttggatttctccaagcttctcattcttacagtttacatgaaattcccatctagaggcttaggtgcaaactgtccttatcacaggatttaaaaatctgatttgattcagatggtccaggtgagaggaaaacaaaatgtctgatctgaggggctgtggggaatactgggccttttgaaaccccattgtgacttagacgtattgtggagacctggcttgtggaacaagcagatactagatcataactataggtattaaaaggtgatgacttttggcccagaggcacatgggattagtgacctggaatcactgttagaatctttggaacccagtgccattt

SEQ ID NO: 5729 - DNA, 1218 bp, Homo sapiens
ggatgtgggcgtggtgggcgcccaaaccgtggcagcaggaccggcaagtcaagtgcttctgctcctgatgtggataacccagaggcattcccagctgtggcttaactggatgccataagacaaccctggttcctttgtgaacctttctgttcaaagcttttgcatgcttaaggattccaaaggactatttaaaaaaaaaaaaaaagactgtcattcataccattcacacctaaagactgaattttatctgttttaaaaatgaacttctcttgctacacagaaataacaaacacgttatttgtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagttttcacttcatttgtgtttttaaattaaggatttagaagttcccccaattacaaactggttttaaatattggacatactggttgtaatacctgctttgcatattcacacatggtcaactgggacatgttaaactttgatttgtcaaattttatgctgtgtggaatactaactatatgtattttaacttagttttaatatttgcatttttggggaaaaatcttttttcacttctcgtgatagctgttatatatatatatgctaaatctttatatacagaaatatcagtacttgaacaaattcaaagcacattggtttattaacccttgctccttgcatggctcattaggttcaaattgtaactgacttacattttcaactatatttactttttaaatgcataattttcccattttaaaatctaaactagacatcttaattggtgaaagttgtttaaactacttattgttggtaggcacatcctgtcaagtgaagtagttttataggtatgggtttttttctccctctccaccagggtgggtggaataagttgagtttgccaatgtgtaatatttaaactgttctgtaaaataagtatctggccatttggtatgatttctgtgtgtgaaagttccccaaatcaaaatggtacatccataatcagcaaccatttaacccttccttgttctaaaacaaacaaaaaccaaagggcactggttggcagggtgaggcgggggagtattttaatttttggaatttaggaagc

SEQ ID NO: 5730 - DNA, 1177 bp, Homo sapiens
tattaaagttgttcttttggttttacatggtataatggaattttttggttttgtctgaagcagtggtactgaatgactttataattgatcccttgcatttgcatcaaaagctttagtttcactggaaatgctgacttcaacaattgcaaaaaaaaaaaaaaaaaatgaaggtagtgactttaaaagtaggaataaagtgtatggttgtccaactactgcaggggaaaaggtcaaatagatgaagaaggaagaaaagaaagaaggaaagaaagaaacaataagaaagcatggtaaagaaacaaaacaatggtaggattaagtccaaactgaatgtagggatgaatgagttaaaatcacctttgagaaaatagtaactcttagagggaatgggtccaaaaaaataaagctatatgccaattttatagcttaacacagtgacacagataggaattgaaaaaatatgccacacaagtgctacaggaaaatacaggtactcacctacacagagtgaacaggttttaacattcggctgtatttgcttcagagatgtctctgtctgtctgtctgtctgtctgtctctctctctctccccctcgccacccctctcttctctctctctccaataaataaatttttttaggcacaggtaaagttcctcagcccataatatttaccttctttcttacacagaggtaagcactacccagaaaatggtgtgtttacttcttgtctatgtctttagacatatatatgagtgtgtgtttgtatgtatatgtgtatataaatattcacaatcaaagagtattaatgttttttaaatggatataaccgatagactgtatatatcattttgcaacttgaattttagattcaacagtgttttggagacagccatttcgatacatatggatctagttcatgcagtttaactgctgtatacaaaatatttaattgtatgaattaccacaccttatttatccatttccctactggtgaacacttaggttcttcccagcattttgcggcaatgaacatactaaacagatgtgcttttgtgcacatgtgtgaagttctctagaggtaagtatatggaagtgaaatttctgggtcctagggtttgagcatcttcaccccaactagatattgccaaattgctttccaaagtcattgtacttgt

SEQ ID NO: 5731 - DNA, 1253 bp, Homo sapiens
tatataaagtttttattctcctagtagattgaaagctccatgaagccaaagaccaggtcttaaatatcccctatttttgcccgtaaatcctaatacattgaaggaactcagtaaatatttatttattgaacagtgaataatagcacttctgccaattggtaagatgggcataaaatggtatttcctgactactgcttgttcacttttgagaaaattcttccctgtatagtttgcattcataggtctggatatgtgaatgtaagttttagagttgtgggggggacttaggtcatgttatacacctaccatgtttttaaatgggaaacctgaggttttgtttaaggttaccatgccaggtttttctccatttcatatttttctttttatccatttatcacatttgagtacctgctgtgtatgagccccaaaaagcaaatggtccatttcctttatgaagtaagaggcaaggtcattttctgaaaagggtggagctggggaatagtgctctggaggattgagaagattggagaatttttaaaagttatggcagagtctacggccataccaccctgaatgagcctgatctcgtctgatcttggaagctaagcagggtcgggcctggttagtacttggatgggagaccacctgggaataccgggtgctgtaggctttggccgggcgtggtggctcacgcctgtaatgccagcactttgggaggccgaggcgggcggatcacgaggtcaggagatcgataccattttggctaacatggtgaaaccccgtctctactaaaaattcaaaaaaattagccgggcgtggtggtgggcacctgtagtcccagcttctgaggaggctgaggcaggagaatggcatgaacccgggaggcagagcttgcagtgagccgagattgcgccactgcactccagcctgggcgacagagtgagacaacgtctcaaaaaaaaaaaaaaagtggcagaaagtgaaaaagaaaaccacagcaagattggtgagcagatttcaggagtctgctgcaagtgatttttattttatgtattgaaacacatctgcctgttttgttactttgccctataacttggctactggagataagcacagagaaagtgaacggtaggaatgatcaatggttagaatttggcctagatgagtacaaaaacatcattatcattatcaataacaataacatcatcatagtgagttcagaggttttgtggttttggcaagagtgtaacagc

SEQ ID NO: 5732 - DNA, 1242 bp, Homo sapiens
agaagaaagaagaaaatggaatagcaggtatttaagaaactcagagggaaaaaaatgtgagccaaggaacattatacctggtaaaactgactttcaagtataaagagtacagatatttatcaacatgcaggaattcaagaaatattgttccaccatcccatgaatttgctagagaatgagcttcagacagccaaagtgttgagagacattgaaataaggacaggtagcaagcgttaaatgtacagttacttgtagaattaagatgaaatgaggattaaaagggagatagagtatgtaatgcctatgtgcccagataatgtagataactttttaaaaatggagaaatggggaaatcatgcaaaattttaacagttctcagtaattatattggtggagtgtcaaagttagtgttattattccaagactatgtataatgtgagataatataaatgagcagttattagataatctaattctatcatcctctgtctttgagaactaggacttttaatgtgaaagaatacagatgtaattccaaagaatttagattttttttaaaccctgtagtactccatatgaactcatgagaaattttatttaaaactaaacacacacacacacccacccctgcttttgctctattcactgaaaaggcttagaaacaaggaccagcccagtagcaatgagtatacctagtaactccaattgtgatacagaaatattcttcccaatattctttcttttaagaaatcagggtgtcttagagaaataactgactacaattctggggcaggaaatatacaaataagcttggaacatcttgtcataaaagatagggaaggagctttcaaagactactggggtcatatcgagccaatttaaagatgtttccactggccaattcggtttcacagaggataattgacagtagcaacaagtccatccaacacccaaatcttggtttctaataccatcctctaataaatgaaccagggctccttggagaaatagctgattctagggctgaggcagggaatatacaagatgaacctggagcatctcgtagtcagatgatagtcaacgtatgatggggttatatcctggtaaagccattctaagttgaaaatattgttaagttgataatgcatttgctatacccaacctacccaacatcacagcttagcctaacctaccttcgacctgctcagaacacttacgttagtccacagttgggcaaaatca

SEQ ID NO: 5733 - DNA, 1230 bp, Homo sapiens
attactctattactgagttcttcctaagttgttttattttgttttatgttctttttattgcttcttgagttgaaagctgagtttacttcttttcttctcctttttaaaaaagcttttcaagcatatacagaagaggtcaggatggtataatgaatgcctcccccaatatacctgtcatgaagtttcagcaatgactaatttatgaccagtcttgttttgtctatataatacccactttctccctctgatattatttgaaacaaatcacggacatattgttttatttttttcagtttgtatctgtagaaattaagaactcttaaaatataatcacctaggtcaggttcagtgactcatgcctgtaatttcagcactttgggaggtcaaagcaggaagattgcttgagaccaggaatttgacagcagcctgagcaacatagcgagaccccaccatctctacaaaaataaaaaataaaatagccaggtgtggtggcatatacctgtagtcctagctgaggcaggaggatggctggagcccaggagtttgagactgtggtgagctgtgattgagccactgcactccagcctaggccatagagtgggaccgtctctaaaaaaaaaaaaagaaaaaaaaatatatatatacacctaaaaattaaattaacaataatactaatgccttaaaattacatatctagtcagtgttcaaatttttaattgtcttatagattttatttatttggatcaggatacaaacaaggtccacacattgttattgctcaataggccttttaaatgtcttttttttttttttttttttttaagacggagtgtcactctgttgcccaggctggagtgcagtggcatgatcttggctaactgcagcctctgcctcccagattcaagtgattttcctgcctcagcctcccaagtagctgggattacaggcacacgccaccacgtccagctaatttttgcatttttagtagagatggggtttcaccatgttggccaggctgatcttgaactcctgatctcaggtgatttgaccacctcaacctcccaaagtgctgggattacaggcatgagccactgcacccagccaaggcctaaatgtcctttaatctctaggtacctcctccatctttctttacccctcaagtccctggaatttgtttattgaagaaatcaagttgtcttgtagaatttcccatagtgtgaattttgccaa

SEQ ID NO: 5734 - DNA, 1165 bp, Homo sapiens
acttttttttttttttttgagacggagtctccctctgttgcacaggctggagtgcagtggtgcgatctcggctcactgcaagctccgcctcctgggttcacaccgttctcctgcctcagcctcctgagaagctgggactacaggcgcccgccaccacgcccggctaattttttgtattttcagtagagacggggtttcactgtgttagccaggatgatctcaatctcctgacctcgtgatccgcccatctcggctaagacataactttttgaggacattcttgagatcattcttcattatggctgatattatcccaccttttccatgtctccaaggaaaaaactcagattctttgcctttgatcctttctcactctacatccaatcagatgtcaaattttctcccttcaagccccaatatatttcttttttgtctttctccacttttgaaggatccaacatatttcttgattcctgtctcttctttctgtcttcattgcccttatactatgtcaggcctttataattattgtctgtagtagtagagcagcttcccggtctctgttatctctctctctctgtcctccaattctgtcttacactcccagaataattttccctcaaacctagttctaattgtgttactttcctgtttaaacacttaaacgcagttcccattgcctagtaagagaagtgctatctcaagcacttataatctggcctgcaacctaccattacttccccttcccctgtttgcactctgccatctactcccattttattcagtagtcttgttccagtcttttccaactctttgaccttctttaaactattccttcacactgttttgaaggaaagaacccatcatgttttatgctgttttagacatgaaaattaggaccagctggcagaagggatggcgctaaaccaaaaaattttctcggctgggtgcagtggctcacgcctataatcccaacactttgggaggccgaggtgggtggatcacttgaggccaggagtttgagactagcctggccaacatggtgaaaccccgtctctactaaaaatacaaaaaaattagttggatgtggtggcgggcacctgtaatcccagctactccggatgctgaggcacaagaattccttgaacctgggaggcggagcttg

SEQ ID NO: 5735 - DNA, 1199 bp, Homo sapiens
ggcagcttagcagatttttagggatcctggaataatcctttatggttaatcagaacataagatctggttcagaactatttttcttctgtctttggcagggaaatgaaccgaaggcagacatatgaacaagcaaataagatctatgacaaagccatgaaactggagcaggaatttggagagtactttacaggtaagactcctgctgccctgcggggggttctggggaactagccaggtacctgtttctataagtgtctcaaagaggtgtagacagaatgtagaaaccttgcacggagtttccagttgcttttaagtttttgagcacaaacctttccaaagcacacaagttccccgtgtccagccatagcagttcagccagtttatagcataaaccactcaccaaatgcttccttgaattgttggtttgttcattttgtcttgtccttactagattgtaggctccctgtattactctgtctccctccgtttcagctccactccccctcccccagtactttgctttgcatgtttaggtgctgaataaacgtttgttgatgatgatgattcctcggtgtgctgttcaagttgtctgttggggtgtctgtctgtctgtctgtgtgtgtgtgtgtgtgtgtgtgtgtgtaaggtcagttcctgaaacattgggaaggtttctatgtaatacgttcttcaccttttgaagtacagtgacatatatatacataaatatatgcaaggcagtgccgaatccattctagctggtggtgacactaggttaactgtgtaaagaattcataaatgtcctcacacaccttgggtcttcagagctccctttaccatcagcatccatgtccttgtttgctgggctgacctctgacatacagcagatgtgatgggcccaggagcgctgcctcttgccagaaattgtggctttcagttctttctgtggagaactgcgattttccaaatcttttagtaaggctgctttagaataacaagctgctggccttatggcacccaagaacaacatgaactgcaaggtctggcacatagtgggtgctcaataaacatcttttgaataaacacatttttctggtcattactacttagtctcactgtctcagtgagttgacttcaagccctggacttggggtaccttgttggttgcccttactgccctgaacacacaggcagccagc

SEQ ID NO: 5736 - DNA, 1199 bp, Homo sapiens
caaatgtccatcacctgggcatttaataaactatattacatccacacaaaggtctactataaagccattataaagataagagagttctaaatgaagatgtctgattgaagatgtctgattaaagatatgtgcttatctccctcccttttgacatcccattaaaatggtaataaaagaataagcccttaagagtgaagaaaatgggcttaacaaatttttggaagattggaagtgtgtcaactgatgaaacagaatggaacaagccaacgtgcctggcagaatcccagagaggttcctgtttcagagctaggaagtgctcaaggtcaaaataagaagggagtccgaaaactagggggtgaactgaaaacctgtgaaagaagtgccccccagccctaaaggccaacccttttggaggtgcttatcatgcaaaaggaatcgtgctggaaaaagtaggagttgaagccaaacagccaaattctgccattaggaagtgtgtaagggtccagctgatcaagaatggcaagaaaatcacagcctttgtacccaacgacggttgcttaaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaaccctgtagtaataaattttcatatgccaaaaaaaaaaaaaaaagaagtgcccccattggctccttatgatccccccacccatcatccccatatttagcatagttagcccaatctttatctcctagccaaaaaaaaaggagggaagggaagggaagggaagggagaaaagaaaaggaaagaagagaaaagaaagaaaagaaaaggaaagaaaggaaaggaaaggaaactggaggactcaacagaaatagaataagctgcctaaagaaaactaaggatcatgtaggtgctagtgccacagagcaaaataaaattcttcctaatttggcatttgagggcctccagcctaaaggcagcttccctaacctaagtctaaaagagaaagtcatatgtagaaagctgaaactggatcccttccttacaccttatacaaaaattaattcaagatggatcaaagacttacatgt

SEQ ID NO: 5737 - DNA, 1181 bp, Homo sapiens
caagaacagcctgaccaacatggtgaaaccccatctctactaaaaatacaaaaattagcggggtgtggtggcacatgcctgtaatcccagttactcaggaggctgagccaggagaatcacttgaacctgggaggcggaggttgccgtgagccgagattgtgccattgcacaagagtgaaactccatctcaaaaaaaaaagaaaagataaataggctgggcacagtggctcacatctgtaatcccagcaatctgggaggtctaggcaggaggactgcttgggcccagtagttagagaccagcctgggcaacatagtgagccccacctctacaaaaaatatgtattaaaaaaattagacaggcatgatagcacactcatgtagtcccagctacttgagaggctgaggctgcagtgagctgtgatcacgccattgtattccagcctgggcagggagaatgagaccctgtctcaagaaaaaaaaaaaaaaaaaaaaagataaaaataataaaatgttaaattctatcatttaaaaatcaacataagattaaaaagaaaacaagtgctctgtgctcccaaacgttgaaataaaaaaaaaaaaaaaaaaatgaagccagcatggtggctcaggcctgtaatctcagcactttgggaggctgaggcaggaagatggcttgaccccaggagtttgagaccagcctgggcaacatagcaagactcggtctttatttaaaaaaaaaaaaaaaaaaaagggtaggggggaggggaggccaggtgcagtggctcatgcctgtagtcccagctacttgggaggctgaggctggagaatcacttgaacccacgaagaggaggttacagtgaggcaaatcataacactgcactccagcctaggcaacagaatgagaccctgtctcaaaaaaaatagagaaaaaaataggctgggtgcagtggttcatgcctgtaatcccagcactttgggggactaaggcaggccagatcacctgaggtcaggagttcgagaccagcctggccaacatggtgaaaccctgtctctactaaaaatacaaaaaaattagccgggtgtggtagcttgcacctgtagtcccagctacttgggaggctgaggcaggagaattgcttgaaccaaggaggacgagattgcagtgagcagagatgctgccattg

SEQ ID NO: 5738 - DNA, 1170 bp, Homo sapiens
tcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaattttctgtggtgtttttgaaggggaaaggagggaggggagttatcttaggagatgagcagtagactctataaaggtaatcctttatgacctttggattacagtattgatctagacaaacatggggaggaggtggggatgaggtgcatcaaatggctggaggggttggcaaggattagcgctattgatactacatggaagtaatgatggaggaaagctgcccctctgaaagaggaagaaaatgggcttaatcctcatcgagctgggggcgcggggggggtctcaaaattggtatttgtttcttagcagctgctgctgtgtccaaggcttggaattgctgtggtgaatctaaaactgtctcagtagtggtgagctgacctcacccaagttcaaagccctactctgcctgatccttttttcctgagcctcagagctaaaatgcccccgagctctttcctattggctggaaagacgaattgaagttccc

SEQ ID NO: 5739 - DNA, 1201 bp, Homo sapiens
cccatcaaactccggcagttccatcgcccacctctgaaaaagtactcatttggtgcactttctcagccaggtccccactcagtccaacctttgctaaagcacatcaaaaaaaaggccaaggtataattgaattctggttagaaaacagctataaaggatattggggtataaattaagggaatgtaccaggtattagattgtattagggaattggttattttctcagatgtgatagaatgttattttggttatttaggagaatgtctttattgttaggtgatgcatgtgaaaatatttaaaggtgaggtgtcagaatgactgcatctttcaaaaactgtccagcaaagtctatagaaagataaaagtttaaaaaaatggcgaaatataaacagcgacgtgggataataagtgttcatagtacagtcgtccttcgttatctctgggagattggttctaggaccttctctggataccaaaatctttagatgttccagtttctgataaaatagcataatatttgcacataacctatgcacatcctctcctatagtttaaatcacctctagattacttataatacctactccaatgtaaatgctatgtgaatagttgttaacactgttattggttagggaataatgacaagaaaagtctgtacctgttcagcacagatgcacttgtattttctgaatattttctatctatggttggttgaaatcacggatgcagaacccatacatggatatggagggccgactgtactattctttgaactttacagtatgtttgaaaattttgattatgaaattggaaaataggtaaaatgtttttggtgtgtttgtctcagattgaacaacgtcattgtgtgtagtagtgtcctgtcaggagctagatggtattttctttgttctggacagatgagagaacaagagaggcaagcttcaggtggtggagagatgttttttatgcgcacacctcaggacctcacaggcaaagatggtgatcttattcttgcagaatatagtgaggaaaatggacccttaatgatgcaggttggcatggcaaccaagataaagaactattataaacgggtgagtctctgctcagaaaatttttttcccatacataattctgcttatgcttccataaacttttatgtacaaactttttgttattaacatagctgtagtgagacaaactg

SEQ ID NO: 5740 - DNA, 1238 bp, Homo sapiens
tcggaaggctgaggcaggagaacagcttgaacccgggaggcgtaggttgcagtgagcggcgatcgcaccactgcactccagcctggtgacaaagctagactccatctcaaaaaaaaaaacaaaaacaaacaaaaaaaaccctcttatttctgtgacatttgttataatgtctctttcttttcttctcttctcttctttctcttctcttcttttttttttgatacaaagtctctgttacccaggctggagtgcagtggcatgatcttggctcattgcagcctccgcctcctggattctctctcttcagcctcccgagtagctgggattacaggcacccgccaccacgcccagctaatctttgtatttttagtagagatggggtttcaccatgttggccaggctggtcttgaactcctggcctagtgatccgcccgccttggcctcccaaagtgctggaaatgcaggtgtgagccactgctcccaggcttcctctttcatttctgattttagttagaatctttcctctttttttcttaatctagctaagcatttgtcaattttgtggatcttttcaaaaaacaaactcagttttattgattttttctattgtttttctatttcatttatctctgctctaatctttaatatctccttccttttgatagctttaggtttagtttgttctcctttttctagttttatgaggtgtaaagttaggctgtttatttgagatctttctttaatgtacgcatttacagctataaacttttctgttggtactgcttttgttgcatcccataagttttggtatgttgtgtttttattttcgtttgcttcaacgtatcttctaatttcccttgtgacttctttttaaaaaaatttcaatagctttaggggcacaaatggtttttggtaacatgaatgaattatatagtggtgaagtctgacattttagtgcacccattacccgagtagtgtacattgtacccaatatgcatatttttatccctcacccctctcaccatccccctttccgagtctccaatgtcccttataccactctgtacgcttttgtgtacctatagcttagctttcacttaatggcctccagctccatccaagttactgcaaaagacattattgtgttcattttttatggctgagtattccacggtgtatgccacattatctttatccactcattggttgatgggcacttaggttggttccatatcctt

SEQ ID NO: 5741 - DNA, 1144 bp, Homo sapiens
agcaacacagcgagattccatctctacagaaaatttaaaaattagccaggcatagtggcatatgcctgtggtcccaaatacttgagaggctgaggcaggaggatcccttgagcccaagaggttgaggctgcagtgagccatgcccacaccactgcattccagcctgggcgagaccctgtcccaaaaaaaaaaaagaggaaaattcaagtcaattcagacttagcaggggtggggagggggctcacaggcattctcttccagtatgtatgagtccttgatccagtagagccttgaaagaatgtggaactacaatgagtagtcagggattctgatgccctgggagtgggttacctggactcagccagagtgctgcagatgggctgctggcctagcctccttgctggcctagcctccttcccggcctagcctccttcccttccccaaggctggcctggaatcattctggcctcggggtagaggggaagtggcagccatcagggcatttccctcctgatcccactgtccactggctgtttggggtcactgtcctcagcattctagtagcgccccctctgaactccagctgcttcttcacaactcactttatccaccattcgcattacgtatttttggcacccattttcctgtttaattaaatgtacatatacatatgtgtattttttagatcctaattatttgccagagttaagaggccaagggtatctttttgcctaacctggacagggaaattctcatgtttattcataaaatgaccaagatagcaccagttctcctacctttgagtccctcgctggaatataatccaacacaaaaaggaggcctgttctatgctggagttagtctgaggaaacactacactcggagagtctttgctgtgagttacattaatgcccctatccactagcagagcccagtaaatgacagcagcaaagtcttcatgtcctgagctcatttagccagagaaaagtttttaagctaagaagtcatagactctcaaggttattctcacagcattgctgattgtcccctctgaggcgtcccttagccctcagccttctcgcgaccctatagtttcaagctaactccctctcacctctcagtggctactgaccccacaagtcct

SEQ ID NO: 5742 - DNA, 1192 bp, Homo sapiens
aaggcacacgtaggttggaagtaaaaggatggcaaaagatatagcatgcatacggtaacaaaaagagagctggtgtggctatactaatagacaaaattataaatatatgtcacctaacaacagagcaccaaaacatatgcaacaaaaactaaagaagtgaaaaagagaaataagaaatttaacaataatagttggagatgtcaatactccattttcaataataaatagaacagctagggagaagatcaacaaggaaatagatttggacaacgtgataaaccaactagagcagaatatacattcttttcaagtgcacgtggaacattttctaggacagaacataagttaaatcacaaaagaagtctcagtaaatttaaaaggattgaaatcatacaaagtactttggaattaaattagatggaaaggaatgaaattagaaatcaataaaagaaggagatttgggtaattcataaatatgtggaaattaaacagcacactcctaatacaaataggttgaagaagaaatcacgttgcttcatggccttttggctaagttcaagtgtagtatctgtccttatcagtttaatatctgatacatcctctatctgaggacaatacattaaagggatttttggagcagggagatggaataaggactagtttcctccactccatgcatcaacctggtattgcagtacctccagaaatggtgcacccctcccaataagaaaaaaaaattaaaagaaaagaaatcacaaataaagttataaaatactccaagatgaatgaaaacaaaaacaaaacatgccaaaacttatggagtgcaatgaatgcagtactcagagggaaatttgtaactgcaaaggtctgcttaaaaataagaaagattacaaattaataacttaatctttcatcttaagaaaatagagaagagcaaactaaacccaaagcaagcagaggaaaagaaataataaaaattaggtggggcatggtggctcacacctgtaatcccagcactttgggaggccaaggcgggtggatcacctgaagtcaggagttcaagaccagcctggccaacatggtgaaaccctgtctctgctaaaaatacaaaaatcagccagacatggtggcatgctcctgtagtcccagctactcaggaggctgaggcaggagaatcacttgaacctgggag

SEQ ID NO: 5743 - DNA, 1179 bp, Homo sapiens
catcagttttgtgtgtgtgtgtgtgtgtgtgtgtgtgtgtgtgcgctgacttcaagatttccagcatctttttataagatttgtaattttactttctgacagatttgcattgaattgctaactgatatacctgacgatccatgagagacaaaatgactgaacagatggatggggttagattctggtatttaaaggagtgggttctttgagctgggactgctataagtggtcagttcattagcaaacacttgagggcagttggtactgcacaaaaggccattagtgaatttatttaaaagggggaccagaattttagagtaatagtggaaggggtagggttacgacagcttttgtatccttagaaaacctcaaagcctgggtactgctggggctaagataataaattctcagtaataagatctgcctatttcagcaaaggtctagtgcagtgtttttcaaaccagggactgcaacttgttgatggacattatatcaatttagtgggctacaatgagctttctttcatatcaaggtgggtttcgtgaaacttgttctggggtgtgtgtgtgtgtgtgtgcatgtatgtatgtgtttgtgtgtgtgtttgtatgtactaggtcacagtgtgaaatgtcaagccactgtagagtagaatgactgtgaacattaaagtaagacctggatgtaaattcaggctccaccacttactagttatgtgtgtaacctcaggattattccaggaacagcatgtgcagatgcttagaggtgtgaaagttggtggggtgggggggacttccaagtttgtcattaaagctggaaccataggttcctatagataaatggccagagataagtttggagaggtataaagagtccttgaatgccaagctaaacagcttggacttgatcctttaagtcagtggttcttaaccttctttggttgtggaccccactgaattttccacgaccaaaaaaggtttagaaccactgacctaaagaatgcatatacatcccctagaaaatctacatacacaaatttctccttgtagtttcagaaagtataaggatttcctgaagcccatgtatgggtcctagattaagaacttcagctttagacagtgagaagtcactgaaagaatttttagccaggaagaagtaacgttgtcagacatgcatttt

SEQ ID NO: 5744 - DNA, 1768 bp, Homo sapiens
atgttaagaggcatacattgtgtgttttaaatcctctgctactcattaggtatatgacctttgacaacttaaagtctctagacttctctgtttgtgagggttaaatgaaatcatgtatgtaaagtgctcacctattgcagtgcctggcacatgtcaagtaaaaggtaacccaagaagactcataagttcatttcccacaatataagtgaccactagcactatcaggtagcaggcagagttggcatgctttggttctatgtaagaaatccctaaggtaaaagtttataaatagaagagcatctgtgttggtattggtggttgttattattgtagtactataagtagtattcgtagtaacaatagtttattataattactaatgacactttttgattttttttatctttctgtgatgcttttcatgcctcttgtgcccctcactgtatcttgcctcttctactacttacttcctctgaatgtctgcctttgcttatctcttgcactcaagtgtgtatttctttgtctctttctttcttgtctttgctctttgttctctatctaaagtgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagact

SEQ ID NO: 5745 - DNA, 1329 bp, Homo sapiens
ttttaaagctagagaatagtgttgaataagtgatgttccatatattcctgtttgacattgacataaaggtttcctcatgatacagtaatccctgatcagggatctggaagcctgtattcatttaaggtactcaggtttaacatactgggtgcttttcacaccatactatacagtaccatgcaaagtgctttcaagactgcaaatttggcttagatcccctttagtgagctcctatgctatagtaaaggtagatagccaattattaaaaacagtcaagacaattgcacctctaagcagtagtagcagttgccacaccaccttgaatcttgaagtattttcagcaacaggatgaccattagccacaaatttagtgtcagcccttaaggtcggtattggtttgacccatattttcatgtagttctttttcttcacttgtctaatcttcccgtgtactgccagggcttgtcattagaggactttagggagaccaagcaggctagaaagtagagacaggagatacctatgtctaatgcttcagtttatacttcctaggtttttttcattggggtttttgtaactcttttggtatcctaccggtgctttggtagcctactgaaccctgtctttcttcttaaggacattctgagcatgtgagacctgaggactgcaaacagctataagaggctccaaattaatcatatctttccctttgagaatctggccaagctccagctaatctacttggatgggttgccagctatctggagaaaaaggtagtttggggaatttattgttgtagtgcttctgtctttggattgaacttcccacaactctcctttttaaagcagaacacagctgggcatggtggctcctgcttgtaattccagggctttgggaggttgaggtggggggatcacttgaggccaggagttgaagacccatgtctctacaataaaataaaattagttgggcatggtggtacgtgcctgtagtcctacctactctggaggctgaggcagcaggattgcttgagcccaggagttcaaggctgcagtgagccatcattagccactgcactccagcctaggtggcagagcgggacccagtctcttaaaaagaaagaaaagcagaacgtgagccagttttcatcaattcctatactttttcttttgcatgtacacatacattttaactttacataatgagttcggcctgtttcatttatccctcagagctgggctccagtgaggtctgtaagggcaagcatacttgatccccaatgaagaatgagagatgcaaagcactaaattatttcttttctcaccacac

SEQ ID NO: 5746 - DNA, 2237 bp, Homo sapiens
ccctgaaaatgacattttgtgatttggaaaattttcaaaagtctaatgaaggaaacttttttggcatttctttaaatgattattgtcatttcttttctgacttttccctttataaaaccttaacatgtaggattggaggaagttttctgaccattttctcatatcctctttcagctttatctttctgtaacttccatttctctagccacctccctaaattacagaagactgtgagacccagggctgctgtgattaggcattcataatttcttttcagggtgtttgtgccctgattatcaaatgtacagcttgaagggagttcatgtcttaaagtaatgaattaagagttgacctttgttgactgctaaaatattcttatatgtgaaagcatcctggaaaaatacgttaccagcttaaagagaaagaaactaatgattatatctgaactgagctaatgcctcttctcttcccccaaaccttatcagtttggatggcaaagagtaatgatgtgtcagttaaacagagctaatgccttcctctgccttgtcttaaagactggattgggagaaaattgatattctcactaccatattttgggctgtaggcaagtagcattttacacaggtttccttcaaaaatccaactcaagttggagctcatgtatttaagacatagctggcctgctgaatttaacaagttaaacttcagtggccatgtacagttatatatcactatatatatgtgtattaggctgtcgagttggtcatgtttttgttggtgacttaggctttacttgatagctcttccttgacctttccaaattgagtactgatacatggagcttgggcttcttctgcatcttatacaaatgagtttggtaaagaagcctctcctttactgttttgatgtttatattagaaataacttttgattattttttttcatgttaggatgagaaactgaaacaaaatgtaaatttgaccggtgctagacttcttaaattatgggtagacttaaagtattattttccttaaccaattagaatgctagtcttctagtgttcccggaaacatgagaggttatgcagtagacccaagcaataccctcttattacataatcaagtgcgtataagaatttaaaaatagggatatgactggaacatcactgtactttaccaggtcccattataaaattatctatgttactttacccatagctttgaaaactagtggcatagtatattttatagtatgctgttagtgtgattggcattgaacagtgatgggatataatcactctacaatctatatgttattaaagttttccagccttatagatctcccttgactgaaaattagctactaacttacgacttattttttacagcagattgactaggtctttccaggaaatctgttgatgtacaaaaacaaagtttaattgctaatgtttttttaaaaaataactttttgatattacggatacctggttatttgggccttgtatattttaacatcaaaattacctattataaatccatataaacagaaaagaaagagagtaagtctttagatcagatctgcaaacaatgatggtacgtactgtagaaaaatctggaacatagacttaccagttcttaggttccattttgcttgctttttaaaaactgtgtcttataagtcttcagcaactggttgggagatttttagaaaaaataaccttttaatgttagaacagtgtagagatttacagaatgattctgaagatagagtttctgtgtacttcacacccagtttttcccagtgttaacattttacattagtttggtacatttgtcacaacaaaccaatattgatacattattattaactagagtccatattttattcagatttccttagtttttccttaatgttctttttgtgttccaggatcccattgaagataccacgctgcatgtgtccttagtagtcatgtctccttaggctcctcttggtaatgacagtttctcagactctttgtttttgatgaacttcacagttttgaggactaatggtccagtattctatagaatgtctctctattggaatttgtctgatgttcttctcatgactagattgggtttatgagtgtttaggaggaagaccacaaaggtagagtgccattcttatcacttatcaagagtacatactatcaacatgacttatcactgtttatgttatccttaatcacctgt

SEQ ID NO: 5747 - DNA, 1188 bp, Homo sapiens
acatgcataattgcatttatgttggttcttgtgccctagacaaggatgccccacctcttttcaatagtgggtgcccactccttatgatctttacatttgaacagttaatgtgaataattgcagttgtccacaaccctatcacttctaggaccattatacctcttttgcattactgtggggtatactgtttccctccaaggccccttctggtggactatcaacatataattgaaattttcttttgtctttgtcagtagattaaggtcataccccatcacctttcctttgtagtacaacagggtgtcctgatcaaccaaagtcctgttgttttggactgttaatatgtgcaattacatttgctcctgatctgtgcactagataaggatcctacctactttcttagtgtttttagcaggtagtgcccactactcaagactgtcacttggaatgttcatgtgcacaaactcaattctctaagcatgttcctgtaccacctttgctttagagcagggggatgatattcactaagtgccccttcttttggacttaatatgcattaatgcaattgtccacctcttcttttagactaagagttgatctccacatattccccttgcatcaggggcatgttaattatgaatgaacccttttcttttaatattaatgtcataattgtatttgtggacctgtgtaggagaaaaagaccctatgttcctcccattaccctttggattgctgctgagaagtgttaactactcataatctcagctcttggacaattaatagcattaataacaattatcaagggcactgatcattagataagactcctgcttcctcgttgcttacatcgggggtactgacccactaaggccccttgtactgttaatgtgaatatttgcaattatatatgtctccttctggtagagtgggatattatgccctagtatcccctttgcattactgcaggggctgctgactactcaaaacttctcctgggactgttaataggcacaatggcagttatcaatggttttctccctccctgaccttgttaagcaagcgccccaccccacccttagtttcccatggcataataaagtataagcattggagtattccatgcacttgtctatcaaacagtggtccatactcccaacccttttgcattgcgccagtgtgtaaaat

SEQ ID NO: 5748 - DNA, 3345 bp, Homo sapiens
cctcaatgtattactcctttctagcttctttggttcaaaagtttggtggaggagttacaaattctggtttgaatgatatatttggatactttatcaacacatcaaagctctacctatcccttcccccattctcaaaaccaagctgaattaacatctttacatttattatgcagtttatggaggattttagcattaattattgcttgatttactcaatgtccccatgttatagatgagaactggaaaacccattgaagttgtgactcctggtctagaaatgaagtctacttccagttaatgttctttctggtatgtctttgctttcttgaaatttcccttttttgtccttactgggtaaattttgaaccaaccaaatcacaaagatgtccggctttcaatcttctaggccacgcctcttatgctctctccgccctcagcccccccttcagttcttaaagcgctgcaattcgctgctgcagccatatttcttactctctcggggctggaagcttcctgactgaagatctctctgcacttggggttctttctagaacattttctagtcccccaacaccctttatggcgtatttctttaaaaaaatcacctaaattccataaaatatttttttaaattctatactttctcctagtgtcttcttgacacgtcctccatatttttttaaagaaagtatttggaatattttgaggcaatttttaatatttaaggaatttttctttggaatcatttttggttgacatctctgttttttgtggatcagttttttactcttccactctcttttctatattttgcccatcggggctgcggatacctggttttattattttttctttgcccaacggggccgtggatacctgccttttaattcttttttattcgcccatcggggccgcggatacctgctttttatttttttttccttagcccatcggggtatcggatacctgctgattcccttcccctctgaacccccaacactctggcccatcggggtgacggatatctgctttttaaaaattttctttttttggcccatcggggcttcggatacctgctttttttttttttatttttccttgcccatcggggcctcggatacctgctttaatttttgtttttctggcccatcggggccgcggatacctgctttgatttttttttttcatcgcccatcggtgctttttatggatgaaaaaatgttggttttgtgggttgttgcactctctggaatatctacacttttttttgctgctgatcatttggtggtgtgtgagtgtacctaccgctttggcagagaatgactctgcagttaagctaagggcgtgttcagattgtggaggaaaagtggccgccattttagacttgccgcataactcggcttagggctagtcgtttgtgctaagttaaactagggaggcaagatggatgatagcaggtcaggcagaggaagtcatgtgcattgcatgagctaaacctatctgaatgaattgatttggggcttgttaggagctttgcgtgattgttgtatcgggaggcagtaagaatcatcttttatcagtacaagggactagttaaaaatggaaggttaggaaagactaaggtgcagggcttaaaatggcgattttgacattgcggcattgctcagcatggcgggctgtgctttgttaggttgtccaaaatggcggatccagttctgtcgcagtgttcaagtggcgggaaggccacatcatgatgggcgaggctttgttaagtggttagcatggtggtggacatgtgcggtcacacaggaaaagatggcggctgaaggtcttgccgcagtgtaaaacatggcgggcctctttgtctttgctgtgtgcttttcgtgttgggttttgccgcagggacaatatggcaggcgttgtcatatgtatatcatggcttttgtcacgtggacatcatggcgggcttgccgcattgttaaagatggcgggttttgccgcctagtgccacgcagagcgggagaaaaggtgggatggacagtgctggattgctgcataacccaaccaattagaaatgggggtggaattgatcacagccaattagagcagaagatggaattagactgatgacacactgtccagctactcagcgaagacctgggtgaattagcatggcacttcgcagctgtctttagccagtcaggagaaagaagtggaggggccacgtgtatgtctcccagtgggcggtacaccaggtgttttcaaggtcttttcaaggacatttagcctttccacctctgtcccctcttatttgtcccctcctgtccagtgctgcctcttgcagtgctggatatctggctgtgtggtctgaacctccctccattcctctgtattggtgcctcacctaaggctaagtatacctccccccccaccccccaacccccccaactccccacccccaccccccaccccccacctccccacccccctacccccctacccccctacccccctctggtctgccctgcactgcactgttgccatgggcagtgctccaggcctgcttggtgtggacatggtggtgagccgtggcaaggaccagaatggatcacagatgatcgttggccaacaggtggcagaagaggaattcctgccttcctcaagaggaacacctaccccttggctaatgctggggtcggattttgatttatatttatcttttggatgtcagtcatacagtctgattttgtggtttgctagtgtttgaatttaagtcttaagtgactattatagaaatgtattaagaggctttatttgtagaattcactttaattacatttaatgagtttttgttttgagttccttaaaattccttaaagtttttagcttctcattacaaattccttaacctttttttggcagtagatagtcaaagtcaaatcatttctaatgttttaaaaatgtgctggtcattttctttgaaattgacttaactattttcctttgaagagtctgtagcacagaaacagtaaaaaatttaacttcatgacctaatgtaaaaaagagtgtttgaaggtttacacaggtccaggccttgctttgttcccatccttgatgctgcactaattgactaatcacctacttatcagacaggaaacttgaattgctgtggtctggtgtcctctattcagacttattatattggagtatttcaatttttcgttgtatcctgcctgcctagcatccagttcctccccagccctgctcccagcaaacccctagtctagccccagccctactcccaccccgccccagccctgccccagccccagtcccctaaccccc

SEQ ID NO: 5749 - DNA, 1220 bp, Homo sapiens
caccaacccctcatacagtcaaatctgcataaaatttttaattccaccaaaacttaactaatagcctactgttgactggaagccttaccaataacatagtcaattaacacatactttctatggtaatttattatctactatattcttgcaattagctagagaagaaaatgttattaaaaatcagaaggaagagagagtatatttacgattcattaaatgtaagtggatcatcatgaaggtcttcatcctttttgtcttcatgttgagtaggctgaggaagaggaggggttggtcttgctgtctagggagtggtagaggtggaaaagatggaggaggcaggagaggcagacatacctggtgtaacttttactgaaaaaaaatacataaaagtggacccacgcagttcaaaaccatgttcaggggtcaactgtaatatgtgatctcttgtgtctgacttctttcatttagcataacatcttcaacattcatccatactgtagcatataatttgtacttaattcctttttatgattgaataatctatatatgaatgtaccaccttttgttcatcagttgatgaatgtatttacatgcatttaaataaaatttttttttttgggttttttttttgagacggattctcacccaggctggagtgcagtggcacgatctcggctcactgcgacctccgcctcccaggttcaagcgattcttctgcctcagcctcccgagtagctgggattacaggcacacgccaccatgcccggctaattttttttgtatttttagtagagacggggttttaccatgttggtcaggctggtctggaactcctgacctcgtgatccgccctcctcggcctcgcaaagtgctgggattatagtcgttagccaccgcacacagccaagaaaatgtatttaaagaaaatatggggctgggcatggtggctcacacctatacttccagcagtgtaggaggccgaggccggcagaacggttaagcccaggagttcgagactaacctgggcagcatgatgaaaccccatctctccaaaaaatacaaaaattagctgggtataatggcctgcacctgtagtcccagctacttgggaggctgaagtgggaggatcgcttgagcctgggaggtagaggttgcagtgaactgaaatcacgccactgcactccagcctgggcaactgggtgagggtctgtctcaaaaaa

SEQ ID NO: 5750 - DNA, 1070 bp, Homo sapiens
ggttctatgggttttgacaaatgcacagtcatgtatcttctacactagtaccatacagagaagttctgtcactttaataatttctcttggtggctctttttgtattcaaccccttaccccatactcaatctctggaaaccatcaatttattcttcatccctatggttttgccttttccagaaggtcatataagtggaatcaagcaatatgtagcccttttggtctggcttctttcacttagtaaaacgcagtcaagattctcccatgttttgtggataattatttcattcctttttatcactgagtagtacttcattgtgtggatgtaccacagttttattatccattcactaactgatgaacttgtaagatgtttctagttttggtgaatatgaacaaatttgctataaactttcaggtataagttttgtgtgataaatgctcatttttatagggtaaatgctttggagtgggaatgagtgccagactgttttctaaagtttccctagcattttgcattccaattacaaatatgtgagagttccagtagctttgtatctttaccagtatttagtaattttgtattatacatatatatgtatgtaaatatatatatatattcatttaaattttaatcattgttagaatttgtaattccccaatgatatatggtattatcttttatttgtttataattgacacataattatttatgggatacattgtgatgtttcagtacatgtgtacattgtataatgatcaaatcaggatatcacctcaaaccttatgatgatcttacagttaaagatgatatattcttgcaaagtgtctgttcagatcttttgctcccctttttattggattattccttttcttactgtttttatatgttttttaatatattgatacaaatcctttgtcagatacattatttggaaatagattttcctagtctgtgacttgtcttttcattctttgaacactgacttttttagagcaaaaattttaattttgatacaattcactttatcaatttttttacttttgatgtgcaatgtaagaacacttgt

SEQ ID NO: 5751 - DNA, 1130 bp, Homo sapiens
gtaattgctgctaattgctccctgggttggaccagagtgctcattgtctgaacagaaacctcatcctcacagtctgaggtttgctcctgtggctgatatttaaagttttcccctttcaactttactccagctatccccttacctgcactgacaggtaatcctccaccgtcctgttcacctctcaccaggttcatattttctttatcttatttattgtacttaatcattattttgtgagaagcttttctgattgtagatgtgacaaccagaatacaagttaaaaccacttatccagcgccttacagtgaatcatttaacatgagaaaaaaattgagtgtgtttgcagaccatggggcagaaggaattgagaagggagtcattgtagatgtgagaaagagagagatgataatagatggaagatgatcttgaaagatgatgcaggtgaagctggaagggtgaaatttatggctctagaacacatgcaggtggagggttagccttaggtaagtggaactacctctttgctggagcacagagatagggataggagtaaggaagaggacttggcaagggtggtgaagatttgtaattgtagaggtggatgatggggaggaagctgaccaggaacaggaatatgaagacaaaagctgctggaacagaaatactagagggctaaatatgaaccagagtccctaaggaatattcaggccaaaacgctggagtgagaccattaacaggagagcttatggtatatcaaagtaagaaatgagtttgaaactgggttagaagctcaggaaaatatgaagtggttttggggcattgtcactagcagtatttggttgccttgattgattgaggggtggacagctagcaagagacgagttacacagaaatggatttaagaatccaaactaaggccgggcgcggtggcccacacctgtaatcacagcactttggaaggccaaggtgggcaggtcacctgaggtcaggagttcgagaccagcctgaccaacatggtgaaaccctgtctctactaaaaatgcaaaaattagccaggtgtggtggcacatgcctgtaatcccagctactcaggaggctgaggcaggagaatcacttgaacccaggaggcg

SEQ ID NO: 5752 - DNA, 1222 bp, Homo sapiens
tttttaattgttgaaaaaaaatcagaattataaaacttaattacatcaaaattacaagaaattcaagtgtcagtgtccataaataaagttttattggaacacagtcacattcattcatttttttttttattttgagacggagttttgctcttgttggccatgctggagtgcaatggtgtgatcttggctcaccgcaacctccgcctcccgggttcaagtgattctcctgcctcagcctcccaagtagctgggattagaggcatgcgccaccacgcccggctaattttgtatttttagtagagacagggtttctccatgtcggtcaggctggtctcgaactcctgacctcaggtgatccacctgccttggccttccaaagtgctgggattacaggcatgagccaccgcacccggcctcatactcattcttatgtgtgtcatgtatcgctgcttttatgctacagtagcagaatggagtaattgggacagagaccatatagcctacaaatcctaaaatatttgctgcttggccattaataaaacatttaaagtcagactattacaaaagttgccaggtccctcacagcatcatctttgatagctttaaatgcctaattggcagccttgtcatggactagtagggactattatcattctgttctcttatgtttggtggggattcttatttccttactccctactgtgacactttaaccagttccagaaaactcattcttggtgagcttcagttgtggctgaaatccctttagcaatttctataggctcttgtattgttaagaaccagacatctcttgggccagccaagcaattgggaccacctaagcaatttggaccacccatggctgggcttggtcagcctctaagatggacagggatctcataagaattcaagtaaggaatttgagtaaagacaattaaaatttaaagaaaaattttaattcagtttcctgagtttggaaattagttccaagacagatctgggaatgtcagcgcaagagtttgtgtcatccatcctagtataccacctttaacattttttaattcctctgtgtgtttgttcagtgccttcctcattgttgactcaacctttactttacctcctagcttagtctgcattctgcttccccttcaattttcagctattcataattaaatgttgcttgttgccccagtgtatgagatagtgcccaaaggtatttatt

SEQ ID NO: 5753 - DNA, 1099 bp, Homo sapiens
ctcactgcaacctccgcctcttgggttcaagcgattctcctgcctcagcctcctgagtagctgggactacaggcgaccgccattacactcagctaattttttgtatttttagtagagacggggtttcaccatgttcactgggctggtctcgaactcctgacctcatgattcgcccacctcggcctcccaaagtggtgggattacaagcatgagccactgtgccctccctacaggttttaaaatttattattatctaaatattcattttaaatgttaattttagtgtacttctttgattattttctttagagaaatttctgatttcagaaccaagtttattagcattcactgtatacattagcaccattaaaactagctagacccaagaagcagtattgaatgggtaccccttctttactttcctctgattcactctactctggtgctcacagctaagtaagtatgtacagcaatggcctgtcatttggtcgattatcttttgtgctctgaaatgtctttgttttttcatctgctctcaatacctctgtgctctgatcctttgtatataagggtaaccatatttgttctttcctgtgaaataataattcttttccttccattcagagtagctgcctgactcatacaatgaataaagtcacatagactcaaagagtggagatggaggtcggatgtggtggctcgtgcctgtaatcccaacactttgagaggctgaggtgggaggatcgcttgagcttgagcacaggagtttgagatcagtctgggcaacgtagtgagatctcatctctgccaaaaaataaaaattagctgggtgtggtggtgcatggctgtagtctcatgtagtcccagctacttgggaggctgaggtggggggtcacacatactttttgttgttactgcttcatcattggttctgatcactcagtgttctttcccttacaccagatcataatacagtattctgactaggcaacttagctcagtttattacgaatagccttaattaatttggtaaattactatgaatgaacatttcattcattctgctaggtctaggttttgccagctgttccattaaggg

SEQ ID NO: 5754 - DNA, 1225 bp, Homo sapiens
tgtttctttggctgagtcatttcctatatctaagcctgtttcctcatctgtagaatgacaaagctgtactctgaggtttgtccttctggctctaacattttgtattgcttttgttaatggctcgaaagctccctggtgcaggaggtccttctcttgattgcattttaagaaactcaacatttcgaattattgatttacctatcagcaagaggtggtttactttcctttcctgtttgagcgtttaaacaagcgacattactcatttcctttctagataggattggagttaataaaggctttcttggctttctcctatgtttttttttttttttccccgattgcttgtttgtcattgtgttgttgggctcacttcttattattttatttgtgctttcttttagtaatggtgttatcttggtgttcattatgtactttggaagacttagtatatgtgggttttggggtcctatttattttctcatgcgccagttccgatcattgtttgtttgtgggtttttacccttcctcccatattgttttgctttctccccctctcccttccctccctttcaggaaaatggaggagtggctccattacttctggctctgcccaggttttctgccacaagagtggcacggcctgtgcctctaatgcttctgatagagtcgtgactgctttggatgctacacctgccccaagatgtaatattgagcattgagattccaggggcagtacatcgtcctggaaagcctcaagaaaggaaacttcagagcaaacagaatcaactagggatcatgactatacatccagcatgatccagcatgggtccagccgaggcctccaaaatgatgctttgccagcctcagctggttctcaagtgatgatatccttgaagtctctgtggcccgtgactccagagttaaggtagtggagtttccctttaaagcatctcacagcaggctttgtagatgggacacatctcacttcaacatgcttgctgactactcaggttgaaggtcagcctcagcccttaggtccgttaaattaagttctaattttgaaatgtaggttattatgttataggctaggtttatggtagactgggtctttgacatattggacttcagtaataacttatgcaaaatgattcaacttattctttttagggcttaatttacatagctataaattaggttttcctttggacaaaaggtgttagagggc

SEQ ID NO: 5755 - DNA, 1151 bp, Homo sapiens
ctgttctatgttttgctgttattttagtctttattctcttcctttaggtggagaaacaaagtaccaatttgaagggattttttttattttgtcttttggtttctgtcagtagaaataaccatatgtgctaaccaaatttctgtgaagaatgttttcatggttatcattatatctaactataacctcccccatagttatgaagagtaacctgaaatgccactattgtggaaataggataattgtaattgtgaaaaaataattttaaggaaatcttacaagtattacattaaaaagatactatgactgccacctgccatttaccttctaataaccctgccatgtggtttgcagaaagagatggatatagtagcctcagaagaaatattttatgtgggttttttgtttttcgttactagatttcatggatgaggggatatggttgaccttttactttttaatggagcagccagtttttgttaattactcacttgtaaattgtgagattctgaattccttacctgctattcttgtacttgtctcaggccaaatctatgctgtggttcttatgagacttgtatgaagatgccctgatttgtacagattgaccacgggaatactactgccatgtaatctgtatagttccagataatttgtcatgaacattgacagaatgacaattttttgtatttgctttttctccctttaagagcacattcttctgtaaggagaaaggcagcattctggctaaaatgtgtagaaggtaatttactacacttataaaatagtgtgacttttgtgaaaattttgaattagctttcatatgaagtgccttaagtagactcttcatttacttttctggtaatggtttaaatatcatttgttatgcatttttaagatacagttcagaatgacacattgtagtggcaaagataaccaaatgtctggctgtttgctttttgaccatatcaataaacttttacaatctaaattctgagtttttgattaccatctaaagaggagtgagttttaaacactaaactagaattgtaaaattaggattttacattttgaagttataattaaattaatttaaatttcatattgtcctaaggacagtttgatgggacagtttctttaagtatttctggatt

SEQ ID NO: 5756 - DNA, 1181 bp, Homo sapiens
tgggcaacagagtgagactctgtctcaaaaaaaaaacagccaggcatggtgacgggcgcctgtaatcccagctactctggaggctgaggcaggagaatcgcttgaacccaggaggtagaggttgcagtgagccaagatggtgccactgcactccagcctggatgacagggtgagactcttgtctcaaaagaaaaaaaaagaaagacaatgttcatttatggtttgatggattcagcctggccaacatagcgaaacctcatctcaacaagaaatacaaaaattagccagaaacggtagtgtgcacctataattccaactactcaggaggctgaggcatgagaattgcttgaacccaggaggtggaggttgcagtaagccgagactgccactgcactccagcctgggcaacagagcgagactctgtctcaaagaaaaaaaaaaaaaaagaacagaaaagaaaagtatggtttgatggattaacaaattattataccttagaaaattttcagtatcttgaatcagttcttctcactagtactttgaaattgaataatggagcaaaagagcaattaaaattgtaaagtattaattagttgatttggggtttgttggtcttttagctttgtcttaaacttttaaatatataagaagtttaagaaattagaaaattgtcattttacctctgctttaagactgagcatcagcctaaggtttagtatacatttggaacggattacaatcctgttgggatatagaatgtcttgtgtttggttattaggatgcaaaaagtgaacttttttcagagtcagacatgtatacagattataagacagtgacttaagtgctgtgtaccagaaatagtgagaaaatgaataattttgtcagaggtaaggaatattagaaaaggcctaaccactccccacccccccccccttttttttttgagtggagtctcgctctgtcacccagactggagtgcagtggcaccatcttggttcactgcaacctccacctcctgggttcaagcgatcctcctgcctcagcctcctgagtagctggaattacaagtgtgcaccacctcacctggctaatttctttatttttagtagagacagggtttcaccaggttggccaggctggtcttgaactcctgacctcaggtgatccacccatctcagcct

SEQ ID NO: 5757 - DNA, 1223 bp, Homo sapiens
ttacagtaacattttgagttctgtgatgaatagttctaggggaagggatggaactttcgacatgtaaagtccattgttttaaatgctaaccccatccccaatatttttgtggaacgtgaggctttatgaaaggtttatcagaaatagaatattctaaagtcacttttatggcttatttcaaaaactagtgtgaaagtattttcatgcttttttgtttctcatcttttagcaaagcttctttaccaagttttgattaaattgcaatataaaattaagttttttcacggtgctatattttgtggaatatgggtagcactcaggtttctttcttttttcttttctccttccttcttccttcattccttcattcctccctcccccctccctccctccctctcttccttccctccttccttccttcctcacctcggcctcccaaagtgctgggattacaggcatgagccaccgtgcccggcctatatacccttattcttgattatttcttttttcatcttttcaatcctgcttacttttatcctcacttttctttctgccatgaaaactgcacctaatttaccacacttaagattggcaatttttgattcattgatgggagaagtacagtagaaaggccctgcagtttagaattaagttgtgtttgtttatttacatgtatgcccatttcttctaaattaaatctagaatgtgagactttgacatataaaagcatgataagtattttcttaaaaaataagactattgatacataatgaaaccaccattggtaattgaattttaaaatgatatgcaaaaatatttagaaatccagttgggaaatgtgtttttgcatatgtcaccagatacacattaggcagtactacaaatgttaattcttaaacaatactgtggtgatggcaatcagtaatttatttctttgtcctgtaacttatcattcttgtcttttgtaatgtcttacacagtattaacataactgtaccttttttttgttcttggtatccatacattttaagatggaaaatcagttcatagttgatatgatattgtatatgggcaaaatgtccgttaaactaaaattcagtaaaaaaggtaatataaactggcttgatttataaaagatgttttgtttggcagttatcagtcattataagcaattatcttcaaagacaaaaaaactggactaatttgttgccattctttatggg

SEQ ID NO: 5758 - DNA, 1199 bp, Homo sapiens
ttacaactttttctactttatagtttattgcagaactgtgaaataacatgaagaagaaaataaagaagattcactaacttagcacccagagaaaaacaagcctaatattttcatttattttcttagtaattcatttcccatgagcatgtttatgtattagaattgtaatatgtagagtgagttttaccaggatcttttcaattttcatattgtgataatttttacaccattatatattctttgaaaatataattttgatggctacctactagttctatgatatggacatttcacaatatattttaactacatttaattactacaaagtcagattaattacacttagtgcaggtatcaacacgattttacttttctgaaatagaaactctcttgttaattggaatagcctattttcttctagtgaagtaaaggttcctgatatcataacctaggcaggtggcaaacagtatattggtagctaaagtatatattaaactaattgtaaatttgaagtcttcagacagggcttgctcacttacattttatcacaatcatctatcacaacactatcattttactactatttaatagtagagtgttgtgatagaggattgtggaattatactactataaaattataaagcacaattttatcacaacactctatcattttactactagttagcttacttttacttccttggcactgaaggggtttgcttatgacttttgatagagctataagacagataaaatatgtaattctttatttaaataaatttctactttactagcctgtgaaatctttaaaaacagggaccacagcaaaatccatctctgtgtgttgtataatgtctctgatcaagactgaatcccaggaatgatagaaacaggcctgacgttcatcatcatcccagagacacagctagttaaaaactaatattttgcctgagttgtagccacagacctttctaaattgatttgtaatgttcttgcctgcattccagtgagctaagtcagaaaacaacatggatcttgcccttcttctacatagcctcttctgggttaactgatggaaaaagcgtaaaaacaggaaagttacaatgctacaaaaggaacagacaggaatccttgcctctgataaaacttaaagtatttagggataaagagtgccttcctgttctctctacagctaggac

SEQ ID NO: 5759 - DNA, 1189 bp, Homo sapiens
ggagccctccaagtctctaggaagttccaaactttcccgcactttcctgtcttctgagccctccaaactgttccaatctctgcttgttacccgcttgcaaagttgcttccacatttcgggtatccatatagcagcaccccactacctcagaaccaatttactgtattagttccttctcacactgctatgaagaaataccagagactgggttgggaacgcagagcggacagattcgattcagcggggttccgggccgcgctgtgctatgaagcaggtcaatgagctgaaagagaagggcaacaaggccctgggcgtggaaaacatcgacaatgccttacagtgctactctgaagccattaagctggatccccacaaccacgtgctctacagcaactgttctgccacctatgccaagaaaggagactaccagaaggcttacaaggacggctgcaagaccgtcgacctaaaagtttgactggggcaagggatattcacgaaaagcagcagctctagagttcttaaaccgatttgaagaagccaagtgaacctacgaggagagcttaaaacacgaggcagataaccctcaactgaaagagggtttacagaatatggaggccaggttggcagagagaaaatgtatgaatgctttcaacatgcccaatctgtaacagaagttggagagtgatcccaggacaaggacactgctcagtgatcctacctaccgggagctgatagagcaactataaaacaagccttctgatctgggcacaaaactacgagatccccggatcctgaccactctcagtgtcctccttgaggtcgatcggggcagtatggatgaggaggaacaggttgcaacaccttcaccaccaccccttcccaaaaaggagaccaagccagagccagtggaagaagatcttccagagaataagaagcaggcactgaaagaaaaagagctgaggaacgatgcctacaagaagaaagactgacagccttgaagcattacgacaaagccaaggagctggaccccagcaacatgacttacattaccaatcaagcagcggtatactttgaaaagggcgactacaataagtgttgggagctttgtgagaagtccattgaagtggggagagaaaacagagaagactatctacagattgccaaagtgtgtgctcgaattggcaactcc

SEQ ID NO: 5760 - DNA, 1191 bp, Homo sapiens
caagctggatattactgattactctgaaatgcaaatagtgctattttgttttacagctatcatttaaaaagccatgtactcattaagataaatatgtgcagcatgaacaacaaaaaaatgagaaagaaaatggacattatttgtattttgtaggctctctgatatggaactgaatgcactaatcttcaaatactaatgagcagcaaaaagcaatttgccagtgcacaattaacttctgactggcttctgttgatatgtagtgctataaccccacaccaggtgaacttcccattttttgagattttatttgaccagtatttataattgtggccaaataatgagatgattattatgaaataatgttatgttggagtaaatcatacttacatggagctcttattatagtttctctatttaattgtctgccaccagggccttgagcttttattttcctctttccccttctgctcttcttgccttttcccatcattgaagaaacaagggcctccctctcaattctcaatttggaaacctgctagtggcatgtcttagttacaaacactgtgttttatatcatgtggttatgttcgtcacttatctcttctttctgttaacttttattctattactgtgtcatgtcatttatatgtatgtacgtgtagatacatatacatgcatatatatttacattcagatatatatgcatcccccatgcatgcatacatatcatacagtagtggagaggaggttgtaaagcataaagtttacctgttttgctcatggtttattgaggcagattttgtcccttagctcagatgagaaaatccctactccacagtcataagctgaaattctcaatccagccagatattttgcaaatgtgcctctggtgcctggggagattgagttaaagcatatatggctcagtgagaccaatcattgtgattggcaaatgaactcaaaacactatcttagtaatgttaaggcagttgggaattttatttccacaacatgcaaactaatactctgaatgagtagcagattggaatatggtaggaaactttgaaattgtgattctcaaataatttagcctaatgcttgtttcatagaattatgaaatcttgtttattgtaaggaaccttagaggatcatctaatttaatcactttttctaatgcagcggcacgttgta

SEQ ID NO: 5761 - DNA, 1159 bp, Homo sapiens
tccatatggcgttgttctggattcccatcgtaacttaaagggaaactttcgcaatgtccggagcgcttgatatcctgcaaatgaaggaggaggatgtccttaagttccttgcagcaggaacctatttaggtggcaccaatcttgacttccagatggaacagtacatctataaaaggaaaagtgatggcatctacatcataaatctgaagcggacctgggagaagcttctgctggcagctcgtgccattgttgccattgaaaaccctgctgatgtcagtgttatatcttccaggaatactggccagagggccgtgctgaagtttgctgctgccactggagccactccaattgctggctgcttcactcctggaactgtccgtcgctaaccagatccaggcagccttctgggacccacggcttcttgtggttactgaccccagggctgaccaccagcctctcatggaggcatcttctgttaacctacctaccattgctctgtgtaacacagattctcctctgtgctatgtggacattgccatcccatgcaacaacaagggagctcactcagtgggtttgatgtggtggatgctggctcgggaagttctgcgcatgcgtggcaccatttcccatgaacacccatgggaggtcatgcctgatctctacttctacagggatcctgaagagattgaaaaagaagagcaggctgctgctgaaaaggtaatgaccaaggaggaatttcagggtgaatggactgctccagctcctgagttcactgctactcagcttgaggttgcagactggtctgaaggtgtgcgggtgccctctgtgcctattcagcagttccctgttgaagactggagcgctcagcctgccacggaagactggtctgcagctcccactgctcaggccactgaacgggtaggagcaaccactgaatggtcttaagctgttcttgcatgggctcttaagcaacatggaaaaatggttgatggaaaataaacatcagtttcttaaaaaaaaacccaaacacctcatgttctcactcgtaagtgggagctaaacaattagaacacatggacacagggaagggaacatcacacaccagggcctgtcggggggtggggggcaaggggaaggagagcattaggagaaatatcta

SEQ ID NO: 5762 - DNA, 1158 bp, Homo sapiens
ggcgtgagagaaaatattgagtagcttcataaataattagctgcttaatggctagaccaggaaataattaggttttctctgaaaagtggccatgagattgtatttgcttcttcatatctacatatgccactttgacgatagaaatttgagttgccaggcattttcttttaaataatcttttaagaataaaaccatgcaaattatttttctttccatagatgggaacgttgtctgtgtgcagtctaatcatctgaaaaacatccctgagaaacacagtcaagtggcgcaggtaaaatggaacaagagctggttgagaatggcctggagcattgtagtctacaacagcaacatccctgacattttgataatagagccaattctagtgctagagggaaggaggggctctgtactgaaagcataccttctaactatggagaaaacattgctaggttttcatttcagaaagagtggagaggggaagagagaactgtgtccattattgtaagtatcaggcatctaaggactttttcatagtagggatgtattaggaagaagtgctgatgagggtactatagcaagtgtcaggtgtctgaagtatttggaaggctagtgttttcagcagaacagaattgaggaatatgaggtgaagtggtgataagatagtacatcatgagcttggcctctgatacgtttttttctttctttcttttctttctttcttggatgaggtcttgccatgttgtgcaggctggtctcgaattcctggcctcaagcaattctgccaccttctgtatcccagagtatgctgggattataggcatgagctaccgtgcctgacctctgagacacttattttttattttttattttttgagacagtctcattctgtcgcccaggctggagtgcagaggcatgatctcagctcactgcaacctccatctcctgggtttgagcaattctcatgcctcagcctcccaagtagctgggactacaggcccatgccaccacacccagctactttttgaatttttagtagagatgggttttcaccatgttggccagtctggtcttgaactcctgacctcaagtgatccacccacctcggcctcccaaagtgctgggattacaggtgtgagccactgcgcctggtctttttc

SEQ ID NO: 5763 - DNA, 1209 bp, Homo sapiens
aggttgcagtgagccaagatcgcaccactgcactccaccctggatgacagactgaaccccatctcaaaaaattaaaataaaataaaataaaataactatatatatagccccagctggaaattcatttctttcccttattttacccattgttttctcatacaggttataagcacatgtccttggccctgaataggactggcagaagcattgtgtactcctgtgagtggcctctttatatgtggccctttcaaaaggtgagatagtgagcccagaatccaatagaactgtactgatagatagaacttgacaacaaaggaaaccaaggtctccttcaaagtccaacgttacttactatcatcctaccatctctcccaggttccaaccacttctcaccatccccactgctgtaattatagcctaagctaccatcacctggaaagtcatccttgtgtcttcccctttatttcaccattcatgtcctgtctatcaacagtccttccaccagtatctctaaaatatctcctgaatcagcccacttccttccatcttcactacatgcaccctggccttccaagctactatcggctctcaaccagactgctgggaccacctgatctctctgcttccactctgtctcaacccccatctattttccaagcagcactagagttatcatattaaaatgtaaatatcagttttttttttaaagaaaaaaaccctgagacttaacagagttataaaaaatataaatgtcatcatcagttccctgcttaaaacccttaactcgcttccaattgcacttggaatgaaaccaaactgcactgatccagcccttgcctgcctccccaaagtccaaggggtcatggctctttccctggctacactggttttctttctgtccctcaacactgcaagcctattgctgccccagggcctttacacttgctttttttctgcctagaacagttcttccccaaagatttttaaagggccgggctccttaacattgaagtcgcagaccaaacgccacatatgcagacagttcttctctaactactttaaaatagccctctgtccattcattcttcatcacattaacctgtttaattttcttctcagagctccacactatttggaagtatttgttgacttgttaccatgtctccccactagagtgtaagtttcatgagggcagggaccttgtctgac

SEQ ID NO: 5764 - DNA, 1185 bp, Homo sapiens
aatagaatgggagggatgtttagtatatccagtatgattggtaaatgggaaatataattgattctgatcactcttggtcagcttctctttctttatctttctttctccttttttaagaaaacgagttaagtttaacagttttgcattacaggcttgtgattcatgcttactgtaaagtggaagttgagattattttaaaacttcaagctcagtaattttgaacactgaaacattcatctaggacataataacaaagttcagtattgaccataactgttaaaacaatttttagctttcctcaagttagttatgttgtaggagtgtacctaagcagtaagcgtatttaggttaatgcagtttcacttatgttaaatgttgctcttataccacaaatacattgaaaacttcggatgcatgttgagaaacatgcctttctgtaaaactcaaatataggagctgtgtctacgattcaaagtgaaaacatttggcatgtttgttaattctagctttttggtttaatatcctgtaaggcacgtgagtgtacactttttttttttttaaggatacgggacaattttaagatgtaataccaatactttagaagtttggtcgtgtcgtttgtatgaaaatctgaggctttggtttaaatctttccttgtattgtgatttccatttagatgtattgtactaagtgaaacttgttaaataaatcttccttttaaaaactggaaaaaatcttgaactgattgatttttattatgttctgtcatatgggcacactgattgactttacaattccctcaaagttaagatttttaattttaaaattataaatgatatttagcatctttatatgttcattgttgcatatatcattaattatttctaagatatatccctagaaatgggattgctgagtcaaagatatactcatttttaaggcttctgatttgtgttaccagaaagattctggtactttatctttctacttggagtgtgtgttttattttcccccttataccctccttattgatgcacattattctttttgaactttgccagttttttagttgagaaatgatatctcattgctattttaatttgtatttttttgattaatattaaagttgtacattcttttttaaaaaaaacttaccatgtctacaggactattgagctactttt

SEQ ID NO: 5765 - DNA, 1185 bp, Homo sapiens; identical to SEQ ID NO: 5764

SEQ ID NO: 5766 - DNA, 1197 bp, Homo sapiens
ttcaccacacccccagcctctggggaagggagaggagctgaaggttaaattgactagcagtggccaatgatgtaatcaatcatgcctacatagtaaagcctctattttatttattttttatttttatattttgagatggagtctcactcttgttgcccaggctggagtataatggcgtgatcttgcctcactgcaacctccatctcacgggttcaagcgattctcctgcctcagcctcccaagtagctgggattacaggcatgcaccaccacgcctggcaaattttgtatttttagtagagacagggttttgccatgttggtggggctggtctcgaactcctgaccttatgtgatccacccacctcggcctcccaaagtgctgggattacaggcgtgagccaccgtgcctggctgtaaagtctataaaaacccgaaagaattgggtttggagagcttctggatagcgaacacatggaggtacctagagggtgctgtgcttgtagggggcatggaagcttggtgccccttatcctgtaccttgtcctatgtgattgttccatctggctgtccatctatatgctttgtaatatcctttataataaacctgtaaacatgtttttcagagttctgtgaccctctctagcaaattaatcaaacccaaggggagggtcatgggaaccctgatttacagtgggtcagtcagaagcatagcttacaacctggcatctgaagtggagagcagtcttgtgagcctgagctctcaaactgtgggatctgacactatctccaggtaggtagtaacagaactgaattcaattagaggacatccagctggtgtccactgcaaaactgattgcttgatgtatgggaaaattctcccatacatctggggctacagaagcattctatattaaatagagagtataggaaaatccacattttgtttactcccccctgtatcttacagtgagagtgagcggtcaagggtgacttctcagtttctggcttgtacaactggatgtttggagtaacagcattaagaagcaggacctttaagatcacattgaatactaagttcaggtatgaggactgtgagtttagtcttagacatactgtgtttgacgtgcctttgagaacacccaagagaatataggtagttggatggatggatctagagctcagaaggggcctatata

SEQ ID NO: 5767 - DNA, 1142 bp, Homo sapiens
ttttatttgtatttccctgatcattagtgatgttgagcttttcttcatgtttgttggccatttgtatatcttcttttgagaattgtctattcatgtcctaggcccactttttgatgggattgtttgtttttttttcttgttaatttgtttgagtttgttgtaggttgtggatattagtcctttatcagatgtatagattgtgaaggttttgtcccactctgtgagttgtctgtttactctgctgactgttccttttgccatgcaaaactctttagtttaattaagtcccagcagttcatctttgtttttattgcatttgctttcggtttcttatcatgaaatccttgcccaagccaatgcctggaatggtttttctgatgttaccttctagaatttttgtagtttcaggtcttagatttaagtttttgatccatctctagttgattttttataagatgacagatgaggatccagtttcatcgttctgcatgtggcttgccaattatcccagcaccatttgttgaatagggtgtcctttccctacttgaagtttttgtttgctttgtcgaagatcagttggctctaagtatttggctttgtttctgggttctctattctgttttatatatatatatatatatatgtgtgtgtgtgtgtgtgtgtgtttgtgtgtgtgtgtatatatatgtgtatatatatgtgtgtgtgtgtgtgtgtgtatatatatatatatatatatatatatatatgtatataaatgtttcatatatagtctatgtgcctatttttataccagtaccatgctgttttggtgactctggccttatagtatagtttgaagtaaggtaatgtgatgcctccatatttgttctttttgcctagtcttgctttggctatacaggctcttttttggttccatgtgaattttaggattgtttttttctagttccgtgaagaatgatggtagtattttgatgggaattgcattgaatttgtagattgcttttgacagtatggtcattttcacaatattgattgtactcatccatgagcataggatgtgtatccatttgtttgtgtcgtctataatttctttcagcagtgttctgtagttttccttgtagaggtctttcacctccttg

SEQ ID NO: 5768 - DNA, 1195 bp, Homo sapiens
ccacacacacatacatataaacccatgtagagagagatagatatatatattttttcacaatggaaccatatactacattataatttatgactttgttgattgtccaaatctgattctttttcattttgtgtgtgtgtgtctacaagtgttttggggagattaatattggtttttattgcattgtctcttgatataattgacctatctctgttgtttaagagtacttcatacacagaggataaaaacctagattaaatatgcatacagcatttatatattaacatataaaagctaccttatctaacatttgtagtgtaacttgcgtgtttaactgtagtgggtagaattatgtccccctcaaaacatgtcccaaacctaacccacccaaactttatttggaaatagggtctatgtagatataattaagtgaaagatctccagaagtaaatatcctgaatgtaggttgatgcctaactccaatgactggtgtctatataaaagaaagcagagggagatttgacacatgcaaggaagaaggccatgtgaagattgaagtagagattggagttatgctgcctcaagccaaataaaggaggagctggaagagctaagaaaggattctcccctaaagcttttggaggcagtgtggtcctgcctacaccttggttttgtactttgggctttggttttatacttctgaaccatgagataatgaaattctgttgtttaaatgtgcaaagttcgtgataatttgttatggtggccctaggaaactattcattggctgatatcctacttttcatgtctacagtgatactaatgccagtaagatatgtaaaaagaatttaaaatgactaacatttcttatgaactgtatgcttttaatgtattgagtcagtcagtgctcacagctgttttacaaggtagatactgtgactaatccttattttatagatgaaaaactgaatgacagagagaataaagactttgcttgatactgcatagttagggagtgggacagcttggatttgtgtccagtacctcatgctccagagcctgtcacagatttgtgttaaatttaaagaaacgactggacaagcatgcatattttatgagttcattgaaagcaatactcagtatggttatatatgtaaacaaaaaactgaacctagtgaccaaaaaggggattgtaacc

SEQ ID NO: 5769 - DNA, 1204 bp, Homo sapiens
ggaggggctttaattggaggccccgtagaggacgcgcggaacttctaaggtgggaaaaaacgaaattaaaaaatcctttgatatcagggctctgaatcctgctggtcagagcaccaagcattcagtctctctccttgcctttgtcttacttgtgttcaaagaaaaacaaccagaaaaaaaaaatctcatcatggcaaatattcaccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagcaatctatacatttattgtctcattaaaaatgtatacttacatataacagatgaactaaaaaaaaatctgagattaaatacactagagtgttaattggtgaacatttctgtgtgttaactaatcccagcactttgggaggctaaggtaggcagatcacgaggtcaggagatcgagaccatcctggctaacacggtgaaaccctgtctctactgaaaaaaaaatacaaaaaattagccggtcgtgatggcacacgcctgtaatcccagctactcgggaggctgaggcaggagaatggcttgaacccggaaggcggaggttgcagtgagccgagatcacgccactgcactccagcctggacgacagagccagacagtctcaaaaaaaaaaaagtaatatgtgacatttttttccttttattatctggagtttgagaa

SEQ ID NO: 5770 - DNA, 1318 bp, Homo sapiens
actgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctctttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaagtaatttgtagtgtgcctttcatgttactggttggtattctggttattgtagaaataaggttggtattctgtggttattgtagaaattttagaaaacatagtaagaaca

SEQ ID NO: 5771 - DNA, 1223 bp, Homo sapiens
atgtccatcttttgttggcctactcttctaaaagcccaggccaaatgtcactcactgtaaaaacctcactaatcttctttctcccaagccaaattcatcctttccttaaatgtccactgatctttgacaaaggagcaagggcaatataatggaggaaagatagtcttttcaataagtaatgtaggaacgtctggacatccacgtacaaaaagaatggatctaattcttacatctttcacagaacttcctgaaagacctaccacctcttcaatggaaagcatcaacagtttgcaccctacaattctctgaattcctcacctcaaaatcctcatcttgctgctttcaccaatcctggattgttgtaaaatgatgcttgcccagtcttaatcaagaccccacattgaaatatccaccttaaatcaaacttccaattcttaataaattctgcccagacatttccctctgaaacattgccaaagctttgtgcaagttgaggttttccttgccaaaatacgtaagaaattcaagctttgttttatcagcaggttttgttggtgatatttgactcagctaaatacacacacacacacacacacacacacacacacacacacacacacttcgagctcatcaatcacatgaaaaaattataagggttagatcaccagttattgggttaagtccagtatatttctatccaatggtaaacaaaatgataaaagttaattgacaattctcgataccactcagtctctcctgcagccatcagctctctggtaggtaaattatgcatctgaagactttaaggcagattaccccagggtttgctctcaggctcagatcttcagagaaaataaggaactactatacccacccacattttcagagaaacagaaattaggaaggatcttggagaatggaagggagagatgaattgggtaaatccattgaggtgaagtacacccaagggacaaaccaaatcgaagtgagacaagaaggcaggatgcccaacagtcatcaactccagtgattaagaacttggttaagatgtattaatacattattaccatatatttaagtaaacattatacatacagtgcaccaactctatgtactgctatccgtgtctatgtcagtatttctcactgagaaatatatggagggacctctttttttttttttttttttcctgagacggagtcttgctctgttgcccagactta

SEQ ID NO: 5772 - DNA, 1198 bp, Homo sapiens
cttttaatgtgtctatgtacagatataatttttaaacatcaggatcagtttgtgacctgcatatttgctcctatattgttgggtgttttccttttgaataatctgaaaatatgatttttagtgattataaaaataccattcagatatatcatttaatcctcatattttaggggcatttattttcccttttggactattacaaatagtattgtttggacatatttgtacacacatcttttttccaaatttctgtttggggaagggaacacaatcctagaaggggaattactgattccaaatgaatgaacctttttaaacgtctagatgtacatagtactgccaaattgcttttaagaaagattatgtcaacttagactgtcactggcaatggatgaaagtacttcctactttgtttttatctatattgccttaaaattatgattttaaaaatttgcaaattagaagatataaaaattttgccaggtgcattggttcacacctgtaatcccagcgctttggaagaccaaggtgggaggattgcttgagcccaggcatttgaaaccagcccggacaacgtgatgaaaccctttctcttccaaaaaaaaaaaaaaaaaagaaatgtgaaaattagccaggcgtggtggtatgtgcctgtagtcccagctgctgggaaggctgaggtgagaggatgaatcaagcccaggaggtcaagcctgcagtgagccatggtcgcaccactgcactccagccttggttgacagagcaagaccctgactcaaaaaaaaaaaaggaagatataaaaaatgttacaatctttactagtaaaaaatactgttattctattttatgaatgatttgttcaattatgagcccggtttacttgctgctgataattaaaaacaaaagacaaagacttctaagaacattcagaaccttgtgatgattacaaatctgagaaacacattgactttgcccaaaggtaagagcacaaaatgaagcaaattcctgactcctttggcagtgatctaatggttagattactaaatatggcatcttttttttttttttaaggaatgtcactattactcatggagagaaacacatttctacagaatttttacaaactaaaaagaaattctaattaaaaacaattatctaacagtttttcctagcaccgaacatagtacttggtacatag

SEQ ID NO: 5773 - DNA, 1190 bp, Homo sapiens
cggggcaaactagcttttgggagtgaagcgggtacgcagttatccaacaatgtctggtgagtcaggacagcctgaggctggtccctcacatgcagggctagattggccgaaccctgagaggaatcgggctggggtcccgggaggggtgatccgaagagctggttcccaagggcccaggtcctggatccaaaaggttcttgagcagattatggactcacctcgccagtgtgtcaccccctcggaggtggtgcctgtaactgtgctggccgtccagaggtacctgttagaggatgagccacgcgacacggtgcccaagcctcccctttattgctatgatgtgacgatctcagatggggtgtaccaggagaagtgctacctggaccccagcttgaactctctcgtatatcaaaatattcttaaagttggcattcaaatgagaatttccagggtctcatgtctttacaatgagaaaaggataggccaggggatcctgtgcatagataacgtccactgtggggagacttcagacagtatttctttagaaactcccttcagaaatagagcgcaccaggagaaaccagagaggcctttaagaggcgggaagagtcattacctggcgctgtggaataacgaagatccctatggagatatctggttaacagacaagcaacctgaggaacacaactttagcggtaagtgtttggaaagaacggcagagggttttaaaaaaaatagttttcaggagcttgcgtgaacgggaaaggaaatgaaaatgcttttgtattgttaattacaagccaggagtggtaggtagacaagttttcttaaatgaccaagggatgctcaatgaaatttgcacagccagtggtttttgttggtgttttttgtttgtttgtttctttgattgcaaaagtggccaattcaggaagtgtgtttgactacatcttaaaattcagtctggcaaacgtactgatgtgggagtcagtattcctcatacgttcgttacatgtttgattgtggtggaattaatcttagttttattcccaatccagttgtggaaatagtacgttgtgtcggttgaagagcttatagatttgaatttagcataaaggttgtaaaaatttgcgggtttgcatgttttaatcttcattcaaaaaggatgctccgtgatgtattccttaatactttac

SEQ ID NO: 5774 - DNA, 1161 bp, Homo sapiens
gaggtgagggcagacagggtcctggtgttagaatcaaaagatctagcttcttgttgtgtcagttctgcctagaacctgctgaggaagtcctatagcttctctaggccctagtttgtcatctccaagatttttagtctcaaataaaggcatggggacaggaagccactttgacaaatatagaagactgaagagctgttattagaagcagccagttttaatagaagcctctctttgagggatcctcctagaagtcaagtactggctgcgttggaggtacagaggactctaggccttgtcagctgaatttgtcttctgggcatagggccaacatactccatggcccaaggactgggcaagaaagtttaacttaggatccttacttaatcttccctagtggggagattggagctgcaggagaggattaggagggtcaagattgaccgcagctcctgacttaaccccttctcacctaggtactttccctgctattctccccatctcttgctccaagagtcttgtgcatggtactctttctttggcagtaccctcctaagactacatgggacagggcacttggggttcccaggctcaaggaaggaactgatgtggccttctgggggtgatgatggccaccacagccctcttctgtcagtcagcctcatttctatatcccttgatctcactgcccctcataagaatctgagacacttgcccccttctctgaaactcacttccagctgccaagggcactagtaggtggcaaagccattcccttgaggccctactttcttgaaagtttgtccttagagcagttcatctttccttctacatcaattgattgatggcagttcagagaattgcaactggattgagagattttcttattgtttgaaaaagaagttgatttttgtcctgatcatcaaagtaaagcattctcactttagaacactggaaaacacagaaaggcagaatttagaaaacaaaaatcgcctacgatctccccggccataagtgctgtgaatgttttggttccaactgcattttcaaagagggcacttgaagagagtaatacctcagtcgaaagaaggaatttctaatgacagacttgcagaccagtgagggagagtccttgaaggacctcatggggaaactttatgactt

SEQ ID NO: 5775 - DNA, 1171 bp, Homo sapiens
aaactgaaggaaacagagacacacctggaaatgctgcagaaggctcaggtctcctaccggaccccagagggagatgacctagaaaggttaattactagggtttagttatcagcttgtgagtgctaatgggaagcatcccttaggacccccacttactggccgtagacaaaggaggaagccttaattcacaggccaccaagaattgagtaattacttcttagaaagctgcagccagtctccctgtgcttggtggcgttgtgctttcttctttctagctaatgaaaacataactgttgagaaatgtggttccattttgaaggggcttcattttattctgttggttaatgacttcatgtcatctcttctcctgccccctcactccttcatacagggctttggcaaagcttacgcggctacgtatccacgtcagctatctccttacttctgtcctccctcacttggagcttcgtgagatcgggtatgactcagaacaagtggatgggatcctgtacacggtgctggaggcaaatcacatactggattgagcaccagactgtatacccttctcttctcttatcttctgtctgttctcttttctctccctccctcacgtctctctctctctctctctctctctctctctctctctctcaccctcacctttatgccttatatagagaatctctgtgtaaatcctggctcataatcagtctcctttttatcagttttggtgtggagaaagaggccagtttaaataggctttcaagagtctagggtcagaaaagcaatagtcactaagctaggtgacctgaaagctttaattttcatgacctggatatgtggtctattgtatatctttttctgaaatggtttgtattcatttaggttagatcaatcagcagatattgggtccggtataccaggtattattttggggtaagctaacaagtacaactcatgtttgcagccttcgaagatgtaacaatctcgttggaaacataagacatacatcacattatacacaaaagtgtatgatatgtacaactgagtggtacagatatgacatggaagatctgggggaggaagttcaaggaaggcaccacaccagaaatgggacctaaattaaggcttaaagaatgagcatggccacactgtcagtgagtgttcttta

SEQ ID NO: 5776 - DNA, 1189 bp, Homo sapiens
cttctaaatgaaaaaaaagaaaaaaaaaagattgactataccaggcctcttaatccccttctgggactattggtgatgctgtactactgttaagacgttttctgcttacagtcagtgacagttttatcaatgactctggcaataccattgtgacccttgaaattaatctgtgttttgttttatttgatgaacattccacatatccaagtggctgtaactgatatcattaattgtgttataaaaaatgggtgttttgcatatttgtaatacttctctggattgtaaggggtgttcctgggaaaaaatgatataatttgatcagtagtaatagaacaagtatatggccaggacctgacctggctgtcttagcttagctttttggtatcactaaagcagtataggataccagggaaagggaagagggtggaagggaaggactctgtcttgctcaaagagcttagtagagacaggaacgattaaggaacctatccaacagattgtataaactgcccctcaattgtggccagtgagccacatttgtcagtgattgacaattatgtaaactggtgcctgtggcaaaaacatgcggcaactagacagtggcacccccctggggttgtggacgtgacacaattgttagactatggcaatatttgatgtctttggagtcttaaataattaactcattgtgaagacataaatcaggaggaatcgtgaacctatgtattttttctactttaattctatgttctccatttcctgaaaggatggacagccttacctttaaaactattacaaaatacctaagcaaaaatcactccctctaagtatgcttgctaccatcactgagatctaggcagaccattaagtcttttgattttaaactctaaccctttcagtgcctcttaggctataaacaggaatggcagtactctctgtgttctttaacagaggaggtgatgtaagaaagaagaaaataaaatgatcacaaataaactgtaatgtgtgtaatatgcatcatcttttaccaaagttgctccttcagcttttctccatagccactctttactgtatgtgtatacaaacagtaaaggggctaaaaggcaagaagtaataagacaaaaatggagcaaaatgctttgtatatgggagtagttattaatacttttttccaaagaccctgaagttc

SEQ ID NO: 5777 - DNA, 1203 bp, Homo sapiens
atgtccactgtattgtgcactttaaaattgtctagatggttgcttttagccacccgttcagaaaccttgtgccatcaagccacccaagtgctcttaaatttcctcgctacctgtggctacaaggtttccaaaccaaaggctcagctctgctcacagcaggttaaatacttaggtctaaaattatccaaaggcaccagggccctcagtgaagaacgtatccagcctacactggcttatcctcatcccaaaaccctaaagcaagtaagagggttccttggcataacaggtttctgccaaatacagattcccaggtacggcgaaatagccagaccattatatacactaattaaggaaactcagaaagccaataccatttagtaagatgggcacctgaagcagaagcagctttccaggccctaaagaaggccctaacccaagccccagtgttaagcttgccagtggggcagacttttctttatatgtcacagaaaaaaacaggaatagctctaggagtccttacacaggtccgaaggatgagcttgcaacccatggcgtacctgagtaaggaaattgatgtagtggcaaaggattggcctcattgtttatgggtagtggcagcagtaggagtcttagtatctgaagcagttaaaataatacagggaagagatcttactgtgtggaatctcatgatgtgaacggcatgctcactgctaaaggagacttgtgactatcagacaactgtgaggaaagtaacaaatcataaatccccatggccctcccttatcatatttttctctttactgttctcttaccccctttcgctctcactgcaccccctccatgctgctgtacaaccagtagctccccttaccaagagtttctatgaagaacgcggcttcctggaaatattgatgccccatcatataggagtttatctaagggaaactccaccttcactgcccacacccatatgccccgcaactgctataactctgccactctttgcatgcatgcaaatactcattattggacagggaaaatgattaatcctagttgtcctggaggacttggagccactgtctgttggacttacttcacccataccagtatgtctgatgggggtggaattcaaggtcaggcaagagaaaaacaagtaaaggaagcaatctcccaactgacccggggacatagcacccctagccc

SEQ ID NO: 5778 - DNA, 1178 bp, Homo sapiens
tcctcatcccaagtcagtatttttatatctttcctcctaggacttaccagttttcccagagaagacttccaaaatctttcttacgagggtactaccagcgttctaggagccaaatggcagaaaaggactgggaggacctcaacatttagtattctcttagtttccttgctttcagaaacagtgttcacatcttcagccatgtatggcattccccatcttctgacaatgagcctcaagttttctaccaggattggcaagttatcttttaccccatagcatattgtgagggagggtatttaaaaatcatattggcttttagacagccttcaactgatttgccttattttaaccccatcccttcacatttatttctgaaggtaagtgaaattatcagttcctgaactatttaaggattcttaagtggtgacaggtgtgttcttggctctctccactaccagtttaaaattcagctttcttcagtgtgctgagttggttcctgctcatccaattatttttcatcttccagattattattgctgttgtctccttttcttgttcctcctgaccttgttgatttgtgtttttttttttttttttttaagtgcctatagttttagagagttttctggatggaatgaaattaaatgaatgtgttcaatccaccatttttatgtgaaactaattctaatcataatgaaagagttttcttacggctgagcatggtgtctcacgcctgtaatcccagcattttgggaggccaaggcgggtggatcacctgagtttgggagttcaagaccagcctggacaacatggtgaaaccccacgtctactaaaaatacaaaaattagccaggtgtggtggcacatgactgtaatcccagctactcgggaggctgaggcatgagaatcacttgagcctgggaggccaaggttgcagtgagcagagattgcgccactgcactccagcctgggtgacagagtgagactttgtctcaaaaagaaaaaaacaaagagtgccttacctcctttatatgatattttggttgatcctcaatttgttttaggtattatacctgaagaaccttagccctcgggtgactgaaagagatcttgtgtcattgttcgctcggttccaggagaaaaaaggacctccaattcaattccgaatgatgactggac

SEQ ID NO: 5779 - DNA, 1164 bp, Homo sapiens
accttaagaacttattaaaagaagagcaaactaaatccaaatcaagctgatgaaaagaaataataaaaaatggagcaaaaataaatgacatagaggaaataatagaggaagtcaacaaaaccaaaagttagttctttgaaaagatcaacttaatttataatcccttagctagactgatcaagttaaacagaaagaagactcaaatttctaaaactcagctccactttggttcttatttgtatgggacatctttttccatctttttgcttttaatctatttgtgtttttgaacctaaagtgtgtctcatgacagcaaatagtttggattatattttctctttttaatcaattatttcaatctctgccttttgagtggagagtttagttcatttattttaatgtatttaattagagtctgttaaggatttacatctgctattttgctttttgttttctgtttctcttctatcttttttgttcctctgttcctccatttattccttcttttatgttaaatagatttttccaatgtgccattttaattaacttcttgcctcttttactgtttttgtgtatgtgtgtgtgtgttagtggttgctctggggattacaattaacctcttggcttaaataaattaatttgtattaaaaccaacttaatttcaattatattaaaaaactttgtttagctgttctctacctcccatactttctactgtaattgtcataccaattacatctcagaatgtggcttttcattgaagtgccaggcaggtcaaatagttccatccaggtaaaatagtgaaaattctccaaggatggggcttttatggtgctccagaactggtctgccactccagtttcagataggctgctggtttttgcagcttctgttgttgcaaggttgttggttttcaaggctactgcaaagctagagaaggggagatgggatgatggaaagtcgaaatgctacaaacctcactgtttaagttacattcatctcttagcatatggatagccaattgtcctggtgcctttagttgaaaagactattctttttcattgaattgtcttaatatctttgtgaaaaatcaatttaccataaatgtaagaggctttttaaaatgtttttttcctcttcattttcagcaatttgattatgcca

SEQ ID NO: 5780 - DNA, 1149 bp, Homo sapiens
ggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataaacttggtgtctgactgagtataaatggactgggtgggagaggcccctcacccagtaggggctgttttgctgaccccctgaatatcccttgagcaccctgtcagtgccaggcctatgctgcagccgtgatctcgtgtcatctgcacaatactcatatgaaggacatgctgtttgccctcactgtctggataaagaaactgagactcagcgagtttaagtgacttgcccaaagtcacatggctattacgggaattaggactcaagcccagatccttcctccctctcctgctccgctttcatatgagagcttcggagtgagtggcaaggtgactcataacacacaactgtagcttgagggggtgatttgggaggaaagataccccgaggaagg

SEQ ID NO: 5781 - DNA, 1194 bp, Homo sapiens
tgcagggtctcagccttatcttagtctaggaaaagagatgtcagtggagaatatgtgagagaatgatccatgcaaatattgtgagctggaatggtaatgttaatcagtctatcaggattcagaggtggccatttggttttatctatttgtgcatgaaaataaacataggcatttgtctaaaacaaggtttgaaggggaagaaagtcttcctgattagttcccaaattgcttttctattgcttaagcatctctggggaatccagcacgtaaacgcgcccattggttagtgtataattgtgttatatccattttcctttggaaatgcctaatgactcttgctttgtattccttgcaggtgaaagcccagcctccgtggttcttaatgcctcaggaggactattttcactaaagatggaaacactggagtctgaattgacctgtccaatctgcctagagttgtttgaagacccccttctgctcccttgtgctcacagcctctgcttcagctgtgcccatcgcattttggtatcaagctgcagctctggtgaatccattgaacccattactgctttccagtgtcctacctgcaggtatgttatctcgctgaaccaccggggcctggatggcctcaagaggaatgtgactctgcagaacattattgatcgcttccagaaggcttcagtcagtgggcccaattcccctagtgagagccgccgggaaaggacttacaggcccaccactgccatgtctagcgagcgaattgcttgccaattctgtgagcaggacccgccaagggatgcagtaaaaacatgcatcacctgtgaggtctcctactgtgaccgttgcctgcgggccacgcaccccaacaagaaacctttcaccagccaccgcctggtggaaccagtgccagacacacatcttcgagggatcacctgcctggaccatgagaatgagaaagtgaacatgtactgtgtatctgatgaccaattgatctgtgccttatgcaaactggtgggtcgtcaccgagaccatcaggtcgcatccctgaatgatcgatttgagaaactcaaggtaagggatctggggagcatcccctatacaactttgtcgcataaatgcagttagcaagttctctaataaaataggtgacttttcctatatgacaagtgagttaactttaagttgttctcatga

SEQ ID NO: 5782 - DNA, 1223 bp, Homo sapiens
aacatacagatcagggcttgttatggtgaaccctaaaagaccataaactctttctattatgttggattttttgttttttggtgaacatggcctgaataatgaggacctaaataacttttttgttacataaagagatttattctaatgatatggttatattaggattagatttgtgaagagtaagaatggaaccttttttgtaggcaaatatttttttgcctttgtaaagctccttgctaacccttcctaaatgttagcactaatccttgtgcctttttcccctggtatttctactacctacttcttttataggcaggttggtctcctcttcatattgcggcttctgctggccgggatgagattgtaaaagcccttctgggaaaaggtgctcaagtgaatgctgtcaatcaaaatggctgtactcccttacattatgcagcttcgaaaaacaggcatgaggtatggttccatcctaggctacttctgttgagttctaaacgtgtatacaaacacagatagatttctgcattgttttcttctttcttctccatctttccagatcgctgtcatgttactggaaggcggggctaatccagatgctaaggaccattatgaggctacagcaatgcaccgggcagcagccaagggtaacttgaagatgattcatatccttctgtactacaaagcatccacaaacatccaagacactgagggtaacactcctctgtaagtgacaagtagcagtcatttgtattctacctgacattagccttcttgcaataattcttatacatcatttctttttttattctgcttataaatgcaatacgtgttaatggcaaaaatgttaaattgcacaaaatataaagataaaaattgcctattatcttgccactcagaaataactactgatcacattcttgtgtatttcctcctggtcttttatattcaaatgtatatattttatacatacatattttttagcaaaattggggtcatactgtgtatgtagttttagctcttgttcttttcacctcatagtataagcatatattaaatatgtttaaaacctttttaatgggtatataaaattctgtatagatgtgccataatttaatcattcctctattactgtatatttaaacttttatgagtttttcactattataaataatggtacattgagccaggcataatggctcatgtctgtaatcccagcactt

SEQ ID NO: 5783 - DNA, 1164 bp, Homo sapiens
ccctctaatattagtgcccctcatactctcaagatggctgctgcagttccaggaatcacatgcagacactgcaatgcccactagaaagagagtatgaactattcatgtgtatctctttttactagcaatggaaactttctaaggagtcccacagcaccaccctgaaaacacctcttatttatcattggttgaaatcgtgttatatgtatatgcctacaccagtacattggcaagtggtatacggacataaacgtagagttagtccagtcactcacacaaccacctctccctgccctgcgtctggccaaaacacattgctacctagaaaagttggagggtggaaaatatgtaaataaactcatgatgttttggggggaaggaagaaacagtttctatttcacaacctcatgagtttgtcctcaggatcagttgatacaaaagatttgtaagaaactggtgtatttgttaaatgtgatatattacttatctagggaaacgaatgttttgtatagttctacaaatgaaagttgttgactgttcataggcattttagagctggagggacattagtgatcttttaggtcagtagttctcaaactgtggtctgtggacccctacggttcctgaaatcctattagagaacatgaggaatattttaacagtaatattatcttagtctgtttgggctgccataacaaaatacctcaggctgggtggcatataaacaacaaattatatctcattgttctgaaagctgagaagcctaagatcaaggcagatcaaacctaagattcagtgtctggtgagggccctctttctggttcacagatgttatggtctctctgtgacctcacatggtgaaaggggaaaggcgtttttttctctggagcgtcttttacaagggcactaatctcattcatgagggcttctccccgtgacataatcatctcccaaaggccccacctcctaatgccatcaccttgaagattataattttaaaacatatgaatttttttggaggggacataaacatgtatcatagcaaatacgaagaatgtttacttttctcactatgttgacatttgcactgatggtgagtaaaattactggtgcagtgtaccacattttcttagtagttgtattcgtcatactctcaggggggag

SEQ ID NO: 5784 - DNA, 1217 bp, Homo sapiens
attttagttttgatataaaaattccataagatgaaatgcagaaatcttaagtgaacattcactgagttttgacaatacatacatctgtgtaatccattccccatcatgttatagaacattaacatcaccgttggaagttccctcctgtcatccttctagtgagttttctcctatgtaccacctaaggcatactttgatctgattgttttccagcacggaattatccacctgatttagtattttacataaaatgcataatttaataggtacttttttatgtaagactttcactcagtatgctattaatgagattaatccatattgttgcatttctttagtgactgagtcatattccattgtatgaatataccaatgaagatttatttttttttaattttttttattttttgaagttttaaagctgggcatccgggggagacatcacatgtcagtaggttccgtgatgccccacaagccgcaaaaccagcaagtttttattagggactttcaaaaggggagggagtgtacgaataggtgtgggtcacagagatcacgtacttcacaaggtaatagaatatcacaaggcaaatggaggcagagcaagatcacaggaccacaggacccgggcgaaattaaaattgctaatgaagtttcgggcaccattgtcattgataacatcttatcaggagacagggtttgagagcaaccggtctgaccaaaatttattaggcgagaatttcctcttcctaataagcctgggagcgctatgggagactggggtttatttcatccctacagtttcgaccatagaagacggccacacccaagggggccattttagagacccaccctcaggggtgcattcaccaatgaagatttattatcataatgatacttaggctcagtttagtttctgtatattgtgaataaaggtgcagtgaatatttttaagcaggctttgtgtgaacctatgttttaatttcttttggattaatagctgggagtggaattgttgagtcatagggaaggtgtatgcttagtttcatttaaaattgcctcagttcaggagaatggcgtgaacccaggaggcggagcttgcagtgagccgagatcgtgccaccgcactccagcctgggcgacagagcaagactctgtctcaaaaaaaaaaattgcctcagttttctcaaaatggttatatcattttatattcccatcaa

SEQ ID NO: 5785 - DNA, 2417 bp, Homo sapiens
ttagcaaaactgcaacattctgctcatgttatatgtcaatgaaactaatatcttgattgagcatttccaacattttaaaggcagaactgagaaacagctatttgttcacatacaacactgtgatgttctgcctgaaaatcgattgagtatttccaaacctattatttttcatttattgtgaaacctacatttacctcctaaaagaaacaaagctcttcaaaagtctcttcccaaggcccctccctgcttctctgggcctctccccactttcaacctctattctactttttcttattctttctccattttccccaatgcacactcttcctcttatgcccatggctactataaagagatcaatttcccatattcaagaaattagtgtttacttatcaatcaatattctgacaaaaacttaagccaaaaagaacctcttataaggccttgtttccttctggatattgagccaatataagatgtaccaaattaaaaaaaaaaatcagagcaagctcccccccgttctatttttgcttgcctctgatgtaaactgaattaagattttaggtacctggacctttgagaacgtgacactagcaaggtggtgaccacagagaataggtacaaaggtcttgaagcttgcttagagctttgttccgtggtggcacacaaatcttggcttgctgtaccatcattggcaaacctcatcatatcacagttgggtgtgtttgtatgtgtgtgagcactagtgtgtgtgtgtacatattcgtgtgtatgcacactttgtgtacctgtgtacatgtgattgtagatgtacctgttgtgtgtaaactctgttaaaatgaaatttgcttcgcatttaatgtgcaactttgaagtagtgtaatatttatctaaaggttttcactacttggttttaatgtctttgaacgtgtacttctatcttcaagcaagcttatagtacgtgttgctaaactaacttttccaaagaaccgagttgacttctatttttccttgcctaccaaccaaagggatggtgggctcttttttccctcttgtaaattgtgctgaggagaggacgtggctatgagatcagtcattgttccagttactggtcactgctagggcatcaactttatcagttccttcagactcttctctttttccaacctaatcaaataacgcagtgtggcttttgttcattataacaacgcgctctttaggcaactttttttcaagccttctgtcaccattttattttttcaagtaagttaagtaataattgttcagaattgtgggaaaaaagattacttgggggaaaatactgtatcactttatttgcatattaggttcagaagctgccagcagacagggtacagagggtacagcacagatgtaacagttgctgaataaatgaatgagaaacctcatacacagtagtacgtattatacaaatagtaacaggtacacatagtcacaggtactgcataacaaatgcaatcttgttctcattatttattagtttacagacaattaatttattcagtattgtgctggaagaatctttgtggaatatgtttaccaacttatcacttaccttccagctatcagttcatgctgctaagaaaaaacaatgatggaatatttttgtgtgtgtgacctctacatttaatttgatatcaggcatagtcacttggtcgttaaaaactgaaactttacagttccaccagctaattacatctgctatttctgcttcacagatatgctttgagttgctttggctttgtcttcctttgtaaatactcttgtactttcttttccttgtaaacatctcgtttgcagttttgggagacgactttgcaactctgtatagtgtttatatatatatgtatatctatatatatctgacttgcctttccatacagctactcacaataaatgtgttcatgtaaattattcctgtagagattcattttttaatactattgtctctactttattataaatatattttcctgctttgtagtaggattgactgcatttttcagaatgaaacaaatggggtattttagggtttgggctaaaggtactttgcctagaaacatgaggcttttcaatagagtcaataaagtcaactcttgatttttcaaatgtagaggtgatactagtgtagaacaatttataaaatgacttacctaaaatttcatgcagaccttggataatgagtgaatcctatattgaagcaactactcaaggaggttgaggtgatcatttactttttttttttctgtctccttcccttgacacttaatcttgctctttaaattactctttttttttttttttgttttttttgagacggagtttcactcttgttgcctaggctggagtgcaatggtgcgatctcggctcaccgcaac

SEQ ID NO: 5786 - DNA, 1053 bp, Homo sapiens
tccacctgccttggcctcccaaagtgctgggattataggcatgagccaccatggctagcatttttttaaacttctaatctacaagaacaaacctatacattgaatcttaatgaagagacacaactagtaagagggaaatgtactgttcccactcagtgcttcatccagctgcaaatttgttacattttaaaaatccttgagcccaggagtctgggtggggctgcagtgagccataatgatgccactgctcttcaccctgggcagcatagtgagacctcatctctttaaaaaaattgtaaaacctttgatgagaaaatgaatacttaaaatgtatatttccagtttaatagacaatcttgtacttgaagcccactctgggggatgttttccatggattcttttaagatgtctcaaataaaatagaatacttggtactttgtggtgacctgatcttaaggtaacactggcatcccataatcaatttgctgatcatttattcctatcccttctctggtccagcaccttcttctatgtatctgatcaccccctgccacactccccattatgcacccactcaaaagcagaaagccaagagaataatgctggaacttttttcttttattaaacagatgggaatttcaagtctcctttgcaggtatgactttgttctattagaagaaattcaatgattgagtctagagaccatcaccaatgctgtacttaaatcctatgacttgtgccacataacctggtgaaggcagagtcaaacatgtagaagaagaagaaaaaaatctgtttctctgcacaatgcctggctcactcttgggctccactggaagaaagtagaacagtgcacgcacgtgcaaagatgctgtccaccagaaatgtcagtgacagcctgggggcaagaagaataactgcccttgtgtctttgcccagctgatattcctcacaggcagccagcagagttgattaaccatgtccatgcccaggcagtctcctctgtatatctctcaaaaacttctagttagattttgttttgttttgtgttgt

SEQ ID NO: 5787 - DNA, 1816 bp, Homo sapiens
ccttcctggactccctgttagaatcagcttggccagagagcccgcctcctcctctcggtcctcccttggcccacaggcctggagattgaccgggaggatttggcacagccggaggtggctccgcctcccgagcccgccgtctcctcccttgctcacctctactggtggccgctcgcgcccctccattgcgccggtagcaggatccgcagcggccgccgcgtgaggctgtggtcacgtgttgttttgcccgctgtcgtgcgctcagagtggagtgggcgggggcgcgggccaaggcaggagggggctggggcgggcagacgagggtagacagcctcttcccccaaccctccctttcctgaattccccctcctcctcgctcaccttaaaaccatcgtgcatcaccatggcgagttgctccttcactcgcgaccaagcgacaagaagactaagaggtgcagcagcggcggcagcggcagctctagcagcagtggtgaccaccccgcttctttcctcgggaaccccgaccgcactcattgggaccgggtcgtcttgtccgggagccatgtggctctccacggccactggctcccggtcagactccgagtccgaagaggaggacctgcccgtcggggaggaagtctgcaaacgcggctacctgcggaaacagaagcatgggcacaggcgctacttcgtgctcaaactcgagactgctgacgccccagctcggctggaatactacgaaaatgccaggaagttccggcacagtgtccgcgccgcggcggctgcagcagcggcggccgcctctggcgccgcgatccccccgctcattccaccgcggcgcgtgatcaccctataccagtgcttttccgtgagccagcgagcagatgcaaggtaccgacacctcattgctcttttcacccaagacgaatacttcgcgatggtggccgagaacgagtcggagcaggaaagctggtacttgctgctcagccgcctcatcctcgagagcaagcgccgccgctgcggcacgctcggcgcgcagccggacggagagccggccgcgctggcggcggcagcggcggcggagccacccttctataaagatgtgtggcaggtaatagtcaaacccagggggctggggcacagaaaagagctgagcggcgtgttccggctgtgtctaaccgacgaggaggtcgtgtttgtgaggctgaacaccgaagtggccagcgtggtcgtccagctcctgagcatccgtcgctgtggacactcggagcagtatttcttcttggaagtaggcaggtccactgtcatcggtccgggagagctctggatgcaggtcgatgactgtgtggttgcccaaaacatgcatgagctgtttttggagaagatgagagccttgtgtgcagacgaatacagagcccgctgccgcagctacagcatcagcatcggcgcccacctgttaaccctgctgtccgctaggaggcacctgggcttggtgccgctcgagccgggaggctggctcagaaggtcccgctttgagcagttttgccacctcagggccatcggcgacggggaagacgagatgcttttcaccaggcgcttcgtaacacccagcgagcctgtggcccactccaggcgaggaagactgcacctgcccagagggcgcaggtcaaggagagcggtttcagtgccggccagcttttttcgccgcttagcacccagcccagcacgtccccggcaccctgcagaagccccgaacaatggagctcgcctgtcttctgaagtgtctggttctggctctggcaactttggggaggaa

SEQ ID NO: 5788 - DNA, 1506 bp, Homo sapiens
gtatgttaatttcatatctggagactttactaaatttatcagatataagtgtattggtggagtttttaggtttttctagatgtaagatcatgtcatcaacaaagatagacaatttaattttctattttaaagtttggatgtcttttattattttttcttgcctgagtgctctggtttggaattccagtattatgttgaatataagtggtgaaagttgacatccttgccttgttccagttctcagagaagagtccacgtagtctttatttgttgaggtatgttccttctgtgcctcgtttgttgagagtttctatcatggagggatattgaattttattgactgctttttctgcaacttgagagagaatcatatggcttttattcttctttccattgatttgatgtatcatatttattgatttgggtatgttgaatcacccttgcatccctgggataaaccccacttgaccatgctgtatcatttttttcatgtgatattgaatttgatttgctagtattttgttaagaatttttcgcgaaggcccgcggcgggtgttgatgcgatgtgatttctgcccagtgctctgaatgtcaaagtgaagaaattcaatgaagcgcgggtaaacggcaggagtaactatgactctcttaaggtagccaaatgcctcgtcatctaattagtgaggcgcatgaatggatgaacgagattcccactgtccctacctactatccagcgaaaccacagccaagggaacggacttggcggaatcagcggggaaagaagactctgttgagcttgactctagtctggcacggtgaagagacgtgagaggtgtagaataagtgggaggcccccggcgccccccggtgtccccgcgaggggtccagggcggggtctgccggccctgcgggccgccggtgaaataccactactctgatcgttttttcactgacccggtgaggcgggggggcgagccctgaggggctctcgcttctggcgccaagcgcccggccgcacgcaaaagagctcctgaaggaagcgctaaacatggaaaggaacaacgggtaccagccgctgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagaatcaagacccatcagtgtgctgtattcaggaaacccatctcacgtgcagagacacacataggctcaaaataaagggatggaggaagatctaccaagccaatggaaaacaaaaaaaggcaggggttgcaattctattctctgataaaacagactttaaaccgacaaagatcaaaagagacaaagaacgccattacataatggtaaagggatcaattcaacaagaagagctaactatcctaaatatata

SEQ ID NO: 5789 - DNA, 1132 bp, Homo sapiens
ctaaaaataactgtaattatttgaatgactaagaggaaagtacattttttgaaatgctgaaaattgcctttctgtgtttattcaaactgaaaagctgagaccaagagcaaggaaggtaaaaagttaacaggcaaacattttctcttagaaaaggtgataaaatcataagtatttggaattagaacccttgcacagcactgaacctgggaaagagatttaaactctgaatttatctttgataacagggattgattttaaaatgtacatgtattaaattacatttgtaatttaaggtctgtttgctgttgctgattttattcttgatcagtagtttgcatttcagaaagcctttcattttgctttaattttagcaaagcgggttataatgaatgacttccccaatatcttgcttgaacttacaggtgattaacttggatgagttttgggaagttaaagggaagaaaacactgttatcattttttcctgtttgggaagagcttagaaactggaaatactagatttgggagaagggcagagttacttgataagggactgatgtttgtgcagtaacttgggagtgtggtttctttttgaatctttaattaaaacctgggattatatatccctgataaatattcacacttgaaccatagttactgtaaaatgcaaaaaatcttaatactgttattctttgcactttttcttaatcattttttatatatatgcatatatatatgtgtgtgtgtgtgttgcttatgttgttttgtacagatgtgggccaccattgcaacaaaatacattctttttgctctaaaatatttatgaagaaaatacttaaatgttatgtatatggtggtaataagggaaaaatcaagtattataaacaagaatgaaggtttttgtaaagatttctgttcagcgttttgcaaggtaaaattttaggcaagttttccctgaagttatgtgtatgtgagtattctcattcttcccaacttgcctttgaagagtgaaataccattattatcaagtagactactgttcagcttttattcctgccctgctgtttatcccttaagaatgagtttcttagacttttccaatatgtgattttttttcccatttagaatggtga

SEQ ID NO: 5790 - DNA, 1216 bp, Homo sapiens
ttaagaacagaaaagctcatttggtgattttgtctgatgagcctcccttcccctgtcccactctaggcaacacagttgacctagaccagttccagtatttccagtttgaccgtgtttgacctacactgagcttcggtgcctcagtggtcataattttagcaagtggacctataggaagcaaccctgggagggaccgtccttctgcagaggcctgcgggcattgaggctatcaatccccagggcttggggagcaggaggggagggcaccaagtgctcttactctcctgagctccttttgatgcgtaagctttgtttttggccctctttgaaggcagggccaaacttttcttagtgcctctcaccttagggtggccctccagggaaggtgctccttgaatggctggattggccctgcccaccgtcaaactgctacatgtaggaatagctgatgaggaaatacacaaggcctcagtgccccttggcctctttacaaaaggagaagttggaaggggattgtgggaggagcccctgggggcctggtctgtcctccaccagaacttggagttgctgccagcagaggatctgtgcctcagctgaagactagctccggaatgtcataggggtgtgactgtgtaggccttctcctcctcctcgtttctgtggcatggcacaggttgcctggttgctcgagccttccccatgttgacatcctccacaagcttgcctttgctctgtctacagcttagtaccccattctggagggcactttctggtgcttggaaggagagaagaaagcaaaagccacatgcctggcatggccaagccagagacagatccacctgtcagaggaaggaagaagtaaagggggcatgcagggcttttgggggccagattggctcagaaacatgtaggtcaaaagaatagagggggcccagtctataggcttcacaaggagccatggcctgtatttggggcattggggagcataaggcatctgaactggtccagatctcactcttatcttgggccaagccaacgtggagagaagcaacccaaccagactcttggcagcctgccttacagggtagcccaccttatagggtagccctcatatctgccctgtgccggccctctactgccccagctttggtacaggagtgagggagaagctggagcttgcacacccagtggccagtggggctgtcttcccagctcc

SEQ ID NO: 5791 - DNA, 1789 bp, Homo sapiens
ccctcagtatttggttttgtacaccaaagatgatctggcccatcttcctcccagaggcacaacagtaacatgttcctctgtcagcctgtgaaggcatgcagggttctgaagccacagactcagtctccccaagtcagcaatctctttctctctctctcctcaaacttcatcgcattcatagaagctgcttgcagggtcgccgggctaaccagggtgatcggcgaactttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaacaaagctgttgttttgaaaactcttgctttcttttggtgtccattttgtgttctattttaaagaatctttcatttatattggtgttattgtagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccccacacagtggcttcccttagaaccagtctttgtactctccctaaacagcagcaggcttaggatttttgtcaggctggttcttgcgtgctctgtgcccccaccagtttgctcacctcttggggcattttgtaatgtgttttctctgtcttgtaaaaccttttgattgtaccgaaatggtatctgcagtcgcctttggaaataaatggtcattaatttgtgtacttagcattctgaattttagtctcaggtgtttctgttgttgaagatccttgaatgaaaaggaaccctcaccatggggcttactgttataatgtttcttcatttactgttattaaaagatttatgagaacccaggagtcctggccttgcttcccagaaccctctcagaaggccctctgctttgaaaaatagacaaaaggggcctctggccctccgtactgtggaagaccctcaaaggacagctgggctttctcagcacacttttgtcctgggagctgcgtggctggttgcccttgaattcccacacattgcctacttctgccagggacccagcaggccatttgctcttagcagagggcttgtctgccgggcacgtttgctgggctctctggtacccaaagtgcattgggctaggctggaggactgagctggagaagg

SEQ ID NO: 5792 - DNA, 1177 bp, Homo sapiens
ggctgaggggacaataaaatttttaaaagaacaatttaaacaaggagtagtagagtgcaaagagcactggactcagacttttgatttccaagttctgatcttagctttgctacttactatctctgtgaccttgggcagtcactgcttctctctgggaccccgtttcctgatctataaaattatctttaaggtccttcctagcagtgacaatggcatgtcacctacttctcaatgttaacttttctcttccctgactttctttcaggtatcgtagtgaaaagatgaccctgagctatgctgaataccttgctcatcgccagcatcatcatttccaaaatggcattgggcatccccttccgccatacaaccattattcctgacactgagccgcacaaccagtcactgggcctctctgcagacctcttcccaggagaccctacaccttcttggtctagctatctcttttactgtaccattttatgatgatagtttccgttgccatggtgaagcttcgacatcgtcaactaagatcatcatggtaacgggtagaaaaatggcatttgttaagatcctgttttattattttagatcgttgattttttttttgcagcatatataattttgggtttttttttccttataatattatgtagaattttgctttgctgtctcagtcaggtttctgtttttctgtcctccttgcctttcttcccgttttgcttcctgttttccttcttccttcccgttttccttcttccttccctgcctcccttcctttgactgtggatggaagaaagtgtgcagtttttagggattttacttaggttcgtctttagttttcctcagtaagatagttgttttttgatacctgagtttgggattaattcatatcaaattcaggtatttgtatattactcttgatttttgtctgaaattcactttgctatgacagcctagtagttgggtcttcactccttaagtatatgtttttcccatggtgaaaatacatgaactttagttctagtagtgagcattcaaaggtccgtgatagggcttgtcacagagagagagaaatcatttatccctattgtgctggttatcatagaagagactgcctcaccactttatagaaccaatttgcaaactaaaacactgtttggagaaggtacaaactacc

SEQ ID NO: 5793 - DNA, 1109 bp, Homo sapiens
gtcattttgaatgtataattgaaagacctagtttgtagttctgtcaacttaagttttttaacttttgatttctagctataaagcttcgtggggaccttaacttatttcaaattgtgttgaacaaatttgatttatatttgtaggtgcaggaagctgtttggagactctggaaaaaggaaagccactcgtagtggttataaacgaaaagttgatgaacaatcatcagctggaactggcaaagcagctacacaaagagggtcatctcttctattgtacctgcaggtatgctagagactgattattattatctcttgccttaattcgtcccttgcacttcctcttatccacctacctaacccatctgtctcttctgcctcttaccttctcccagttaccaaaccttttgattttctcagctgtaaaatcctcccatttgtttgtctcccattttgcaatctctgtgttgtatttctatgtgtatctgtggctgtttctttgcatatgtgaatatctgagagagtgtgtgtatgtgtgtttatttaggcgtgcatgtctccaagacactaattttggagttctaaattttgagttcattatttagattttcattattcaaggaagacaatttgctcattttagttaaaagttttgcctatagtaaatccactaaaatccctaaattatatttactctttcatttattcagttacacccaatatataaaaggcactgttttaggtgctgtggatacagtagtaaacatgagataaagtccctgttcttatggtgcttacattctagtggtggaaaattgataataagttcacaaataaatgatcaaggtatttcatgtggtgaaatgtactatgaagaaagtaagacagggtgatgtggtagctggggtgaagactgattagaattgtcagagaaggcttggcagagtacctaacattttgatctgagacccgaaatacaaggaagagccagtcatgtgaagatttggaggcagaaggaacagcaagtgcaaaagcctaagtaaggaatgaacttggagcttggtgtgtttgaggaacagagggaagattagtgttgcaggagcatagtgagca

SEQ ID NO: 5794 - DNA, 1238 bp, Homo sapiens
tgttgaggtgaagatgggtgtgtagtgggaagttgattgcaaacacttattaattaatggcttttctaggttcagagcaatttaactcaattgaaattgtacacttactcaaaatatggttgttcaggctagaaaggacatttttttttctcttttgggtaggagtttagcaattcacagatgtaatactgaccatatgggactattctgactggtggctatttatgttttttagaaaaaaaattgttatcttatgtattttagtaaaaacaaaacaaaacaaaacctcaaaccccagggtccacagttgtggtagttaggggagataagatgagctctgagtggtgaaagaagtttgaaaacctctgatgtggtacttcatgccccacgcatgattttatttagtcttcacaacaccctgcacagtgggtgctgttatctccattctgcaggtgaggaaactgagagttacagaagttaagtattttgactaatatcactcagatgaagttggggctttgtccaagagctgcataactttaaaatgacaggtggaataaaataaagattttcagattgcttcagaacctctctctctctctctctctctctctcactcactctctctctgtctctctctttcaaatccatatcttatctgagagggttagattgaaaaaggtatgattatctgaaggccaaattcagttatagcgcttgagatgatgttgctctgacaaggacagaggaaggagaggagtgattattaaggtatataagaaccagcaaatgtcactcaaatgacaaagtcataaagatggatgtcaaaaggaaatttaagaaaaaaaggcaaagaggctgaggagttgagtattctcagcatggaatttagaggggaaagggagatcaaaaggaagtggggaaattttgatgcctctcatatactaaacactataatatatataaagcttatacgatgctaatagcttatcaccagactgcctgactttcacaaggatcctgtgagaaagttatgctcatcatcattgtatagttttgcattcaattctccagatatacaaatatcagttaaacgccaagtactggctagtgtgaagaaactgagattcagagagattaagtaacttgccactccaaggcagaaccaaatcttcaacccatgtctgaccaattctaaaacccaccgttcagcacatcccaccggggttttaaaaatt

SEQ ID NO: 5795 - DNA, 1099 bp, Homo sapiens
gagaaaccaatcccacttctttctaggagattgggtatcttagataatcttttggggttcctctgtgagtataggaatggtatccttcctaattatcttccaaaggaattattttgtgtgtgtgcctgtgtgtgtgtagagacataaaggagggtgatgtgattttcagctagtcctttcacattttcaataatgaggtaatcatgttacatacacattagtcctcagttataaagtgaatctcagatagaaattaaaagtgcagttgtgttaagactctttcatactaccctttagtcataaggagaaaaaaacactcaaatagtagaagcagcaagtagcaaacttcaggagagctactttctatccaaataatttaaaaaacacttttcacctactcctttcatggttataacacattggcagactttttgctggctctgggagccatgattttaatcacattctgcaaggtgacaaatgtcatacattccacattgtgtggtagccatctctttagactcatgtgttttggggaaaggaagaagttcttggctgagtactattttgaactttccagaaccctctcacaccagagacagttcttctctgttcagtttccaatccccgataatttgctaaaataacattgtacatccaagagagggaagaagagtatgtcagtatattatgcagaagatagatacagccttttcagaagatctccactagtttttgttccaaaaattcaagtttatgggagaaatctcaattagccaccttttcacagttgtgtggatataacatttgggggatctttctggactcctacctatctgtgcattttaccggcacctcaggaaaggagggtgaccaggttgtcttagcttgtactgcttggtgatctctgaggaccttctaattcagttgtaccccagtgttccatgtatagaaaaacttcattagaacaaactttacttgatatgaaactcctattaacagtctttttttgaaataaaaagtagcttgagctttcttttaaaatcatgtatcttgattgttgatttaatgaaggatttccttttaatgctgcttttga

SEQ ID NO: 5796 - DNA, 1177 bp, Homo sapiens
aagggagaaaatagtaactttacaacggggaaactcagcaaaatccaacttaaccaagtgatcaagttcaacaacaataataagactattgacatcatgagctgcttaatatgacacactgaggtcacaacaccatcttgtgatatgtttgggaaaaaccccataatcttaatctagttatgggaaaatatcagaaaatgtttaaattgagggacattctatctgaataactgaccaatgcttctcaaaagtgtcaaggtaatgaaagaaaaggaaagatgattgataaactgtcgctgattggaaaagacaaagcagaaatagtaagtaaattcaatgcaggatcctgagcaagattatgaaagagaaaaagtgcactaatggaaaaacttgtgaattttgaagtaatgtctgtatttagtaaataatcttttactaatgtcaatttcctgattttgataattatactaagattatgtaacaataacattgggagaagttgggtaaaatgttatataggagcgctgtattatttttgcaacttttctgtaagtttacaagttcaaaataaaagattaaaagacgttgttaggctgggtgcgatggttcatgcctgtaatccccgcactttgggaggccaaggcgggtggatcgcttgagtccaggagtttgagaccagcctgggcaacatggcgaaagtccgtctccacaaaaaatacaaaaattaccctggcatagtggcgtgcacctctagtcccagctacttgggaggctgaggtgggaggatcgcttgactcctggggggcagatgttgcagtgagccagatcacaccactgcactcaagcctgggtgacagagcaggaccatgtctcaaaaaaataagaaaaaaatgttgtcaggaaagcattacaaaatttcgagaattactctgttagtgccaacagaggtgaaccaacagtcaagttatacttgtatattggttgagaagttaggaggctttgaaacagcagtttcaagaaatagatatagcaacaattgtagttgaagattttaatgtatgcttcttagaaaatgatataacatacaaacaaatataaacatcactctccatgatgtacttatttcacattattccctgtattaaagcatctcatgtaccccataaatatatacacc

SEQ ID NO: 5797 - DNA, 1181 bp, Homo sapiens
aaatctaaatatacattttgatgaactttatatatcctgtacacttgtattttccttccttccttcctctctttctctttctctctctctctctcttttttttttttttttttttttttgacagagtcttgctctgtcgcccaggctggagtgcagtggcgcggagatgagatttcaccatgttggccaggctggtctcgaactcctgacttcaagtgattcacctgcctcagcctcccaaaatgctgggattacaggtgtgagccaccacacacctggcccacttgtattattttcttaacttaaatgcttaaagatatgttattgatggattaaaacatgagtgtacatttaaagcttttgatatgttgtctccagaagcttttatgtttgcattcccacaagtaacacatggatagctttacttccatacttgttaacactatacattatcaatctatttaatctttgccattctaaaaagaacaaattatatcaaaatgttttatttttcatttcagtgattaaattagtgatgatgagtattatttcaagtttttattgcctatctatattgcttcttttgtaatttgtttgtttgcatctgttgtggtcagaagcactttctattgttgaaatatattgagtatttttatggcccagaatatggcctatcatggtaaaagttctttaggaacttggaaaaaaatgtattctgtggttattggttagagtcttatataatgtcaactatgttaagttggttgatagtattgtttaaatcttcaataccttacctattttctgttttcttgttctatcagttagtaagagaaggttattgaaatctccaacactaattgtagatttatctttctccttgcagttctataatttttccttcatacattctgaagctctattattagatatataaatgtttaggattgtattgtcctcttggtgaatttgtactgtcattctgaaatgacttttctttatattcttgataatattctctgctctgaagtccacttttctgatattaatattgtcagtccagctctcttttgtttagtattagcatgatgcgtgtttctccatccttttatttttaactgatttgtgtctttgtagagaaagcgcatttcttatagttagcatatggtagtatcttcctg

SEQ ID NO: 5798 - DNA, 1179 bp, Homo sapiens
ccaaagtgggtggatcacttgaggtcaggaggagttcaagaccagcctggccaacttgatgaaacccagtctctactaaaaatacaaaaattaggtgggcgtggtggtgcatgcctgtaaccccagctacttgggaggctgaggcatgagaatcacttgaacccgggagatggaggttgcagtgagccaagatgggccactgcacttcagcctgggcaacagagcaagatcctgtctcagaaaaaaaaaaaggaaaataaattaaacatatatatacatatatatagaatgtctctgctatatatcctaatgcaattatttacatagctttagtaaaactccttcttatgcttggcaatgaaatgcaaagttgtaattaagtttgttaattttcaaaggtcttgcaaaagttacatgaccttcattttctaaattgtttcaaataaattattccagctaagcttaaacttttagtttcatagtattttcctctattcccttggttttaaaaaagtaaaaatgggccaggtatggtggctcacacctgtaatcccagcactttgggaggccaaggtgggcggatggtttgaggtcgggagttcgagaccagcctgaccaacatggagaaactctgtctctactaaaaacacaaaattagccggtcgtggtggcgcatgcctgtaatcccagctactctggagactgaggcaggagaatcccttgaacccaggaggcagaggttgcagtgagccgagatcacgccactgcactctagcctaggcaacaagagtgaaactccgtctcaaaaaaaaaaaaaaagtaaaaatgataagaaagaactgaagatttgtgtctatgatattgattcactacacaagaatttgcattttactttctactttagtaaagaaatcgcttaagtggatgataaaactatttgagtacaagctttggcttgacaagaaatctctgaaatcagagatagcacaaggctgactactgtgctggagtcttctcaatgaatcttttcaaagctgcccgttgtgatactaatgagctcactgttttgtgctgttttctctccacaaggaaagacttgctttatcatctgtgagctaactcctgctgtacttttttcaggaagccataaccactcttgatctatacatctttttcagt

SEQ ID NO: 5799 - DNA, 1161 bp, Homo sapiens
agaaaacaaaaagcaaaactgttctaattggaactatcaatatggaatttttgcatcccagcataataattatatatgaggaaatagatgtcttacgtggtgtccttaactgacaagaatttcatcctgattttgtttccccctaaaataggtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagcttttcttattcttttattcttaagatcagtatctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaac

SEQ ID NO: 5800 - DNA, 1318 bp, Homo sapiens
gggtgagctttgctgatagcaatatagtgtccccagccagtacctgggtgttccccaccttgggcatcatgcgtcacaacaaacaggccactgagaatacaaaggaggaagtgaggcaaattctggggctgttggatgctcacttgaagacaaggacttttctggagggcgaacgagtgacattgactgacatcacagttgtctgtaccctattgtggctctataagcaggtcctagaaccttctttctgccaggcctttcccaataccaaccgctggttcctcacctgcattaaccagcctcagttctgcactgtcttggggaaagcaaaactatgtgagaagatggcccagtctgatgctaaaaagtttgtggaaagccagcctaaaaaggacacaccacggaaagagaagcgttcacgggaagagaagcagaagccccaggctgagcaggaggagaaaaaggcggctgcccctactcctgaggaggagatggatgaatgtgagcaggcgctggccgctgagcccaaggccaaggacccctttgctcacctgcccaagagtacctttgtgttggatgaattgaagctcaagtactccaatgagacacactctctgtggcactgccatatttctgggagcactttgataaggactgctggtccctgtggtactcagagtgtcgcttccctgaagaattcactcagaccttcatgagctgcaatctcatcactggaatgttccagtgactggacaagctgaggaagaatgccttcgccagtgtcatcctctttggaaccaacaatatcagctccatttctggagtctgggtcttccgaggccaggagcttgcctttccactgagtccagattggcaggtgggctatgagtcatacacatggcagaaactggatcctggcagcgaggagacccagatgctggttcgagagtacttttcctgggagggggccttccagcatgtgggcaaacccttcaatcagggcaagatcttcaagtgaacatctgttgccatcacctagctgcctgaacctgcccttcagggagaaggggtcattaaagaaaactgaacattggaaaaaaaaacatttttggggttgttatttttttatttttatttttatttttatttatttatttatttatttatttatttatttatttatttatttttgagatggaatctcactcttgtcgcccaggctggagtgcagtggcacaatcttggctcactgcaacctctgcctcccaggtataagcaattctcctgcctcagcctcccaagtagctgggattacagg

SEQ ID NO: 5801 - DNA, 1141 bp, Homo sapiens
ggcaagggataaaagactacacattgggtacggtgtacactgctccggtaatgggtgcaccaaaatctcagaaatcaccactaaagaacttatccatgtaatcaaacaccacttgtttccccaaaacctattgaaataataaaaaaagttaaacagaatgggaggctccggcggctcgtgctcgcgcacgcagggtggaggcagggagcgcacgacgtgcgcgcaccctctgccctggtccatcgctgccgcctccttcttctgcagctcctggtgctgcttgtgtgctcgtttggtgcggacctggtacctcttttgtgaaacggcagctgaggagattccggcgcttgccatggccgacgaaaaacccaaggaaggagtcaagactgagaacaacgatcatattaatttgaaggtggcggggcaggatggttctgtggtgcagtttaagattaagaggcatacaccacttagtaaactaatgaaagcctattgtgaacgacagggattgtcagtgaggcagatcagattccgattcgacgggcaaccaatcaatgaaacagacacacctgcacagttggaaatggaggatgaagatacaattgatgtgttccaacagcagacgggaggtgtctactgaaaagggaacctgcttctttactccagaactctgttctttaaagaccaagattacattctcaattagaaaactgcaatttggttccaccacatcctgactactaccgtatagttttctctattctttcatttcccccttccctattcctttattgtacataaagtaactggtatatgtacacaagcatattgcattttttttaactaaacagccaatgatatgttttgattgacatcaagtggagatgggatggggaaaaatactgattctgtgaaaataccccctttctccattagtggcatgctcattcagctcttatctttatattccagtaagttattttgctctcactgttttaacaaaaacaacaacaacaacaacataaaaatccttgcatacctttttcaattggagaattttaatgattttcatttatcattgtaaaaccaaggacaattttataactttttcgtacatagctgctacatgtagggcaatctg

SEQ ID NO: 5802 - DNA, 1429 bp, Homo sapiens
tcacacccggaagctgactggtccacgcatggccaaagcatgagaaaactcattgcgggactcattttccttaaaatttggacttataccatagggacttcaactgaccttcctcagactgaagactattcccagtatatacgtcaagtcactgaggtaggaaaaaagttgctacagtcctattattttatggttattataagtataccaggactctaaaaagaacttgtttgtataatgctattctatacaaggtatgtagcccaggaaatgaccaacctgatgtgtgttatgacccatctgagcctcccatgaccacagtttttaagattaaggactgaaacctggtgggggctcataaacgatatgagtaaagtgttagccaaaacaaaagaaaaaggggtgcccaaacaagtcaccttgaagtttgatgcctgtgttgtcattaatagtaataagttaggaataggatgtggttctcttaattaggaaaaaggctatatggcaaaaaaaaaaaaaaagtacatttgtcataaattaggactgtatggaaatgaacgtgcatactggtcttgtgtcatttcggctacttggataaaaaatgaaaaggatcccgtccaccttcagaaagggaaaagtggcccttcctgtacaagtggtcagtgtaaccccttagaactagtaataaccaacccccttgatcctcactggaaaaaaggggagcgtgtaaccctaggaattgagggggctggactggatcctcgagtaaatatcatggcttgaggagaagtttataaacgctctcctgagccagtatctcaacccttctacgattaactgaatgtgtcagtaccagaaattccaggaaaaacaagaaatttgtttttacaattagctgagcatgtagcctagtctctcagtttcacttcatgttatgtatgtggaggaactataatgggagatcaatggccatgggaagcctgagaattagtacctacagacccagttcctgatgaatccccagttcaaaagaatcaccctgataacttctgggtcctaaaagcctcaattattagacaatactgtatagcaagagtggggaaggacttcaaccttcctgtgggaagactcaactgccttgagcaaaaactgtataatattactacaaaaacagccacctagtggagttcaaaccacactaagaaaaatccatttagtaaattcccaaagttgcaaaccatgtgaacccacccagagtcccactgggactgggcagcccccactggattatactggatatgtgggcatagagcttacaccaaattaccctaccagtgggcagatagttgtgttattggcactattaaaccatctttcttcctactgcccataaagacaggcaaactcctgggcttccctgtctatgctt

SEQ ID NO: 5803 - DNA, 1174 bp, Homo sapiens
gatttcaacctttagatgagttctaatgctgaaatgggcccagagacagtggactggtggggcacataacctactgaaacatcagctggggtggctaagaaagtgtgggcattacctctcccctaaccccaagctacatagctcacagctccaaaagagaccccttccttctgcttgatgagagaggagggaagagcgaagaggactttttattgcatgttgaataccagctcagccacagcaggataggacactggtcagaatcccgaggcccccattccaggccctacctcccaggtaacgtttctagacacaacccaggccagaaaggaacttgctgccttgaagggaaggacccagtcctcgcagcatttattacctactaaccgaagagccctagaccctgaatagcaagcagagatatccaggtactactttgaaggacttcagtgggactctgagacttactggcttcaaacatgtctcagcacatttccaactgtagtggctacagggcgagacttcttctgcttaagagcagaggaaagagtaaaggggactttgtcttgaaccttaggaaccaggtcaaccacagggggctgtaccaagtgggctcttggagtacacaattccaggacttgcctcttcaatggtattcctggacctctcctgggccaaagggaagcccactgccctgaaaggtgagtcccaagtcaggcagcattcatcacaaacagacataggagcccttggacctaaagggaacattgacagtggtctggcaatactccccatgggcctgtgatggtgatgaccacagagtgaggcttctttacatttggaaaggggaggggagactggaacgactgcattttgtgccctcactgacagctcagccacaatacaatagaacaccagcaagacttctaaggttttggactcttcttcctgactccaagatggcactcttggacccacatggggcctgggagcactcactgctctgaagggaagggtgcaggcctaactttccacctgctgattttagagtcccagggccttgagtaaatataggcagtagccagggagtggttactgcaggcgttggaaaacatgcagtgctgtgctggcttcaggtctgacccaacacagtcatagtggtggtggccacagg

SEQ ID NO: 5804 - DNA, 1199 bp, Homo sapiens
cactctaggcgccttccttctaaagatatgttggaaacgcaccagacatctcggtccctcatagcaaatgttccacctgactgcgtctagttggccatcttgctcgatcctctttatccctttgaataaactttctacccctatctttttctctacctcctctttaaaacgaataacttttagatttgaccttttgaggctgttttctacattctgtaggtgtgctttattgtttttccttcctttttctttcgtttcctctgtatatttccaaatagcatgtctttaagctcactaattctttcttctgcttgattaattctgcaattaaagggctcatgcatggggtgcagtagtgcatgcctgtagtctcagctacttgggaggctgaggaagaaggattgcttgagtccaagagttctggactatattgcactatgctgatcaggtgtccgcactaagttcggcatcagtatggtgacctcccaggagtgcgggaccaccaggttgtctaacgacgggtgaactggcccaggtcagaagcgaagcaagccaaaactaccatgctgatcagtagtggaatcatgcctgtaaatagccactgcactccagcctgggcaaacatagcgagaccccgtctctaaaaaataaatgactctgatgcattcttcagtatgccaattacattttccacctccagaactttcacttgattctaattttttcaatctctttgttaaattattctgatagaattctgaattctttctctgtgttatcttgaatttctttgagattgctaaacacagttttttggggttctctgtctgaacgtccccatatgcctgtttctccaggattggtccctggtgcattatttagttcatttgatgaggtcttgttttcctggatcgtgttgatgctagttgatgttctttggtgtctgagtatggaagaattaattatttattttagtattcactgtctgggcttatttgtacctgtccttcctagcaagactttctagacatttgaaaggacctgggtgttgtgacctaagctctaccttctttagggagtaccctaagctcagtaacactgtggttcttgcagattcgtgaaggtaccaccttgatggtcatggaccagatcgaggagaattatctggattaccaggcagagactcttgttttctctct

SEQ ID NO: 5805 - DNA, 1155 bp, Homo sapiens
ttcaggtttgtttacatcaaaattcagaatttaattcaacaaacttttatagagtctgctatgtgcagatattttccatcctcaaggactttataatctactatgaattataagaaatgtggtgataatggcattttttacttagtgctcagtagtgccaaataccgtttccttagactgcttcctcacaggcacctattaggtagaataattattatcttaattttacagataagtaaagtgagtcctagagatgtcaagtactttgcccaaggtcagtcacacagcttacgatgatggtcttgggaataaagcccaggtttgtctggtgctgaaggacttaattgacaaaggactataataccaaacttattaacaatgactctggcatgaaaacctgctgggcagcctccaagaaaccaaagcctgtgggtcccttgcggcagagtgacagagagtagggttgcagagttgacactcagaggatgtgacagaagggcaccacgaggtgtggagcctgaggctgaatttgactcaagagtggaaacttcacctggcctggatacggaaaggactgtcaggactgacagattgatagctctcttgattctgtagaagactgtgcataattgtcttaaatcagtagcgatttacatgatcaatcccattaacaagacaatacagatgtgataagtggcataagggagctttatataaaacgccgttgtgattcagataataaaaaataaaaataaaagcttgcatttccacaatgctttctctgtgtcaagcactttgctaagcgccttacaggcatcatctcactcaagcttcgcaacacttaccttatgaaatgagtaacttttctcacgctcatatataactctgatacatttagcatcttgttcaaggccacacgactagtaagtagtggagctaggttcaaacccagatctgtgctgggtgcactggctcacctctgtaatcccagcattttgggaagtggaggcaggaggatcaattgaggtcaggagtttgagacgagcctagctaacatggtaaaaccctgtctctactaaaaatacaaaaattagccggatgtggtggcgcgtgcctgtagtctcagctacttgagaggctgaggcaggagaattg

SEQ ID NO: 5806 - DNA, 1183 bp, Homo sapiens
gtttcgccatattcaggctgatcttgaactcctgacctcaggtgatccgcctgcctcagcctcccaaagtgctgggattacaggcgtgagccactgcgcccagcctctcttccactttttgttttccacattttctacgtgcacacaagacttttcagtcacaaaatatatacacattttttaaatgtggacttgtctgtagtaagtgtatagaagtatttgtcttctcatctcctctattcaacacctccttacttttatttctgaacaggtctccaggaaaagttgggctttcaacattcaaggtaagttgtgctttctgaaagttatgtttttagaaattgtatactttttattcgtgtttttgtgtaattcttcattttcttgcttttgcttttttttacttactttttgctcagtaatgtagtcattatgtcctacttggtatacataggtactctagaaatacctaactaaatattatgctgtaaagaaggaactgtaagtattttttagatttctactgatttttatttgtttataatatctagaataaaagaacgtgtgtgtgtgtgtgtgtgtgtgtgttgaaaaagtgatacttggccaggcatggtggctcacacctgtaatctcaacacattggggggctgaggtgggcagatcagttgaggtcaggagtttgacaccagcctggccaacatggtgaaaccccgtctctactaaaaaaaaaaaaacacacaaaaattatccaggtgtggtggcgcagacctgtattcccagctacttgggagactgaggcaggagaattgcttgaacccaggaaatggaggctgcagtgaactgagatcgtgccactgcactccagcctgggtgacagagcgagactccacctcaaaaaaaaaagcaaaaaattaatacttgcatgacaaaaatgtacagtaactgaaacacatgtatacttcttgtgggcccatgtaccatcactatatataaaaatcaatcccagcttatattcaggcagaggagtttggtattgagatattatgccactgagagccattttaagtataagatatcaccaaatggaactatttatatcagatagagtatatattgtatatgtatatttatatgtatgtgtaatctcaaacatgctatatttttttcagttccagtatac

SEQ ID NO: 5807 - DNA, 1148 bp, Homo sapiens
aaaggacagactgaatggtattcgacgagtcctggccttcatatcccgaaaccaaaactagtgagtggattgccgaagaggagctcccaccttccccactgccgtcggggggagtcttcttgtaaatatatctaattgcaataatatcttaacagaagggggtgtcaaacagaggcatcagcctgctgttgatcacagagagaaattgagtagaaagaccaaaagaatgtgacctatttgaaactttctgtcttaagatgcttcttgacatgctgcataactacataaacagcagaggtgtttaagagcccagaaaaacataatttgattttaacattaaaatttccaaaagtttaaagtggttttgctttaatattctttctttcatagatcaatgactgtgtggttgaaatgtgaaaacaaagatactaataatgttgctgtataatttcactgacttgaggtctcattccaaatggttcaggttttatagagcattgtgtaaaataatgttcatacttctttctgttttaataatttattttttgcactactgtatccttttttctacatgtatgtttgtaactatttaagcgtacattgctgaaaagtccattgctttatttattgatgtggtttaccatgtacctagggggaaataacaatactagaagtgtgcagtttttgcttttatcttttttttactacaatgacactagttcttagaccatttccgtatctatccaaatggatgcttaaaagaagttcagaatgatgctaagatcatctgtcttcagagtccacttttttttttcagtttgaactaaacaatataaaatacttaagggatttggcctagattatggtatatgccaaggtaaagtaaaataattcattttctgtgtgtaatacagaacaaagctgaaagaattatttttattataggcatttacttcagcaatctaattgtacgtgtatctaatttttccccagtgcagttaggaatcggattttgggcaggatcataattaactcttcagaggaaatggtgttcagtttagcacatcacagtcatgcccaactagcctccataacccacctctccccggggttctgaggatcaagacctggacagaaacacttgataa

SEQ ID NO: 5808 - DNA, 1222 bp, Homo sapiens
aaaacatagtgattacaatatttagaaagttttgagcacttgctataagttttttaattaacatcactagtgacactaataaaattaacttcttagaatgcatgatgtgtttgtgtgtcacaaatccagaaagtgaactgcagtgctgtaatacacatgttaatactgtttttcttctatctgtagttagtacaggatgaatttaaatgtgtttttcctgagagacaaggaagacttgggtatttcccaaaacaggtaaaaatcttaaatgtgcaccaagagcaaaggatcaacttttagtcatgatgttctgtaaagacaacaaatccctttttttttctcaattgacttaactgcatgatttctgttttatctacctctaaagcaaatctgcagtgttccaaagactttggtatggattaagcgctgtccagtaacaaaatgaaatctcaaaacagagctcagctgcaaaaaagcatattttctgtgtttctggactgcactgttgtccttgccctcacatagacactcagacaccctcacaaacacagtagtctatagttaggattaaaataggatctgaacattcaaaagaaagctttggaaaaaaagagctggctggcctaaaaacctaaatatatgatgaagattgtaggactgtcttcccaagccccatgttcatggtggggcaatggttatttggttattttactcaattggttactctcatttgaaatgagggagggacatacagaataggaacaggtgtttgctctcctaagagccttcatgcacacccctgaaccacgaggaaacagtacagtcgctagtcaagtggtttttaaagtaaagtatattcataaggtaacagttattctgttgttataaaactatacccactgcaaaagtagtagtcaagtgtctaggtctttgatattgctcttttggttaacactaagcttaagtagactatacagttgtatgaatttgtaaaagtatatgaacacctagtgagatttcaaacttgtaattgtggttaaatagtcattgtattttcttgtgaactgtgttttatgattttacctcaaatcagaaaacaaaatgatgtgctttggtcagttaataaaaatggttttacccactatagtgtggtgacttatttaaatttttttaaaaaccttattctagggaatctgattcagacattttactttggcttaaa

SEQ ID NO: 5809 - DNA, 1264 bp, Homo sapiens
gcacaactcaaatccatgttgttcaaaggtcaactgtaggccgggcgcagtggcccacgcctgtaatcaccacactttgggaggctgaggcaggccgatcaacggaggtcaggagtttgagaccagcctggccaacatggtgaaaccccgcctctactaaaaatacaaaattatcctggcatggtggcacacgcctgtaatcccagctactcaggaggctgagacaagagaatagcttgaacccaggaggtggaggttgcagtgagctgagattgcaccactgcactccagactgggcaacagagcaagactctgtctcaaaaaaaaaaaaaagaaaagaaagaaaaggaaaaaaaagaaaaacaaaagttggttgctttctgtaaatgtgaccagatttgaatgaatgcatgtaaatctatgctgtactttgctggggaggtttttgtcagggataaggatgggggcaaactatgttaagggaagtgatgacaagaaagccttccctgcgattaagaaattataataatatatgcttaactggcaggggagataccatgatcacaaaggtggttttcccagggcgaggcttatccattgccctctggatgtgctgacccctgcgatttccccaaatgtgggaaactcgactgcacaatttgtggtagtgggggactgtgttcgcgctttcccttgagaaaaaaaaaaaagaaagaaattataggccgggcacggtggctcacgcctgtaatcctagcactttcggaggccgaggcaggcggatcacgaggtcaagtgatcgagaccatcctggctaacacggtgaaaccccgtctctactaaaacacaaaaaattagccgggcgtggtggtgggcgcctgtggtcccagctacttgggaggctgaggcaggagaatgccgcgaacctgggaggcagagtttgcagtgagcggagatcgcactactgcactccagcctgggcgacagagcaagactccgtctcaaaaaaaaaaaaaaagaaagaaattataataatataataataactaccacttattggtcacttaatgtatacaaggcagtttattatcccatttaactgtctttattgaccctatgaaataagtactcttagtactcctattttatagatgaggaaacaaggcacaaggtgtaagtcacttacccaaccatcacatagctagtaagtaagtggcgaagctgggacttgaacctatgtctctccttcctcaggccctttttt

SEQ ID NO: 5810 - DNA, 1097 bp, Homo sapiens
ctctccagtgccggctctagagggcgctcctgggctagcgtgtagggctggcggcggcggcgctcgggtcacctctgggagcggagtgggggcggagcgagacggaagcagctcaggagacttgaggcgtaggctgcggtccccaaggtgaccgcgccctatgtgggactcgccctaatgcctctgaacctgggtttgaggtaatgacctttctcctaggtctgaaggtcacgggtccgctggaggatgccccctctccactcagaggggtggaggcttaatgctactggtgcagatcacctcttcccctgtgacagcctcagagggttgggagggtccagccagtatgatatacgaagactagatttgagagaggggagcctaccttaaagggcattgatcgagatggcataagctcttctctttcccttccccatggttataactgtccctgttggcttccttcctgtctgttaggtgcagcatgccagcaagcagatcactgcagataagcaatacaaaggcattatagactgcgtggtccgtattcccaaggagcagggagttctgtccttctggcgcggtaacctggccaatgtcatcagatacttccccacccaggctcttaacttcgccttcaaagataaatacaagcagatcttcctgggtggtgtggacaagagaacccagttttggctctactttgcagggaatctggcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtaccaaggctttaacgtgtctgtgcagggtattatcatctaccgagccgcctacttcggtatctatgacactgcaaagggtaagtttgctgtgggctttaacgttgtgttcttaggagacagtttaaaagagcattgtaccaacctaacagtccaagagctaaagagttgtttttttaattgctaaaggaagccaagatcatccaatgcaac

SEQ ID NO: 5811 - DNA, 1143 bp, Homo sapiens
agaaaaatatatattgatgtgtttgtcacctccctactcctgtcattacatttactttattaaaagcaaaataactgttgtgctgtttccatcttccttgccaagttttcctaccccttctaccctctccttaaacatcagaaaacaccctctatgaaatcaaatgtactgtacctgggttacttgcaaaaattactaatgcttcagtttttctgttgtatttcatttccagttttcaggcagttatttttattattgtactttaagcttttaagatgaattgttatacaagaggtgcttatgcttagcttgatgaccaggatgttatttttaacaaaatgattgctgaagtgtttcatcctggctggtccttcacttgtgttggatttagaagtgaatgtgtttggaatatggcctacagagaatagaaacaaatccatgtaaacaattttgaaggaggcatgggagctaaaaatcctgtgatactaagatctcagtcatatgaattacaacgtagtatttactggcaagaaggagaaagttgaaggactcagctaaaggagtacagcaattgtagtaactgacacatcctctctttgcaagctgctgactgggcacactcatgccaagtttcagaattattggtcttctgggtttttgctttttaaaagaggtgtgggagcagaggaatggaaacaatcgtgagtttttgagctagggaaagttggagctcctttaatctttttaaaggatcagtgctgccctaagtgaataaactcaattgtccatctttattttagagttttaatgaattcaaggaagggagcatagcatatctgtggcaaactattttccactcaaatcctgagttattgctgcatgctttaatttcttccctttcagcatctgagaaccttaaagccaatgtctgcgatctttttttggatatttatacttttagatatatagtacctttaagtagcagtatgggacaaggcttgtaaatgttttgtctaatgttctattgtcaccttttatgcatttatcacttccaaatctaactttgcacaagtaacccatgtaaaaaaaaatgtacatttttcaaaagttgtaaataaaaataaccttaaaatttcatagtca

SEQ ID NO: 5812 - DNA, 1168 bp, Homo sapiens
ctcaaaaaaaatatcatgcgggagcttttatatgtttgtgacccattatgagggggttcagagtatgtctgtgtacctccaggtccattgaatcaaaagtgggtacaagtacacttggagagagtgggcttcgccactactctgatcctagttaagagcctagccttcaaattattttgagaggataaaacttgacttggctagtttttaaacacatagggaattattttttttactctccagaaagaactccaaacttgttagaggagagaaaagcagtaccctttgtattttgtggtacctaaaaggttatgtgaatgggaacagctacattgctgtcagactgcctttgtaacttgacatttttttctgtgtaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaattgctgttgtattgtggtttgtcaattactgaattctcccttccctgccaaacctaataacaacactatccagtagaactttctgcaatgatagaaatgttctctggctaccatgtgcttgaagtgtgtttagtgtaaaggactgattctgtaaattttattttatttttttttaatgtatttatttattttgagacagagtctggctctgttgcccaggctggagtgcagtggtgcgatcttagctcactgcaacctccacctcccgggttcaagcaattctcttgcctcagcctcctgagtagctgggattacaggcgccccccaccacatccagctaatttttgtatttttagtagagatggggtttcacaatgttggtcaggctggtctcgaactcctgaccttgagatccacccacctcggcctccccaaagtgttgggattacaggcatgagccaccacgcccggcctcacatgagttttacaattaatcaactcccccattcacgtctagtgcagggaaatagcaatcgcagaattttatttttagtagagatgg

SEQ ID NO: 5813 - DNA, 1099 bp, Homo sapiens
tttaccactgtcacgggtcttctgtatcattggattgtgggtcacccgcttcttttccggtcgaaccacagtgcagccttcgtcgctactgctgccgctttctccgggctctgggtcgcaggccgggcgctttctgcgtccagcagcccctttccgcccaggctttttgaaaaggaaggtgcacacctgatccaccgcctttcctggagaaagctgctctgccattttagagtcctgagctccgaaacagccgtggctgcctgggttgcacttggcccctgcacgtcactccacgttgcgcgctccgccgggagtcgaagcaaaagacactgacggaagaggactgcgagagcccgagcgcccgtctctcttgtgccctagcagattccgtcgcttcttccggagccgtacgtggcaccgccccgctcgcgggcggccgcggggcttgctgggaagagaggcgaagccaggtcacctttcaaggacccagaagtagggttttggcctaggtaacggggcagagatgtggttcgagattctccccggactctccgtcatgggcgtgtgcttgttgattccaggactggctactgcgtacatccacaggttcactaacgggggcaaggtaagccggcttcggcccgggggccgactccacgggctgatttccgaaaagggtggtgggcagggagaccgtcagcctgcgaaccctctctccgaggtcggccctctacttgcttccggttgcctagaagccgaggcttgcgaaacgaagcccgatagaaactacatcctgctctagtgaaaaacagcgtttctgggtgtatcagagtgggccttagggcagagtagcgacgcgggggccgggaaggtagattagaaaaggtggctcaagcctgagaatcgctcactgcaacctccgccttctgggttcaagagattctcctggttgggcgcggtggatcacgcctgtaatcccagcactttgggagaccgaggcgagcggatcacctgaggtcgggagttcgataccagcctgaccaacatggagaaaccccgtctctcctaaaaatacaaaattagctgggcgtggtggcgc

SEQ ID NO: 5814 - DNA, 1189 bp, Homo sapiens
cttgactttgaacttaaagctttaatcataatttctcatgtatacatcgttcttctgatggtaagctggatttgaaggtagtggtttcagtgtttcttaagttggtagctgagggtatcaggcatcagttcatgcaataatacaagaaaaaaaatcctttgcttgccaagaggtagagtgatgtgcatttatctgttttctgttctgtaagtctagaccttcaaaccatttgtaaactaacccctgggaaatttgaaattacctgataacttaagactctgtgatctctggaatcaccatatgtttcttttttgtgtagatattaataacattactctttgactatagtgtgcactctgaaatgtactcagtgaaaatttgttttgagtttcattaatgctatttcaccagttagacataattacttctaccgatgtgaatgatacggatgccggcagagcttccagatctttcagactcaactgctaggtcaattagtttgtcataataaaacttggcagattctacaagtctattatgacaaaccaggaactaattctataatggaaaactatccattctgaataataggtatgtaattatttgctgctgctgctgtgctctgtaaattctgaatatgacatttaaactctgtgcctactaaaggtatcttctggagtttttgggaggagagaaactggaaaattaaattgtatttttgccagaagactcttacttgcatgtgtctcagggtcttcagtttttctataagtttccatatccaaagttcagaattcatgtgaaatacttctttggggcaaaagtccttcattcctggtatttattggattggaaatctgtagcaagatgctgtttaaaattaccatattgtttttttatcttatacttagctctctggctattgaacttccttttcttgtttgaagttagcttcaaatttgctcctatgctaaattacctgtaaatattctggataggaactacttgaaatagtaatttgttaaaagatatgacaaaatgaaaatgcttaaactacagaaatttaaaaatgccataacaatcttgcgagactaactttaaaatatactttaaatgattattatgattttggtggtaacgatcccccacacacaaccactatgaagaaataatgccgcatttttccccc

SEQ ID NO: 5815 - DNA, 2454 bp, Homo sapiens
gaagcagtgtaattaatggaaatagttgagtggactttttctcagtggttaacatgcccattttaaagagtaatacttacctttaagaagaatgttgttgaactctttgcatgttatttagtatgatgtgcagaaaacacttaagaacgtacctggtcttcatgaattcctctttggaactgggaaagagatccctgtggctattaaaaaggggggagggttcttacacaccattaattatgaagcaaaaggtttatttgcttaaaatgtcatttaaagatacttaaactgcatgcaaactttatttactgtacagagttctggatgtatttatcaaatagaaaaaccacccttgacttggttgttcacccgttttgtgatttcccttgaaaagagaaatgaattgtcatagctattgatattttactaggtgatgttctgttacactgaaagggatgttttttaaaaaaaattatttggaaacaagttttcaagtagggggacagttgcttacataatatcttgtatattcacatcctaaaaattttcatttatgagtatgggatgtgtgtatatggcttagccccaagttaactgtgctgattaacaagtacttataaaaatagctaaagtagaaaattaatgatcagttgtactagaggaacatcatagaagagaaaaatccaactctttatattaaaaatgaatacaataagaaaattgcaaaagagaccaaaatgaacgtgttttgtaaattgttacaggagcaaaaactttgcaactagttttcaacatactttagactttaaatgttgtttggacagttttgtcttcaacttggaccaattgtagattgttacaggcttcctaggatttagcattcctattttctctaccaaagttttttttagaagcatcccaactcttctctttgttgataaataagcctttcctgtcatcttcattttaacttgctaaaaccctagatacaaaggtcctccctcatttttcccacagagcccctgtttgggaatttgagattctgtgtcatgctggttttcctttcagaattgcttgaaatcgagttctcttagccactggacacctagttttcaggagaatgtcccaagattgtttatatatacaaaatggcaaaagtactgtttttcgaattgataattcaagcaaaggcttctctttactgtcactgatttttttttgtttttattttgtttccttgtttctatttccttgaagctttgaagggaggagaagcagaaaattttgtttatgtttgttaaaaatcagaactacttaatgctttttgccacagcatatttccttgcctgttggagccgttaggaagattacctatgtcctaatcttcaacctgagaagatttttgactcttgtgtctactgttgattgtttgcttgagttctcaaagacctgtggccaggtattttaaaaagtcgtctatttctttctagttgcatcaacttgcacactggtgtctaactatatgtggtattcggaacttgtaattcttattgagcagccattgcctatattttctcagctcctcactgatttctttatatgagctcagctgacaagcaaatgcagctattttgtttaccctctcttcataccggaccatcaacaacagtgttctaactcatccctgatggtctgtgagatgtagactattacacaagattcaagttactcgtaagcaacttttagatagagttggtcctgttaggaggagactcttgatgtcaccttcagtatcttgaaagcgggtcccctccccgaggctcttaattctttgaaaacttgatgctgtttcagctgaaaaattagcaagactgttaaaaaaaaaaagttgaggggagctgtttaagaaactgaaaagtaattgcaaactacattggataattgtgactttcagttgttgttctgtatcagttgaatttttgtgctcttttccctgtgtacgtggtggttctatttttctccaataaaacttttatttaaaaaaagtttctagagaagatctttaaaattcaagtattgtaagaaagttataaaatcacaggacttaaaatcttcctaacaacttctaatgaactcacatttgttgattttgttatttttaaactttttaaaaattttgtaatggttttgtggtaatgctataagagtatgggggagggcatggttaacagggtgaggaaaattcccaggaatcctcaaggtggataattattcttaaacatgcggatacaagtataaacattgcttcattcaaatcctcagtgtcaaattgtttcataaagtcaatatgaaatgagtctagatttgagttcaggggagaagaaaagattactcttagttatggcatttgctctgccttttctgttaatagttttttgagttctgggccagata

SEQ ID NO: 5816 - DNA, 1175 bp, Homo sapiens
cccagaggaggatgccaaagctccgtgcgtcactctcagaatgatatctcccataattaagagcttctggtgctgtccatttaatgggaatctgctttaagtcagaagatgagtacacaccaccatcctcttgacgagacattccaaagtcactgattttcagaacattattttcacctccaggcagtttcttacagcaaggtccctgtgtatacattttttactcgagatacaccatccagaatcagcatctaatgaaaatttcactgagttttagttcattcttctttctctgaaaggagaggaaatcgcctccaggaaccagttccttaatgacgtagataggccgtctttgtgtgtgaactcctatacttttgacattactgggatgattatattgcttgaggattttggcttctagtaaaaattttaatttcagttcctggggaagacgttcttgacgtgttttaacagcaacagcaattttatcctttaatgtgaccttaaatgtgtcaccaaaatttcccttgcctcttgtaacgtggcacctttatgattgagaacccatttcttattctcctaatggccatactgtgataccatgatgctcttaattggaacattgactttttttttttttgcaatttaaacaattgagataaaattcatataacatcaaatttacctttcacttttttttttttcttttggagaccaagtctcgctgttgtctcccaggctggagtgcagtggcgcgatctcggctcactgtgacctccgcctcctgggttcaagcaattctccttcctcagcctcctgagtagctgggactacaggcgtgcaccaccacgcctggctaatttttgtatttttagtagagataggggtttcaccgtgttagccaggatggtctcgatctcctgacctggtgatccacctgcctcggcctcccaaagtgttgggattataagcgtgagccatgacgcctggcctcaaacttgccatttttaaagtgtacaattcaatggtttttagtatatccactatgttgtgcaagcatcaccgctgtctaattccagagcatttctgtcaccccaaaaagaaactccatgcctattagcagtcactcccagttcttcccttcctcggcccctggaaaccagtaatgtactttc

SEQ ID NO: 5817 - DNA, 1194 bp, Homo sapiens
caaaacactatgtatagtctgagccagatcaaagtatgtatgtttttaatatgcatagaacaaaagatttggaaagatatacaccaaactgttaaatgtggtttctcttcggggagggggggattgggggaggggccccagaggggttttataggggccttttcactttctacttttttcattttgttctgttcgaattttttataagtatgtattacttttgtaatcagaatttttagaaagtattttgctgatttaaaggcttaggcatgttcaaacgcctgcaaaactacttatcactcagctttagtttttctaatccaagaaggcagggcagttaacctttttggtgccaatgtgaaatgtaaatgattttatgtttttcctgctttgtggatgaaaaatatttctgagtggtagttttttgacaggtagaccatgtcttatcttgtttcaaaataagtatttctgattttgtaaaatgaaatataaaatatgtctcagatcttccaattaattagtaaggattcatccttaatccttgctagtttaagcctgcctaagtcactttactaaaagatctttgttaactcagtattttaaacatctgtcagcttatgtaggtaaaagtagaagcatgtttgtacactgcttgtagttatagtgacagctttccatgttgagattctcatatcatcttgtatcttaaagtttcatgtgagtttttaccgttaggatgattaagatgtatataggacaaaatgttaagtctttcctctacctacatttgttttcttggctagtaatagtagtagatacttctgaaataaatgttctctcaagatccttaaaacctcttggaaattataaaaatattggcaagaaaagaagaatagttgtttaaatattttttaaaaaacacttgaataagaatcagtagggtataaactagaagtttaaaaatgcttcatagaacgtccagggtttacattacaagattctcacaacaaacctattgtagaggtgagtaaggcatgttactacagaggaaagtttgagagtaaaactgtaaaaaattatatttttgttgtactttctaagagaaagagtattgttatgttctcctaacttctgttgattactactttaagtgatattcatttaaaacattgcaaatttattttatttatttaa

SEQ ID NO: 5818 - DNA, 1169 bp, Homo sapiens
gggcccctctgcttctcccccgccccatcatctccagcgcgtggtgggggaactgctggggaaggcgattggcatcgatctctccatcccttccgaggcccgacttcggtcagttttcttcgggcaacaattttctaaattggctggggtctggcggtgttggcccccgcgcgcagaccttgccccgaagggggccctgcctgcctggcatgggcggaggggggaagggcgggagtggaaggctgtttgttggggggttttggcgccacttttgttttagttttagtgctgcttttcattcccacccccacccgcactgtctttctcaaggcacgaactgagctgatccttgccccaggtaggcagcctgtgcgttttcactccacacttttattcttgctcggggtcgactttcttttttcttctcccctggatccggagatctgcggacggcgattttgggacgaaaagggtcggatgggccgtgggagagagaaggtgtgggaaacagcatcaagtagttccgcaaaactttgagccccgttcccattttcttttggcctagaattgtgaacgtattgttgatttcggcctttttttccccccgtcgcgagaatgtcttgttttgcctttagttttttataaaccgctgtactttcgacatttagtttccgctcccccttggtgcatatgtcattttatttttaatccttaactgtaatgggttatcgtgtgattttcgtgcttcagtgctcggctttaatttttaatattgtattagtagtttcatccggtttgtgagactttctcttccgtggcctagaatgttttttatgttgttgcctaccacccctcttccctctccctccttctttctcttggatgtagtttttaaattgagggccatggtgttggattaaatggtaatttacagtttacatgatatatctattggaaacttttgatctgtaaggttagatttaaagtaaacgaggcgcttgtgttggtttgcaatggttccttaaaatgcgcgggccacccccttctcccaccataaagccccatcttcccttcacactggagtgtaaattccataccccttttctcccacggaccgccgtatttcgcagcagccacaccctgtatttgtctctgtggattggactcat

SEQ ID NO: 5819 - DNA, 2133 bp, Homo sapiens
ttaaaaaaaaaaaaaaacaaaataacaatctgaagaggcatttggtacagatatgaattctcttacatttatttactggttgtactaaataatgatgacctctgctggatttctgtttacatccagaaaacaatgttaaggatgtatttattcccctaccctgaagaaagtgtaggatagaattgtttttagcattctaaatttaaatgcttaaaacgtcaatcaacaaaactttgttttaaatattgtaattgtggagaaaagtaaacttataagcagaacttttacaattttttcatctaaaagtattttaagatatttttaaaatccaagagcttctctatacttttcagaaatatccagatgcagtgaactgccagaaggtaaccagtctcaaacatgcttatcccattatcaaccctgaaagtttgcttgtcctttaagataaaaatgtaatgttgtgatattccttccagtaatgccactgtattttgtctccaaataaaagaagcttattgtagtatgtttgcagaaaaattctaaacaaaaattatacagcttattagagtgtgggaatagggatctaaattttaaataaaattatatatatatataaattggtgctgattttataattgcgcagtttgtttagttttttcttacttttaaattccaacttaaaattatgaggtttcagaaatatattgaaagtttaacaatgtttaaaaatagaaaagcatgagtgttcatgctttaaaatgatttttaaatttgtattttatattgttttatctatctgtctttgcaagcagtcttcaggttaaagatacttctaacaggttacagtacatttcctctgtatgtaaattagatgggataatagaattcataacccataatattctttgaaagctaagctttaaacttcattttatgtcctttcacaaataaattagtttaaaacagaaagtggctacttgccattttgacatcaactcattttgcgaggcttaggcagctagacatcgtttaaaacaaaatattaacttatattacatgtgtatctatctattgtcagtcgtctctcagttcttgaggtatattattttaatcattccatgccttaatatgcttgcaatacaagaatatcttcagatgggtgaataccaaaaggctttcagtttttagtcagaaatcaagcattgggctgtggtagccaaaaaccataggttagctaaaaagatcatgatacaattattttattaagtcatggttaataacaaatgaatccagacttgtctaacagattttccatcaacaaatattgttatgtgcaaaagtattgcctatgttgttttacacaccactgcattaactagaactgctgagaggactgtatatatgattttaaacctaagttgattttttttctcactcttgaaaggagtacttctttgtgaaagcagttcttacagctttgttttcaaccagctaaaaatgttttatatattactctaacctgttgtcctccacattctattgtcctaattgtactgttttctgatttgtatttatgtcttgagacagtaactttttgaataaaaataaacctacagtatgttgtatgttttctcttgtactcaaagggggagggtggctataaatggtttgcaaatttatatctattatcacatcttttaatgtgtttggggaataatttatagagaataccatcagtttatatttttaataaatcatatgtatttacaatgaaaccaaatccctaattggattattactttaaaataggaacctgtaaccattattgctttaattttcatctggtatgagttaaacacatttacaaatgtttacattgtttatacagggtacatttgagtgcctactgtgtgctagcatgtgttaagagatctctccttcatagatccattggggaaaacaaaataatgaaacttgtaataaatgccaggaaggaaacaagcaggatatgctgaggtagagaatgagagagagacagtaagagagaaacctgccttaaataaggggctcatggcatggaggtaaaaccatttgaaaaagaatttactaattgaattcttattgaaaactcat

SEQ ID NO: 5820 - DNA, 1199 bp, Homo sapiens
gccaaccttgggatgtttttaatactccatacacattaatgcagagcttctagtgggatatttacattttttttcaggcttcctgtgtatttatgtatatctttaataaagatatgccttttgagtttttaatgatttttaaattatacagcaatgacaagtgcttttaaaaaaattaaaaggaaatttaagcagaattgacagataaggcagaagttcttcaatccctgttctgtctcctactcccaactttgcctaaacccccattccccagccaggccactacccttaggagtttatatctttctagaccagtgctgtccaatagagctttctgtgatgatggaaatgtcctgtatctgtgctgtccagtccagtggcttctagcagcagggggctattgagtacttgaagtgtggctagtgcaactgagaactgaacttctaatttaatttaatttaaagtaatttaaattcaaattccctatgtggctagtcactattgtactggacagtgcagttctagacctttgtatatgcttttttgttcactcatagacaaaatactgatttgtgtgtgtctctatatcataaacggtcttatatgtatgtgttggtctgcaacttgatttttttttttaactcagcagtgtgtcttggagaacctcccatcttattacataaagacctagctcattgtactttttttcaaattcctaattttgtcagtaatttcctttactaaaatggatgtgtcaggttgtgaaattctttggggttccccccctcctcattatctttgatttgccattaagtgctgtgatcatgataacccgctgagaaaaagtttgattttattgagtaatcaccccatgttttggattcttgggcatgctatgattagaggctttaaaaaccacactatattttcaccaccattggcaccaatgactgttaacaaaggagccaagtgcaccgtggccaattaatttcagaagactttctgtgggctggctgagatagagctaggatagggttccaaccctgcacttggtactgtgatctgttgcattggttctcagacttcagtggatgtaagaattgcttagagagctttaaaaaaagtgtggatgcatgtgtcctcacccctagaggctgtgattagtagacccaggcagctgtgcttttaagacatactca

SEQ ID NO: 5821 - DNA, 1180 bp, Homo sapiens
gcagaacaggtttgtcatctccgcaaggccagaaagtgatcacaaaaagaggcagatgatagacactggggtagggtcataccacagggaaatacctttcctgggcttgttttctagcatatcactgacctgggatctttgggtgatcaagggtgtggttagtggaggctctgtgctgcacgtatgcagtatcctatctctttctacatcagatcaaaacactaagttggtgtactgcctcgaccttttttcagctcatcctggaacatatacagagttgagagttttagacaatctctaggtagaggagacaagatgtagacccagacagaagaaatctgcttccctaccatggctattccagcaccccaacctgtaattgccaagtcctctaaggtactaatttgtagctgctctgaagtaaggatttcggattcagctggtagggaaagactctgcacctgctgtcttagggaagaaatggttcaaatccatgtggtgacattgcattagtctccctttcactgttttcttattctgtaattgtttgttatatttcccaaaaacgtcttgatcactaagcaaagctgctagtgggattctatatttcgtgtcatcttttttattataatttattgcaaatttttttctgaataaatatatgttgtgtgaaaaagcaaagtgtgattttggtgaggaagcactcagaagggagggcttatgtgtcactgggttccattcgacttgactgcagtccccatcagctgtgcctgcactgtcatcacctgtcttacagggaaataccatttataagaattcttagtatattcaccctcagagatgagaagaaaccatgcgttttcagaggctaataaaggtgtcctgtactttcagaggccagccaagtacccttattttaaccctaaggattcaggcaacaaaacaactcaattagaggaaaggatgttgattcttaatgcatgtaaatgtcacactaggtcagatctgtgatccctccggccccagaaacaaaccctaagatacacatctggggagaacccagctacccctgctcagtagtctcagtagtttagacgcgcttccccaaagagcttgttttcacataatcctattttgcagcttttgaaaaccagttttgaacttttatgacttcttgggg

SEQ ID NO: 5822 - DNA, 1170 bp, Homo sapiens
ggaggggcgccgggggacgcctcgcggggaggggtgtgtgtgtaccgcgggggggcatagtgtgggagggacttagagagggacaagaagggacaacataagggagcgcgggggtacggagaaaaggggggcgggagtgctccaccacgctggccacgaaggcgaagggaggccgcgaaggagaggccgctgggactggccacacacagggacgggggtcctggggatggacagtcagcgagggaagggggtcggagcttccgcggtctcgggaggggaagggggagccgacacgggaaaagggggtggtgcggggacccgagggtggaggcggatgggcgtgtgtgcagcgctgagggcagggatttaacgcagctcttcgagatgacccaaagaccacggtgggggctgcacagacgggacggggctaccgatgcaggaggagaactgcccaggggaaagtgggacctacaaggattagagaagggtggcgggggcggcctcggactcggcaggaaggcgccaccaccgccctctgcccgtccccagcgtgccccgccccgtccgggggccctaagggcagcggcctgggccgtgggggagccgagccagggcggaaccattcggaacagagaggggggcttggggggaagggaggagccaggggtcagaaccctgttgggggcgggggggcgccacaccctgggaaaaaggcttgggcacatccagagtggaccaatcagcgagcaaggccagggtggcgtcaaggggcagcttcggccaatgggaagggagaacacttcggaggttcggaggaagaaaagaaaaaaaagccccacgaaacaacaatcgaatctgtttgggggcttggaaggctgggaatgggcgtcgtttatagcacgctctggcacctgccttctcctttgaaggatggggtggcttgcatcactcctgggtagtggggagcaaacggagctgaagagggtccggggaaagtagacggggattggccatttaccggggacacttgattgggcgcctcaatttggggggtgggtgggacggaggtagcagctttgtgctcaaaagagtgcaagagaatgttgtggtctcttaaacggaggcaggagtgggcagggctcccgcatcccctaccactggctactgact

SEQ ID NO: 5823 - DNA, 1176 bp, Homo sapiens
gctaagaccaagagttctagaatgctatagttctgcctgttgcgcttactagctatgtgaccttaaggaagtcccttaacttctctgcaccccaatttcctcagcagtataatgggtcagagggtgagagagaaataacaacagtccctgaaccttagcacagcaaatggcaaacagtaactctcatgagcactgatttggcagggaaggaaaactaaaaatggggcagaaaagagatgtaacacggattcccgggcagacagcagatggatatgaaggtgggcgatgaatgtaagcaggagtgaagggtgaaaatgccgaaatagtcggaaaccgagcaggagaatctggagagcactgaggaagaaagatgtggacctcacccaggaagatccaggcgctgtccttgtactcggagtgccaggacaccttatcggccaccccaagctggacctctcgttcattcagctcgttgatcagcttcaccttagttaaagggcttcacggtggcggggggggtggggagggtaggcagaaaagcagacaagtaagtgcgaaccggccggagctgaggaagagcaaaactaggggacgagctgttccagtccccgcgccgctcccgcccctcggccccgcagacgctctaccacaccagtcccggtggaccacccccagtggcccgctgctccttcctcaaaaggaagctgacgccttacttcatctcctcgggttcgcgctcagcactcaggaatcagcgcccgggaaaggcagcgcagcgcatgcgcggccccggcgccagtggccagtcgattcggtgacctcgcgccggaagagccggggcgtaccggggcgtggcgcctgcgcactagcagccttccgcgctgcgtgcggttacctcttggagaggtggtttttctctagtttttcgctttttcttctctgtgaaatggggtaaaggcacaagcctgggctgttgcaggacccccacctcttgaacgatatctgaaactggttagattagctataaatatttgctgagtgaacggaacaagcagcctgatgtggcgactttagtctcagccctcgctcccagtccagagtcccacttggaccttcgctcctagtcagttgctaaagcacagacccatcaaagcatccctgtcatggcagaaaagt

SEQ ID NO: 5824 - DNA, 1190 bp, Homo sapiens
ggcaaagcacagaggaaattggggtaaaaaacagaaggtcgtagtttgctttctttgtttctcgatgagtgtaaggttagtgagcaaaggcaatctctgcctggaggctgagaatcacagcccgaagggaacaagaatgaataggagacctgtatattcttcattctgctgaggtgttagcagcagcatttcatgggagagggtgttggcagctcatactggtagtagcagctggtaggagaggggctgggcagctggcctgcaaccccagagctaaacagcacagttagtccacagggctagaggaccttggcacaggtgcagaggaccactacgtttgggttttgtagtccttggaagcatagtactgtttcagagaagttggacagcatgtacaggtagcggaccatggcaaaaggggctggccaagcgaacaccggtagcatacactggcagagggattgctatgggaccatccatggacagagggccctggccgagtggttgagccacttatggggcagcaagacatgggaaaggaattgggcaatacccgtgagaagaaggctgtgatagagaacctgggcaacccacacaggtggagggccctggcagggacaaagattgcttcctccaacttctggatgttgggaagttcacagcaggtgcagcctataatttctacccctttgtggtacttctactcagccttccatcttggagctgttctacttgcattaagtaatgatgagctaacgtgtgcatgtttgtttattctaattatctattctctattctggttacgcacgttgctctccatgaagattgcctttgccgctgataacagtgcctttcaaaaaactactttgttggctgggtgcggtggctcacgcttgtaatcccagcactttgggaggctgaggtgggcagatcacctgaggtcaggagtttgagaccagcatggccaacatggggaaaccctgtctctactaaaaatacaaaaattagccaggcatggtggtgcgcgcctgtaatcccagctactcgggaggttgaggcaggagaattgcttgaatccgggaggtggaggttgcagtgagccaggattgcgccattgcactccagcctgggggatagagcaagactcccccatctcaaaaaaaaagaaaaaagaaaaaaaaactactttg

SEQ ID NO: 5825 - DNA, 1174 bp, Homo sapiens
atacacaattttatggcatcgattttctcctgatcagcacatggttatttttatcttctttgcaagttccatggctttgttaataatgagaaaatacaggactgattcctaactgaaaaacaataagacacatacaaaacaaagtcacaggacacagtcgtaagtcacagccttttaaagacactggaaaatatttctgttccaatgttaaataatgaaaccatgagacaaaatcctgttatctatctgattagcatttatagtcatttgtgtatttgtgtccattcaaatagggctgtgtgggtcttgtcaggctggagagctatccgtacccttatgttagagctccactacatatcggcctccccctcaacatgtaaggcctactgcctaggtcagatatggagtagaactgctagggaacctgggtaggcagtcaggacaagaaccacatggcctggtgcctagatttgctcttctccaagaccttaagggtaagctttttttctcttctctccttaggcatggatcactaaggtctgttcccaatacaagaagactctttgacatcataataaaatactgcagatacgatgctgagtgaaaaagagtagaaatgggaagacttggttgtgcagaaactgagttcttaaagagaggagatactttatgagggtgagtggataacctctcagtttaatatccaatggaaaccaaaagcaaatggctaagagtggaatatgtttacacaaattgagcgaaatgttaggtagtcatagtttctggtgtctttgtctcttcatggcctttttattgaaacatgtagggatgtatctgtaaacattcagacaaaaagctgatagtgtctacttttctttctttctttctttctttttttttttttttgaggcagtgtctcgctctgtcgcccaggctggagtgcagtggtacaatctcggctcactgcaagctccctcccgggttcacgccattctcctgcctcagcctcccaagtagctgggactacaggcgcccgccaccatgccccactaatttttttttttttttgtatttttagtagagacagggtttcaccgtgttagccagaatggtcttgatctcctgaccttgtgatctacccgcctcggcctcccaaagtgctgggattacaggc

SEQ ID NO: 5826 - DNA, 1230 bp, Homo sapiens
agtgaatatggaaatggttatcagtgtttaatatatagttttatgacattgcttttctcttcatcagcatatggttactgttttactttgcaagttctatgtcttgtcactaatgagaaaatataggacttattcctaatgaaaaagagtaagacacatgtacaacaaagttataggacagtcttaagtcatagccatttaatgacactggaaaaaatttctgttccaatgttaaataatgaaaccatgagacaaaattctgtgatccatctgattagaatttatagtcattcctgtatttgtgtccattcaagtagggctgtgtgtgttttctcaggctggagagctgtccgaacccttatgttagagccccactaaatatcagcctccctctcaacatataaggcctaatgactaggtcagatcgtgcagtaaaactcctagggaacctgggtagggagtcaggacaagaaccacatagcctggtgcctagatttgctcttctgaaagaccttaggggtaaaacttttttttttcttctctccttaggcatggaaacctaaggtctgtacccaaaactacaggactatttgacatcataataaaacactgcagatatgatgctgagtaagagtagaaatgggaagacttggttgtgcagtaactgagttcttgaaaagaggagatgcttgatgagggtgagtggattacatcactgtttaatatccaatggaaaccaaaagcaaatggctaagagtggaatatgtttacacgaattgagcaaaatattgggtagccatagtttctggtgtctttgtttcttcatggccttctttttgaaacgtgtagtcatgtatgtgtacacattcatacaaaaagctgatagtgtctactttactaaagtaatattcttgaggtcaaattttaagatttatctttatttgccaggtgcagtggctcatgcctgcaatcccagtgctttgggaggccaaggtgggccgatcacgaggtcaggagattgagaccagcctggccaacatagtgaaaccccgtctctactgaaaatacaaaaattagcagggtgtggtggcacacacctgtaatcccagctactcgggaggctgaggcaggagaatcacttgaaaccagaaggcagaggttgcagtgagccgagatcgtgcctctgcactccagcctgggcgaaagagcaaaactctgtctcaaaaaaaa

SEQ ID NO: 5827 - DNA, 1143 bp, Homo sapiens
cctggatcagaacatgaaatggaactcctagggaacctgggtagggagtcaggacaagaaccacatggcctggccgggctcggtggttcacgcctgtaatcctagcactttgggaggccgaggcagtcggatcaggaggtcaggagatccagaccatcctggctaatgcggtgaaaccccgtctctactaaaaaaaaaaaaaaaaaaaaaaaaaaaaaaaaaaaaaaaattagccggtcgtggtggcgggcgcctgtagtccctgctactcaggaggctgaggcaggagaatggcgtgaacccgggaggcggagcttacagtgagccgagatagcgccactgcactccagcctgggcaacagagcaagactctgtctcaaaaaaaaaaacaaatgaaccacatggcctggtgcctagatttgctcttctccaagaccttaggtgttaacatttctttgtttgtttgttgtttccttaggcatggatccctgaggtctgccccagtactataagacaatttgatgtaagaaaacacagcagatataatactgagtgaagaagagtataaatgagaagattggttgtgcagatactgagttcatgaaaagaggagatgattgatgagggtgagtggatcacacctcggtttaatatccaatggaaaacaaaagcaaaatgctaagagtggaataagtttacacaaattgagcaaactgctaagtagttctagtttctggtgtctttgtctcttcttggcctttttttgaaatgtgatgggcgggagaatagcgcctagagcaaagtcagttggcttctcccgtacaatactgccatcgtgcggaaacagtttcgtagcatccaaagccgtgagcgtttcctccatgtgagccctagcaattgaaggaaaagccagtgaaggctgaacagacccgagacacaagttgatcttcctatccttttctctgaggcctggcagaagcaatgaacaaatgcaaagtctccgtgaagtatctgctgagtgagggagcaggactgagccagctgcttccaggaagttttggcacaggaagtagaggacagggcctgttttctcatagtggggacaaggctagaaaatgatacagccaagtacagacccttggg

SEQ ID NO: 5828 - DNA, 1183 bp, Homo sapiens
tgtatggcattgcttttctcttgatcaccacattttttttagcttctttgcgaatcccacctctttgttactaatgtgaaaatacaggactgattcctaactgataaacagtaacacacatacacagcaaactcataggacatagttgtaagccattgcagtttaatgacccaggaaaatgtttgtgttacactgttatataatgaaactgtaagacaaaatcctgggatccatctgattagcatttatagtcattcctgtatttatgtacattcaagtagggttgtgtgtgtctgtcaagcttgagagctatctggactcttatgttagagccccactaaatagcgacctccctctcaacatacaaggcctactgactaggtctgaacatggagtaaacctcccagggaacctgggtagggagtcaggagaagaaacacgtggcctggtgcccagatttgctgtcctccaagacctcagatgtcaacatgttttttttcctttctctttagacatggatccctgaggtcggtccccaatacgacaagacaatttgatatcataatagaacactgcagaaacaatgctgagtgaagaagagtagaaatgggaagacttggttgagcggaaactgagttcttgaaaagaggagatgcttgatgagggtgagtggattacacctcagtttaatatccagcagaagccaaaagtggaataccattacgcaaatgtagcaaaatgttaggtagccatagtttctggtgtctttgtctcttcttggccttttttttgaaacgtgatgggcgggagaagagctcctggagcaaagttagttggcttttctcgtacaatactgccatcgtgcggaaatagtttcatagcgtccaaagccgtgagcgtttcctgcatgtaagccctagcagttgcggaaggaaaagccacccaagacacaagttggcattcctacccttttctctgaggcctagcataagcaatagacaaatgcaaagtcttagtgaagtatctgctgagtgagggaccaggactaagccaactgtttccaggaactcctggtacaggaaatagaggacagggcctcagtttcctcatagtggggacaagactagaagatgacagagccaagtgcagacccctggggcatttatgttatgaatatgccctt

SEQ ID NO: 5829 - DNA, 1217 bp, Homo sapiens
cattttaaaagtcatttcctattgggattgagagaccacttatttatgatatttatacacctatctgtgtacacatgtttactaaccatagtagtgattagtcatggtagtgattagtcatggtaatcatttcagttaccatgatctgtgcctatatccgtatgtatgtgtgtatgtacttatttatacaaaacaagatgttaaggagaatttgtacatgcatttaatgcaagcaaatactttcccttcaaaactttgtcagaatacacatctggtctgatccaaaccacaatgtacagattaatccaattttaatatagatttattttttgtgtgaacaaaatatagtaggcgtatgtatctatacattgaaaagtatggaagaaaataacccaaaatgttatcagttgtcttaacagattttatgatggtgttattcttcttgatgtacacaagattatttttgaactatatggcaaacatcattcttttttaattttttttttttagagactaaggtgtcagtatgttcttcaagctgctctgctcctgggcccaagctattctcctgcctcagccttccaagaagctgaaactacaagaacacaagactgtacctggcttgcaaacaccattgctaataagaagatattgtaagactgatacctaagagataagaggtaacacacacacacacacatgcaggcacacacacacacacacactcaagtcacaagaagaagctgaaaaatatttaatggcataggaacatgtggaaatataaattattcactgttaaacagaggacaatttttaaaactgtgtaactatcttttttttttttttttttttttgagacagagtctcactcattctgtcgcccaggctggagtgcagtggcgtgatctcagctcactgcaacctccacctcccggattcaagcgattctcctgcctcagcctcctgagtagctgggactacaggtatgggccaccacacctggctcatctttgtatttttagtagagacagggtttcaccatgttggccgggctggtctcaaactcctgatctcaagtgatccaccggcctcggcctcccaaagtgttgggattacaggcgtgagccactgcatctgccccaaaactgtgtaacttctaatgggagtttatacagatgtaagtatatgtatcatgccctgtggaacaatgtattaca

SEQ ID NO: 5830 - DNA, 1149 bp, Homo sapiens
ccaggaagagtgcctttaccagactcgaatctgccagccccttgatcttggacttctttcccagtctccagaactgtgagaaatattgtttaagccacccagtctgtggtattctgctatagcacctgaattgactaagatagtggtactagggttctaaacaaggttggcctacagatccagttcttcacagagttctctctgcccctctataggttatttggaaatgtgatggcatttgggttgtcacaatgacttagaagtgctcctgccatttttgtggtcatggatcagaatgctaaaatcctgcagtgtgcaggaaaattcaacccaatgaagatgcatttacacacagaatgcctttgagaaacactggttgttccccaattcagtgtgatcctatcaatgttgagtttctttcccttccttaaaaatctttattaatatgatactatgttttaaaattcagtatgacttatgagaggcaacttagtgtagtagaatgaccactgggctggcctggggtgtttgaggttataggtctggctctgtgcctgtgaaccagacacaaacttcctggacgtaggtgttctataaaacaaagaagttgcactaagttatttctaagttcccttccatctttaatattatattttttttatttgcgtgtttctgccttagaaattatagagtatgctgtttctaagaaagtgttttgattaaaataatcaagtaatattttaattcttatttttttaggtggagatgagttttcctaactgaaagtgattaaatatttttaaaaggctttaaccttgactgccagtaactcaaagcttcaaataattttatgaacagaaatgactataagagattttctttcctttaggcagaaccatatttaaaccattttaaagaaatggtaattaaacttgatggagagcctcatctactactaggaattcatgtcagtttaatcagttgctgaatttggtaatctttccttgtgtctaatctaattcttatatcctaaagcctgagttcattttttttctctcgtctctagtgagagaacaccactgatgtttctttgtgtaataatccttcatgcatatggagtcaggcttcattctcctcttgaagttaaat

SEQ ID NO: 5831 - DNA, 1157 bp, Homo sapiens
tcatttgaacatgcttctaaataaaataaaacaaaaccaaaactatacttttgatctataataagagctcaataactttgtcaaggaaagctctaatatatgcagtgatggtttatgaaagggtgtggcaattttaaatttatattgtgtgtgatgttcaaataaagtggtatctacattcatgtgatttatgggtcagcatgaccattaattactgagtagaaattgactaaactttgatttcctttttttaaatcgtgttgcatttgattcctgagcaaattccctcaaagtgaactcttgttcttaaattttgaattttatggtgagattgtaaagatagaggcaattgaaacattgttccttatttatgaactgcttgaagtgaatacttaatttaagtttgcactttaataccaaacttaaaaccaaacactcatttaaaagtaggttaagtgatcatggatcattgttattagctttgtggctttgtgaaattctaaaggaatcaaataattcatcatgatttaaattttctagagattttgatttttttataatgtttctttcctgtagattgtgttcttgtttctctctctctctctctctctctctctctctctctctctctctctctctctctctcaaaattacagtgttcattgtcattgacctcagcagcaaatttgacttgaattcacttaggatcgcaggaatcaggggaaagtgattttaaaggtggtttctccagcacattttaagaaaagggaccaaaagttattttagcttcctcaatagattgcatgttgcttattaggataataaattaatattaaatgcaatatatgtcttgtctttattatggcatctatttaggagttgttcaaatcactgcagtagggctctgcaaataaaataatgtaacctattatcatggatctaatgtactgtaactttatcagtgaaaggtaaaatctcaaataacaagtacaaacattgaacaattacctataaagatttgtaaaagtaaaatttttccaatagatttcattcttgtcattttgtaagacgaccctgcagtccacctgtttgtaacttttttaataaaatagacatctgtattactgaggttggtttctttaattatttggtgtatt

SEQ ID NO: 5832 - DNA, 1089 bp, Homo sapiens
tttcttgtgttgtattgtgttgtgctgtgttaggtttttacatactgtagtgttttgctgtatatgtgtggtgtttgatttcaactaaagtgttattagtggggaacagaagtatatgtgcttaagaacatgacaggttcatgcaaatatgctctctttctttagaatatttctgtaggtttcttgggactgacatttaaaacgcctcacttttgaatgtgcacaaaacctgctcattaacatgcatgtgtataatttgtacctgcagatctgatgttgcataatacaatcaaattactagattttttaaagagagaaataattacctgcacaaagcagagaacttcataaaacattaacccctaattcactcttcttaaatagcttggcaaataagactttacctttaaatgaatttctcagcatttatactaaaaattatgtaaagtgctcattagattttttgtgtgtgtggcttgagaatcccatctcctaaattgagtgtctaaaactgagccatttgtcatcttcagctgagaaactggtacttgggagcttaaaaatatgctaattacaagttataaatcaaacggagagatgggggcatggagatagtttttacgtactggaggaaagtgtgtaaaaccatggcaatgtcaccttttacacaaatgccattttccaaatgcaaatggctcatgctctttagactactctttgaataacaagtaagatgcaatctagcaaaagtcagtcagggtgaaagagaattggttgcaaatgaggacttccctccccaaatggacagtcttctctgttgatcacagagggagcctgagtacaggcttggagaaatggctaggacagggaacagggaagcacttacaattattccttgatttattcaaaagaactgggaaagatggttgtagttgtctttagcttcggttcaactgagtttcgttttgttaaacagttcagtgaaggagaaagcacctgtgatatatggcaagtgtccccctgcccaaactttaacatcagaccctctcacatcataaccaagcctcttttatgcttgtttggattcgt

SEQ ID NO: 5833 - DNA, 1275 bp, Homo sapiens
aaagtttagatgttgcctttacagttgcctttcaattcagtgttatactgtgtgtaggtaaaacaaatctcaatatggaattaaattgtctttttggggttggactaaatatgaaatccgaaagccaaaccagactcaccagaaattgctgtttagatattttaagaagttcttaaattagttatggagacaaagtgaaaacataaaatgtgaccatttaacttatggctaagaaatggactttaaattattcatgatacactgttaaaacccaatcttggaatcaaatattttttccaggggtgagaataagtataaacataaagcaactaaaatgaaacataaaaccttttattttcttctgattttaacaaggaatctatttaaatagaataacaactgatggtgaatcttaccgagctgtagaaaataaaaaattcctctccaaacatgggtagttttatgtcaaaatattggcttttcaagaacaggactcatatcttgatatttaagagatgtttaaaattttaaactttttctaccttctactgtttaaaggttttacacagggtgtatctcacattaaacaaaacacctttttttcaaaatgaaataccaatgtaaagatctaatttccaggcgctttcagggcactgtaatttcaacaatactggaatcattttggcgctgcttctcattcattttaaggcttctctgaattgtgctcattccaaattaacccatgtatagaatctttcttcatcatctaaatggtgtgttgctgaagttattgtggtatataatcctggattaaagtcaggactttctttctatagaattattttatcaatatttgtgtagtgaggtcctaatcaagaaacttgaacaggataatgtgtctaaaaatattgctgaagttattcttgatcagatagaatttaacctaaaatgtgaactcttacttactttttgtacatctctattgtaatgtttccagttgggccaactatttctagccctttagttctttttcatgttgacagatttgtagacaattacaaaagccaaaaaaggataaaataagcattaggaaggctagccagttattcaatagcaccttgataatgtgggcaaacccttctacaaagtttttgttttgaaaagagcaaaagtaaaaagtgttctgtagtgaggttacatatcaggaacatatgagttgagcagagtaatttggtagtgtaagtcgatgcaaaaatacttctatggtacctatta

SEQ ID NO: 5834 - DNA, 1195 bp, Homo sapiens
tgtatcaaataggagctcatgggaattatcaataaatgtatttttctgattaaactgtgggctctttttcagtcacaatttaagcttcaattctgagttatattataagagaataatttgcacttcatttactctgaattgtcaagaatcttgttcttccccaatgtaagtgtctgcaaagaggacttcttattcagtttgattgctttttaaattttactagtggagatgccctagtgagtctgagagaattggtctgtttcttatgaagagtttagttctaatgagttgcttccatgcactgttctgtgcgaatacagagcaattgaaatgtgcggtgtattgatttacctcaaatggattaggcctgtgtgcaccattccttgcattaattgactttctcccataactgtactaataactgcaaatcttcagtatagtattagcttcaatttactcataaagatccttgggtttttgctaacttactacaggagagtcaatgcaagcaagagtatttagaaattgactagggggaccaagttacatcatacaacccagaaatacttttaaagggctctttgatcatggcagccaactcttcagttattacaataaataggagttgactaaactcaccagttaagacctagattatcacaatggatgaaaataaaaaatccagctatatgctgtgtataagagacaaaggtaaaacataagaacataaagcacacaaaaaggattggaataggtacactatgcaaacactagccagaagtaaactgatgtggctatgttgatatcagacaaaacagactttaaggtagaaccattattgggcataaacagatcactgtgtaatgattaacagttcagtttttttttcagataacaattctaaacttgcatatgcttaataccataagtttgaaacgtataaagcaaaagttggcagagctaaaagcagaaattataaaatctgattttttttcagaaattgataggtaaaatgaacaaaaaatgaataaggatacagaggatttgaacaacatgattaacaaactcaatataatgggtatatatatatacacacacacatatacatatacatctaaaatacacacatacacacacatacacgcacacacacacacatatatatatataaaatctgcacccaattggaagaata

SEQ ID NO: 5835 - DNA, 1228 bp, Homo sapiens
tttgaaagtacgaattgctcttgtatgtcttctgatgagaacaagtggaatgaaatttctattccatttttttttaaactaggtgatgaaagtagtggagaaggaagtggaagtggctgtgagtatcagcagtgcccttcagagtttgactacaatgccactgaccatgctgggaagagtgccaatgagaaagccgacagtgctggtgtccgtcctggggcacaggcctacctcctcactgtcttctgcatcttgttcctggttatgcagagagagtggagataattctcaaactctgagaaaaagtgttcatcaaaaagttaaaaggcaccagttatcacttttctaccatcctagtgactttgctttttaaatgaatggacaacaatgtacagtttttactatgtggccactggtttaagaagtgctgactttgttttctcattcagttttgggaggaaaagggactgtgcattgagttggttcctgctcccccaaaccatgttaaacgtggctaacagtgtaggtacagaactatagttagttgtgcatttgtgattttatcactctattatttgtttgtatgtttttttctcatttcgtttgtgggtttttttttccaactgtgatctcgccttgtttcttacaagcaaaccagggtcccttcttggcacgtaacatgtacgtatttctgaaatattaaatagctgtacagaagcaggttttatttatcatgttatcttattaaaagaaaaagcccaaaaagcagtaaaatttccatttctccctgttattttagttgccttatctggagagacgtggaggtgattttcttttttttaaattattattaagacagaatgtgagggcacaagcaggcttctgagccacttgtcagattgtattcaaagcatcaatccaagaaggaggttatgtgtacttcatttattggtgatagttggaagagactgcagactactgctttgaatgagttgaattacataagctaagatcactataggtccatttcttgaacccacttatacataaaatgtaacccatttagaaaaagattctggatatcatcccccttgaaagatagaaagcattcaggatgtcccagttatcacatgttcacacttgggtttaggggtgtttttttttaaaaccaggcaggttagctagcccaccctgtgctagttttcatgttcacactgaccctatttga

SEQ ID NO: 5836 - DNA, 1197 bp, Homo sapiens
cacaacaatcactgtgggaaaaactggataatttaaagagcataaatagctttaaagacaaaccagaaaacagggtagaaaaaccatcctattaagaggcctaagaaaacgtccttttctttatccatgatacagtgttaatttacataaatgcacagtaaaataaagcaaaggtgaaaagagctgagatttgtaaatgtgcttaataaagacagaaacaattagcttcttctttatttatgcacatatctaaataaaaatgtctttctcctccctggctgtctgaggatagacagccatcatgaacgacacggtaactatccaaactacaaagttcatgaccaaccgactacttcaggggaaacaaatggtcattgatgtccttgaccccaggaaggcaacagtgcctaagacagaaatttagagtgcctaagacaggaaaaactagccaaaatgtacaagaccacaccagatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaatgcaagaacccaataaagaaagtcagggggaccgcaaaggccaatgttggtgctggcaaaaagtcgaagaagtaaagggctgcaatatgttatctgcggccattgtggatttttcatgagaggatttataaactaaaaactttcatgtgaaaaaaatgtctttcataattgtttgcatagcagtactacttcagagccaatgttaagctacgagggtgctagaaacagatatatccactttactccaagaagtacctgtgttctccaacaacagcctttcagaaattacaagtagatttcagtagagaggaagcaaaatctaggaaagaaacccagggcatgtaaatctgtttctctttctttttcttttctttttttattatactttaagtgtgcaggtttgttacatatgtatacatgtgccatattggtttgctgcacccattaacttgtcatttacattaggtatttctcctaatgctatccttcccccattcccccatcccacgccaggccccggtgtgtgatgttccctgccctgtgtccaagtgttct

SEQ ID NO: 5837 - DNA, 1165 bp, Homo sapiens
tggggtggtgtccgtcccaggagcctctgggtgcgcgctgcgctacctcgtgcccttggctttgccgtttgccatcctccgttttttctccccgagccctcgctattcgtctcggtgttggttactctgggcgcccagtgcccttctcggccctcccccgcagcgggccaaggctgcggcgtcgagcgcctgcacaacccccttccctacagctcctctcctcccctccccccttccgcccccgggccccggagccgagcggggccaccggggggcggggagcgccacagcgcgtggccacgccccccgagccggctttttctagggcggctccgggagcctctccgccggctgcgccgctcgcctccaagggagcgttccgtgctggcccctcgctcggctccgctccgcctccgccacgccgctctccgagcttcggcagcagccagcgccccctccacgctgcgaccccggctctcggctctccgtccctgtagctccgtgcccagcacctcgcgccccgcaacctcgccgtctcccaagtcccgggccccgcttctgtcgctgtccgtcgctgtccgtgtgtcgctcgctcggtctgtctctccgcctccccagcccttccttcctccctgtctccctcgctggcttgcacgttcgctcgctctcggacgcggcgaaacagcttcgcaggcaaatcccagaaacctttgcaaaaagcttgcaatgaaatttaagaagttcttcgatttcggcgccattttcgagtggagccagaggtgacatgcgattttttaaaaagggacttggtggctggcgtctttcccgactgtaacgtgggttacggcaggcagaaaaacatctggtgataattctgaaaaaagtgctgtggcgtttgggggggttgtaaagcacgttttgcgggcgggatgggggcaaatctgacatttaaagtgtttaacaaatgagtgcggccgggaaattctcaggaaacggactgggaaaaaaaaaacaacaactaacatggaggggcggggagagaaaactgagtaaggggcagtgaccgactgtcagcctcgctagggtcgggagcgactggttttgacagaatgtaaatgaacttttcctcttatttgcaagaagttagttatgtcttggaaagaaa

SEQ ID NO: 5838 - DNA, 1216 bp, Homo sapiens
cccccggtggccccgctcggctccggggcccgggggcggaaggggggaggggaggagaggagctgtagggaagggggttgtgcaggcgctcgacgccgcagccttggcccgctgcgggggagggccgagaagggcactgggcgcccagagtaaccaacaccgagacgaatagcgagggctcggggagaaaaaacggaggatggcaaacggcaaagccaagggcacgaggtagcgcagcgcgcacccagaggctcctgggacggacaccaccccacgctcacgggtcctctggcggtgtcctttgagctgccgggacggcgcaaggtggctgagcgaagctttttgctcggtgcttacagggagtacctgagatggtttgggaaaggaaacagggggtctcagaccgcttgggtgcagcgctctccccatgcgtttgagtgcagatctgtcgagacgccccagccctcgccaccccaccaagctctcaggtagagaggccccgggacagggtgagccccatagtcctttggtgggcataacacagagggaggagcaattgtttacacatgtgcccagtacaagaagggaaactgatatttaagactgaagtggggaaacgggagggaaaggagcccttatcctggatgttagacgctattaaggaccatgctattttgtatttgtgagaatgatattgaaggtaaggaggtccttatccttgaagatgcatgctgaagtgtacagaagtgaaatgtcacgatgtctgcagttttcaaatgatgcagctaacatacgcacacattatgagagagagaacagaaaggaagcaagtattgcaatatgttaacagttgttgcatcctgttgggggtggggggtaaacagacgttcgttgtaccgttctttcaacttgcctaaatatttgcaaaatgccataatgaaaattttggaagagttcccttataaaatagtgcctgaatgctaagaaaatgaacgcggcttcttttcctttccctgtcccgggtgggacaaatctgcgagcaagcagggctcaaggccagcggggtctggacgggaagagcaatgggtagagccggcctgcagctgccatagccctgggcaggccaggaggggccatcggagcctcggggcagataggctgccgggcgcaaaactatgcggaggagcagccgagcgcgttggccccgggggcggtg

SEQ ID NO: 5839 - DNA, 1204 bp, Homo sapiens
taaagaacgtttttgtgaaagtcagctttttttttttaaataaacactcgtcccttgataatgtatttctttttcataaaattaaaaaaaaaatgtgggttgtagtaggtgtatatatttatgtggtacatgagatgttttgatacaggcatgacgtgtaataatcacatcatggaagatggcgtatccatcccctcaagcatttatcctttgtgttacaaacaatccagttacactctttttgttatttaaaaatgtacaattaaattattattggctatagtcaccctgttgtgctatcaaatattaggtcttattcattcatttaactatttttttgtacctatttatcatccccatccccggttccctcccaccacccaccccactacccttcccggcctctggtaaccatccttctactctctagctccatgagctccattgttttgatttttagctcccacaaataaatgagaacatgtaatgtttgcctttctgtgcctgacttatttcacttaacataatgacctctagttccctctatgttgttgcaaatgacaggatctgataatgtatttcttataaacgtgtgtgtgtgtgtgtgtgcttaatttaatgcttgactaagccttcgttactggtgaaggagggacgggtgtctttctgtgcatctccaaagtgggctataggttcaaagtagtgagaaaagactttttgcccttaacatttacatatagtttacacagttttctaaaaaacctggttggctactttcaggctacaagaataaaaatttaaacgttactttgagtttccttttatgggtcaaaaatctcgctatggccctaagttttaaatatttgacaagcaattatcataacaaacggtttcagacatttttggctttcccagagattgaaaggtgaaaatgttcatttcttttgttcgcaatgaagcatttcatcttattatcacaaatatgactaacactgttatggatttttataaatcatgtcatcttaaaaattaaagaacattaccacaataaaggagaaaaacactcttttgaagtggcatttcaaaaggcaaatgaattagtcaatttgaaatgcagttttttcacaaggtgttatcttcccatctttagaatggttcctttagcttatggactcccacgccctttctcattaccagtcagtca

SEQ ID NO: 5840 - DNA, 1192 bp, Homo sapiens
atagatgcagacaaagtatttgacaaggttcaacatcctttgttgatacaaactctcaacaaattaagtatagaaggaacttacctcaacacagtaaagaccatttgtgaaaagcctgcagctaacatcataatcaatggggaaaaactggaagcttttcctcctctaagatccagtactaggcaaggatcccaatctcgccacttctattcaacatagtattggaagtactagccagagcaaccacacaccttttttgaaaggcatccaaataagaaaggaagaagtaggccaggcatggtggctcatgcctgtaatcccagcactttgggaggccgaggcaggcagatcacttgagttcaggagttcgagaccagcctggccaacatgacgaaaccctgcctgtactaaaaatacaaaaataagctgggcatggtggcttgtacctgtagtcccagctgcttgggaggctgaggcacgagaatcgcttgaacccgggaggtggaggttgcagtgagccaagaacgtgccagtgcactcctgactgggcaaaagagccagacccagtctccccacccccccaccaaaaaaaaaaagaaagaaagaaaagaaaggaagaagtaaaattatgcctttgtagatgacgtgatggcggctgcctataatcccagctacttgggaggctgaggcaggagaatagcttgaactaaggaggcgaaggctgcagtgagtcgagatcgcaccactgcactccagcctgggtgacagagcgagactctgtctaaaaaaaaaaagtgatattcagatttgatgtaatccctatcaaaattccagcagcatttttcacagaaagagaaaaacaattctaaaatttgtgtggaaccacaaaagaccccagatagctgaagcaatttttttttgttgttttgttttttttgttttgagacggagtcttgctctgtcgcccaggctggagtgcagtggcgcaatctcggctcactgcaagctctgcctcccgggttcacaccattctcctgcctcagcctcctgagtagctgggactacaggcgcccgccaccatgcccagctaattttttgtatttttagtagagatggggtttcgccatgttagccaggatggtctccatctcctgacctcgtgatctgcctgcctcggcctcccaaagtgctg

SEQ ID NO: 5841 - DNA, 1136 bp, Homo sapiens
tgtgtggagcatctacaaatgaatgaatagttatttacacacaaaccactgtgtacaaaagcgtccatggagctgtcagtgtctcgagtggtattatgaggcctcaggtgccttggggtacattgtcatgctataagggatgtatatcataaggtatggtggaagaggggccttatgtgaatgattgccacatactgtttctgttgctgctttttttccgattcctttttgtcattggatttgtttgttttgtcatgtggtgaatggtgttttagttattgtgttgctgccagaatcagaatccagttcttgttcttactgccttatagttattgtgttgccaccagaatcagaatccagttcttgttcatactgccttgtagtgagggcagtttaatatctacaaagaagcttttagaagctgaaaaagtcaatgtgattgtgcattctgcttttaagaagctgtttcagctatgaactgtgtatgtgctataagtgtgaggtaccataagttatttaatttttaaaagaggaaactcctgagtgagctgtttaagaaatctgagtgtgatctattgttacgttatttataactaggtaaaatgtctgtcgtgatagatttcttttaacgttcagatactgtggttgggttgtctatatttaatatgcagatttgcctgctggaatcataatccatttttaagtgaatgtaagaaatgaaaactactgcatttgtgtcttttgaaggcaaggatccttggattttaaaggaagagtatgtgctttgaaggcactcagagactagtaatagcatatggtttgaagggaaacccattctctttcaattacaagagagcatcacttagcgtgcagtacttctgttacagcatccgatgtgtcctttattttaaattgtaaccataacagccattaatggctttatttcttgtattgctctcatctgggaaaagtctctacttcttcaaacgtaacataaatctattatgaagcttgtcccctagtatgccattataaagaaaaaattcttcgatggtatgcagtgtatctattctgtttgtaaaagatcatgtcaaaatgttctgcctctataatgataatagatggttttgtctttc

SEQ ID NO: 5842 - DNA, 1216 bp, Homo sapiens
gaacatcttcacaggattccataaagggacaaaggaatggcatttgtaagagtagaaggggctcttttgtattactttgcagtctcaccttttcagttgtcactgtttccctcacttcattctctgcaatgtggtcaatacccaagcaagaggccttacctccaaaggatggagaaacataaaaagtgacaatatggaagatgaatataagaaagagaacagaaatacaattaacctctttcttttggtgattgggaccagtaatgacttgaagcctataattaagataactttaaacaaatttttgtgacactcagatccacaaagatttaataggggaacaaagtagcctttggatggttcagtgccctgaggccttggttctcaggggaatcctggtagaatatactagtgaaaggtcactccccacttactaccagtggcctaactgcaatcctgtacacagagtcaaccttaaggcagagatgtagtaaggaaggggatttcaaagggaccctttgtgagtgtccctgatctgcctgtcactaggaggctggagggccaaaggagtaggctgagagattgagtaccagaagtcctagatgcagggatgcttcctccaggtgccactgcagaggtctgatgacctgcctgcttctatagatactgcaacactgttttgtcttccatcatgaaggtcactcagattacacaggtactgcaataagcagttctgagcatcaaagagcctaaaatgaaaagtatgaaatctgttgggaccaggtatgggatggacaaaggtcagtcagaacacatacccagtgaaatgaagtaaaatgaaaggccatgatgatctcaaactatttaatgacatggggaaatgatctcatctgaacagtaaagaataaaaggagtctacaaagccttcaaaacttggtgagggcaatcaaagtccctctatcttaccaccactgaagctcatcacggaccccatactgaaagtacctggactttatgtgcatgaacaatccctgactttatgatgatggagaaggtggttcagggaaggctgcctggcttgattctgtagctgccggcccagaactgagctccttctcttccccgtacacagctgcttttggccctcttgacggttgtaccaccttctttcacttgtccccagtcctcttcatacccactctcttactggtcctta

SEQ ID NO: 5843 - DNA, 1197 bp, Homo sapiens
gactagcttattatcagtctctatcttgccctctccatccctctactatttttcatcttgcttgttcatggctttagccctctcattaccttattagaaagttgcatggatttcttcattcccagcatatctggactatctgtaacctcatggtacaaaggaatgaagggcaggcaattcttggaggtcataaaatagatctgaaattcaacattcatcctacaatcataagcacttcttaaacatattcaaaacagttttttttcaattcactgaaattttagttatgagtgttgaaatttacctttcctcttcctaatgtcaagtagatagtaaagaatctgagccctctctcccatggaagccattggtggttcctagagatctagtaatcttctttctcaaaatgctagtctgtatttcagtgaaaatgtaacaaaatataaaacgacttgcagaattgtcagaaatataagcttgctttgagacctaaccattttttctgctttttttaaaaaattttttttagcctccacgaacatctcatcctgttgtgaggttctcctgtgtagattgtgagccaatggtaatagacaaacttccttttgacaaatatgaacttgaaccttcgcccttaactcagtatatcttggaacgaaagtctccccatacctgctggcaggtacttatccttacctattagctaaatgtctgtaaccactctaggatctgggaattgttttaagaagcttcaaaggttattctcaaaataattggactgactgtgctaatgatgtttctcatgaatgctgtcaaataagcaacagggccaggcaaataatttcagactaatatgaatcattagtctactgtacattgccatttaaagcaatagagtctgatgaaacctatatatttgaagatttgggggaccccttgaagtctacccatgcaccccagcttaagaatccctaatctaaaggttgtacttcacttcaggtatggcgtctgcagctgaaacaaggtgtttagcccttactttgaacttgacagattggaagtacaggatagtttaggcagagaaccataagtcctgaaactaatttctgtattagtgtaatataataaaactcttcgtcctgtggtacaaatcacactaaaaaatgtgtgtaatgtggattttgcaacttggatgag

SEQ ID NO: 5844 - DNA, 1106 bp, Homo sapiens
gctaccagaatcatttcattaaggaggtcaccagattgttgtagttagcaaaggactctctcccaattaggaaattagtttttctattgagacctaataactgcagaaattagagcatttgtaacaactttttttttcgttttcttaaatatatcacattcaatccacctgttcttttaaattaagaactgaggacttgtgtaaaaaataaactttagttccatattaaaaccagttatgatcaggaggaagaaagggagaggtatgagaatagagaatagaagcaggatactttgatgtgtatcagtcactatgtatctggtgcttaacagcttacactggtttgtttgtttttcattttgtacggggcttttacacatacattatgtagttccttagaatagtcttgtggtaaggcaattatcatctaacccattttatagatgaaatggaggcttacaaaaggcaatttctccaaactcactgagctaaggatgtggctgagcttgaactcaaacccaggtcttccctctctttgaagaaagaaatggggagaaaggaactggaagagaaaataccggtcatttttgaggtgctggcagtatcattttactttcattctacactctcatcatatcttctttcaaatgttgatcagctaattgtttatgtgacacctttactgtaccatcctagagagtccatgtgaatgggtatttaatgccatggaaataatttgctgagctacagaggtagtgactaaggcagtgtcaccccaggagctctctactcttaatctagactgcagaagattttctttcttctcctgactcccattttaaaactctggcagaaaataattagcctaaatgagctccttggtggaatcattgcacttggcattgttagaaatgcaaagagtattattcacttgattatctaatctatttatatctaaaagtttctccagtatttacgtttgtccgttagtttccaaaatctgcctaattcccaacagacacaacataaagacatggtataacaggatatatccatggtctctcattcctttctgtcaagatatgaatggtctttaaaggccccac

SEQ ID NO: 5845 - DNA, 1144 bp, Homo sapiens
tctcttaccttaaaaaactcagccaacaggtagtattggtaaaaacaaacaaacaaaaatcctttgccctcagaagtgcatttccttattctttagtgtaattgtaatttttcaaattaaatgtgtatatatctctacactttatggattagtaataatgtgattctctatggcttctagcttcaccattaagctgcagttaagggtctgtcagtatcatttgatgctgtgccatttctccttttgcctgccagtttgtcctacccgcaagctggttgatatggggcagaggtttaatagacttctctcatgggtcacattttgtctatcttcaacctagttcctcctcagatcactctgggctacagcatccctcctgtttagatcagcacactgaggcgtggtgtgattaaatgacttgtctgagattagttttcaggcatgtgaaggacttatactcacatgctagcccttggataaagagctatatgcttttccctggagagtggggagatgagaccagtgttcctcacactggagggtgatagaccccaaggggaactgaagagtggagctcagtttcctctcttctcaccctccacctgttcctcatttgccattattcaccttgtcccttgcctgcccctctctattagtacctcatcctccactcaccgttccttatcatacttctcacctctacttagcccattcttgtaggatggaaatatttgagaactactgagttagaactttactatcatatgaatgtgttatgttatatgacaaattaatgcagcagttttacttaccttatgcacaaaggtattcccaggtaggggacaatagtagcattcgcagtggtgataatgcttcaaggtggatgtgtttggaagtttggcctttaggaaatggagagtagtgagcaaaacatcagatttcaccaaagaaccaaagtgactccacaattgggatgccgacacaccttgctaggaactgacaacaacttcagtatggtctggagcttaccagctcctaccagtccagtgtgcttataagtgcaaaagaaagtaaaggcaaccccagatttctaatctaccaagtgtccccctaacctcctttcctctctgctaatagatttttt

SEQ ID NO: 5846 - DNA, 2023 bp, Homo sapiens
aatgcagtgtaagttatatgtgaaatgagtctttggtatttcatataggaattattttttttttcatttaaaacaaatccacatcttttgtaaaagccactgttttgaacacatttccttgaaaaatgttggtggtttttgtgattatttatttttttagatttcttttcttttgcactacaatttttggaatccttttggaaatactgtgtgactgctgtgttttgcagcatgaattatagtaaaatggtcttcaattcttaacaaatggacttccctgatgagaccaaaatggtgatttaacagtttttcttgtgtcccctaaaaagtggctctgcttcagaagtacttgccagtttttaatttatttgtgacttttcaccctaccctgctcccatataccttctaccatcagctgtcttgtttcatcatttctctgagattctgtgtgcagtgagcaatttttgtgtcagaaattctttgtcagaacaaatatatgtaacaggctcaacttactgtaaagctacttgtgttctcttcatttgtctgtaaaaatttccctaattgattatatagtgtaagaatagttgaagactagttgaagaccttttgtgatttcattatcatgcctatgcagaagaaaaatcattgaggaaaattgtcattagccagtttaactgattcaaactctgtttatttcatactaaactagtgaataagtgaaataaaggaaactcgtcattaatctaaagacagagttcaaaggaattgggccaaatatattctcagtatttggaactaatgtttttaaggtttttaggaaaatcaggtcatttaagaaattgttttgtagtttctggtttatagcagtcttcaagttttccatcttcactgtatgttgctgaaagtgaggatgaggatacagagttgatatttttagaaacagtaattttacttttaaggaaattggctagctctttgagctagagagctgtaggaagctcaacatttctttgtagagaacgttgctttttttggattgtacaggtataaaaacattgcttttgttgaattgtataggtgtaaaaagggaataactgtatgcaggtttgaaaaggaaatgtgctttaggcatgagtcataagatgccattgtacttgtaggcattttattttcctttagaaatggacatcagctcttctcttctgactggtaacacatagccccaaagcatgagattatttttcattgggtttttattgttgtttagttttggtttgttacgccagcccagtctgtctgcggaacactgactctgctctctaatgagaacaaagttagaaatctgccgataacctaaaataatttagaaatgaattaaaaatgtgaaatcgggttaaagtgatgatgataaaatagcatgcaagaaacaagctccttccatcagacttggctactgttttcttctggtacgatttggtttggaagagcctcttgtttccttctctttggggtatgtcttcgtttcttaatatgtttgtaacattattgagatataattcacataccttacaattcacttattttaagggtacaatttagtggtttttagtgtattcacaaagttgtgtaaccgtgaccacagtcaattttagaacatttcgttaccccaaaaagaaaccctgtacccttgagcagtcacctctcattttctcccagtgcccaccccatccccgagcccctggcaaccactaatctatttctctctctgtagatttgcttattctggtcatttcatataaatggaattctacaatattcggtcttttgggactggcttcccaaatatgattttctatatggagtgagaaaattcttctcatcttgagaactcttattgctgtgaaagggagtggttggtaaaatcaatagatttcaggcaagagggccagatacctaacaggtttttctccgtgaatcttatgctgagtagtttttcctcataaccaagcatttatgatat

SEQ ID NO: 5847 - DNA, 1155 bp, Homo sapiens
ccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacc

SEQ ID NO: 5848 - DNA, 1195 bp, Homo sapiens
ttaccaaaaagatgagccatggccatgtgtcaacaatatccttttttgagagctcaattaaacataataaaaccagttataaaagaattagaaaaacatgtaatccccatgctttggaaggccaagttaggaggatcagttgaggttaggagtttgagaccagtctgggcaacatagtgagacctcatctctacaaaaaattaaacaaaaattagctggctgtgatggcaggtgcctgtggtcctagctacttgggaggctgagatgggaggatcacctgaatcctggagtttgaggttacagtgagccgtgaccacaccactgcactcaagcctgggtaacagagtgagaccctgtctcttaaaaaaaaaaaaaaaaccaaaaaaaaaaaaaaaagaaagaaaaaggataattaaaaaggggcacttaccctgtagtaatcccacatttccagtaaagaagaaaggtaaatttcataaagatgggtaagctctatatagatttgtactgattttagagaagtaaattaatttgttgtgccattaacacctgtagttcctaatcctgcaactattctgatctcagtataattgtctgaaaaaaatttttttgttgttctatgttctatgttctgccctcccttcctctctcccttcctccctccctccctcattcccttcctcccttcctctcttcctcccttcctcccttcttcccttctttccttccttccctcctttcctccttcccttttttccttccttatttttttccttccccctctttcttttcttataagtggacaagtctaaattcttacttgctcataaaggagtctgatacttatagcagacaattcctcaagggttttgagactcccctaatgttttctctagtcatttacagaaacacttagataaatttgtttcaccagaaggatctataatttttcaaaatatagatgattttgctggtagcctcagaaactaaagagcaatgcaaaactaacactttggctttgttacaattctttgcttcacaagggcataaggcctcactagataaattgcaacattgcttttctgagtaaactatttaaggcatctgtgttcagctgtgggccttagagtggtataatctaggggtcatctcattttgcagatctaacagccaaatgtagtgctatggttagaat

SEQ ID NO: 5849 - DNA, 1205 bp, Homo sapiens
tcctgtgtctagcctgtgaccttgggagtcttttaaaaccatcgttaggaagggtgtgatgagtaattgaatctttcaaaggcaagaggactggaactaaaagttgctttttcaaatgttaagcagctgttgcttaagaacagctaagggtgatcaagggtagtggtaaaagttaagttggcccttttaaccagttttatgtaaattgcagtgttactaaactacttagttcaaattgcttcctactgtggctgaggcttagctcgttatcgttttctttagttattaaggaacaatggttttagtggaaaatatgagaaatgtgcgaaagtaaaagtgtccaataaacttgaggaactttttgcagtgaggtaatactattccttttcaacagactcaccggcccaaaaaaaaaaaaacatggttgaagcagatcgcccaggaaagctcttcattggtgggcttaatacggaaacaaatgagaaagctcttgaagcagtatttggcaaatatggacgaatagtggaaggtgagttgtctggcagtacaggctgggctattataattaaaatataagctatgatgaatttgattgcattgatcgtctgacatgataatgtatttttgtcctctaagaagttctgagctttctgtttacacatttactttggttatttcatttgacctagggtaacactttatttttctgaaaactactttttagtactcttgatgaaagaccgtgaaaccaacaaatcaagaggatttgcttttgtcacctttgaaagcccagcagacgctaaggatgcagccagagacatgaatggaaaggtgagattgtctacacgatggatgataacctgttactagtgcataaaataacatgtagttgtccaagtctggtctaggacagcttttgagttttcgttgtttttcagtatatacctgtctgggatccactcatcctgtttgtgatcctgttccaaagagtattctgtaattgcagaaccaaatctagtagtgagttatatcttatgctcgtaacattctctcagttcagaataattatggcattacatggtacttttttttttttttttttgatagtctccctccgttgcctagcctggagtgcaatggtgcagtgcccactgcagcctgtctcccgagttctaagcgatttttctgcctcagccccccccccc

SEQ ID NO: 5850 - DNA, 1205 bp, Homo sapiens; identical to SEQ ID NO: 5849

SEQ ID NO: 5851 - DNA, 1179 bp, Homo sapiens
tgagagcttgtcattgcctcccgtgtataacaggcagcaagaaactaaatttaaaagtctaacaccaatggaaatccataaagccacctgactcaatgactatatccatacagccattgtcgtttgttggcaggcaagtagctcaaagcaaatcaatcaaatctgtttttgattggctgactcacctaccataatagctgtgcatgaaaatggcaacaatcttagactaaaataagtgaagctatagagaattgagtgtgcgtgtctgtgtgtgtgcatgtacacaccccggatgctatgctgcatgtacatgccatctacagctaacgttataatgccaaaatgaagaaaaggaaaggaaattcacactttgtgaacacagtaaatatgttttgggcactttacatccaccacgcctatttattcctcatggtaggcttactgatcagaaggcagatataatctattaaatttttagtttcaggagtgcatgaatgatgtctgttttattcgccattgcagctacagtgcctaacacaatgtctggcacatggttggcactcaataagtatttttaaaaataattaagcggaggaagaggagggcgggcatcaagacctattttacagtgagtcacgcagctactaagggacatagctgggactgatatgcactttgttctcagactctatgctatgtctgcactgccatattgttctccacaatgacataggagggggagaaagaagaaaaacaatatgtcactctgtttggagattggtaggctacagaaacagtatcaattcagacgctcctaaaaacagccttgctgaaaagcttttgacccagagcgcgtcaggatgcttctagtccaattgtttccaattatacctaattcacctacaggagaaatttatcttctcacaaagcaccagggggacccacgatatttgctagtgactaacaaaaaatgcatttaggagttaatacatcacttccaaactggtcttcgtctgcttgagtttccaacaagccttgcagattctcctaaattcccacttattctccatacttttttcagcaaccaaatcctattttcgaatatgacaagaaataaaatgattttaggcactagagttgagaatttatagataaatgttacacttcgatgcttaattc

SEQ ID NO: 5852 - DNA, 1170 bp, Homo sapiens
aacccatgattcattgctacatgatgttagatgtatagagcctttgcatttagtgactcccgtctgttgtgtttgagctttcacgacacctttgaaagttttgtagtttgtctacccttcctagctaccccttccctctcctacttcttttcagcttatctgcccccaccagctaggtctccttttgccatcatcttcctggctgccattgcctgaggacttggggcttgggcctcctagatattaccattacttcattccttgcccattccccagtactgagatatctgcagccctacacctactagctacttagcctgatcacacctccagcctgtacgccagtttagaggccttagggcagagctcagctttctcacccttgttctttgaaaaacctgggttctgtttagttcccctcttctctggatccctggcccaagctagatcctttcataggtatcattgtgtactagttatcagatactatagcgtattgcctggtgcaattcgtaaccgtcgtgaaatcttttgtgttgtatcttttcagcttgccttggatacccgattctggacgtggataaatcactttgtgatttggggttctttagccttctatgtatttttctcattcttctggggaggaattatttggtaagcaattgtacatgtgtgagcaatatgtaaatagcaaagtagatacatgtgtatgtacactatatatgtaagcattcattatactttaaaaattttaattatataagatgacacgtctttaatattaatggcctgaaggttatttgttagctggtagtgctactaatttcaggtaagattttaaatacacatatatagactgcacaagtcactcagaagacctccctttggtagcttctgtctgtttgaaggtgttgtaaacatctctctagtgaaactatagttttcagcacaacctctcgtgattttcagaggaaatactcatcctgtgaagtttctacctgatatattgaccaacagatacattattgtccatttggacccttattttctcttgatagtatataaccatgattcatgttactacaggtgtgctcagggtataggatatatacaacttaataattcagagggttgtattttgaaattgtcatcttactgttttggtggagg

SEQ ID NO: 5853 - DNA, 1201 bp, Homo sapiens
cacgcacagacacacattctgtacacacacacacaaacacatattccgtgtacacacacttccatacacacagagacacgttccatgcccacacattccatacacacacagacacatccagtacacacacacacagacacattccatatacacacacacattccctacatacacacacagacacattccatacacacacccatactcattccatacacacagagacacattccatacacacacgcacacattccacacgcacacacattccatatacacacacagacacattccatacacacacattccatacacacacacacacattccatatacacatacacattccgtatacacacacagactcattccatacacacacagagacacattccattacacacactcagacacattccacacacacacattcatacacacacacattccatacacacacacagaatcattccatacacacacagacacattccatacacacagacacacatttgatacacacacacattccatatacacacacattccatacacacacattgcataccaacacacacacattccatacacatacacagacacacattccatacacacacaaacacattccgtacacatactcagacacacattccatacacacacacacattccgtacacacacacagtcacacattccatacacacacacattccatacgcacaaacacattccatacacacacacatattccataaacacaaacacattccatacacacacacagactaattccatacacagagacacattccatacacttacgcagacacattccacacacacacacattccatgcacacacatagactcattccgtacacacacatagacacattccatacacacacagacacattccatatgcatacgcaggtatgtccccaaagaaatagattgtctccatcatatgcacattaacccaacgaaatacttttggagctctgtaacacccaaacttgactcacaacacacatgaacactgaaccacacaaatgaaacctacactacccagacatacccattgtttgaagacttgctgcaaaatacccagccttacgccatgatatacagacttggcccattgacctatacctaccttgaatcacagggactgatagagcaacactcagatgtggc

SEQ ID NO: 5854 - DNA, 1230 bp, Homo sapiens
gatgacctcatttctggtagtagttggagcactaatagtcactggcatgatatagcagtgcaattattaaaatattcattggcggtaaactggaatggaataggggatagaaaagaatgtaatagtatacacaatatctgaggcctttacaaggttttaggagagtggtaattataaggggtatgaaattggatggttttgtggttattaatgatgcaccggagaaaaacaagcaaaggctgagtgtaacgaattcccaatttaaggcaaaatagaaaaatctgagggattcttttatataaagaacctctcatctcctgcagctgaagggcagaaaaagctgaggttatgaatcagaaattatttacaagggtagagtagctcaagaagcttgaatgcatggatgtgagggtggtctggctgtgacatctgtcaccccattgattgccagggttgattcggttgatatggctggctaggtgggtgtccccttcctgcctcaccactccatgtacatccctcctgaagctgcttgcttggtcaaagaggacaaccatccctgatagaggaggaccggtcttcagtcaagggtatacgagtagctgcgctcccctgctagagcctccaaacaagctctcaagaagattgaatgtttaatcctgattatgttagacagaacaatcacagagaagaagaaaactctgaatcttgggatggggccatctgtgtcaatatatctgcaattcttgattcctcgggttcccttgaacccactgggttggcccagtgtctcactgttgtctgtcaaaatagcatacattcttttcttgaagaaagtgcacaggtttttgctttgtacgacaatttagagtcacaattaatctccacccaccttctggccaacagaaaaataactaaggtgaagtcataacataacttggctagggaaagtactgggttggcaaaggagggaaagggagcatatgctgaatgaactggagatactaaaagaagggtataaacagggctagaccctggagatgatgactcaaagggagggaaaatgcagatggaaggggtgagtttatcaatatggaatggatctcttaggattaaggatttaaaaacccagcaaaggtcaaggagaaagtgcaaaaagtccctacttgaagtgaagaagggtaatgcaaaaagtgcctactctatgtgaaaaataaataccatggtaga

SEQ ID NO: 5855 - DNA, 1164 bp, Homo sapiens
gatgtaagacctagctgtctggtcagctattaaatagttttgttttcccctcatgaggaatagtcagcattttcagttgatgaaaaaatcattgttccttaaccatagtatatgttcttttaaaacaaaagatggcccaaactcaatgctttgtaaattaagatattaactggcaaatctattttaatcaagattatttacaatgtgtgattttttaaggttagctggttataccttgaatgtcatttatctatattcatacattttagcatgttttatttaatatcctatcatgaagaagtccccaaaatagcatatctgtgccttagcagtagaataattggataatagtgccaaattagacaactttaaattttattcagtataattttactgctgagtgtttttgttatatctctaattcttgacatcaataatctgttatctgtagtaattttctttttaaggagatcattcaatttcctgataattctgtgtaacagtgtttactgtaaatttagaactgaaattgaaatattccagtatatttttatctgatgaaaaggagaaaggttttattaagtaaaatgtcaaattatttttactgttatcttgtatattttaaataggaagtagaccagttgcgtttggagagattacaaattgatgagcagttgcgacagattggagctagttctagaccaccaccaaatcgtacagataaggaaaaaagctatgtgactgatgatggtcaaggaatgggtcgaggtagtagaccttacagaaatagggggcacggcagacgcggtcctggatatacttcaggtacaaactaagcattttactcagtaactttatctgttcctagacttatagctgctaatctctaatattcattagaaccccattataacaatttgccgctacatggtttccaattcacagtgggttaaattgtgttacaggagacatagagtaaaaacctgatgataaacacgtagagttcacagggccggtgcaagttctgttcatgctctgattgggggtaaatctgcaaagcccttgtgtgttgatgattttcttaaggcctctcctgattttataactgtatagtcaaaacttttttcatttgtgtactgtggctcatttttattttgtcaggta

SEQ ID NO: 5856 - DNA, 1223 bp, Homo sapiens
ggaaacacaaacctattcattctctctcctcccacccccatctttttgttattttagacaaacaaaggtgatgcacttgccaaccgagtccagaacacgcttggaaactatgatgaaatgaagaatttgctaactaaccattctaatcagaatcacctagtgggaattccaaagaattctgtgccccagaatcccaacaacaaaaatgaaccaagcttttttccagaacaaaagaacagaataattccacctcaccaggataatacccatccttcagcaccaatgcctccaccttctgttgtgatactgaattcaactctaatacacagcaacagaaaatcaaaacctgagtggtcacgtgatagtcataaccctagcactgtactggcaagccaggccagtggtcagccaaacaagatgcagactttgacacaggaccagtctcaagccaaactggaagacttctttgtctacccagctgaacagccccagattggagaagttgaagagtcaaacccatctgcaaaggaagacagtaaccctaattctagtggagaagatgctttcaaagaaatctttcaatccaattcaccggaagaatctgaattcgccgtgcaagcgcctgggtctcccctagtggcttcctctttattagctcctagcagtggcctttcagttcaaaacttcccaccagggctttactgcaaaacaagcatggggcagcaaaagccaactgcatacgtcagacccatggatggccaggaccaggcaccggacatctcaccaacactgaaaccttcaattgaatttgagaacagctttgggaatctgtcatttggaacactcttggatggaaaacccagtgcagccagttcaaagactaaactgccaaagttcaccatcctccaaacaagtgaagtaagtaatttttaaagttttgtttggtttcacttttttttagttctctgctctaacctctataatccagtattcacaagcagctctcatttaccttaatgagctgtataggatactcttcaagttcagggtctgaattttgatcttctgtcacttgtgacataactgattaacacgctgcaaatagagttaaatctcaataatttggaatgacagaagacaaggtcggtctgactgaaagaatgacaagttggagttataaaatagtttcataaaatacagttgtggtaatactatgtataaat

SEQ ID NO: 5857 - DNA, 1192 bp, Homo sapiens
gagaaagcagagaggaggaggctgaagaaaggaggaccaggaggagaggaggaggaggaaaggaggaagaggaagagtggaataagaggagcagaggaaaaggaggagggggtgggggaggagtggagaggagaggaggaggaacagagttggaggaggtgaaagagaaaagaggagaaggaggagaggaagagagaaggaaatgagaaggagaaaagtaggaagaagagagaagagagagagaggagaggatgaggaggaggagaggagaaggagagcaggaggtgggaggaggaggagagtaagaggaggaaatgaggaggaagaagaaagaaggacagcagatggagaggaggaagagagaattaggagaggaggaagaggggaggagaggaggagaaggaaacgaggaggaggacgaagctgcatcacccttatcaggttccagttctcggtgcgccccgttctgcaagacactctcctgtggtcagccctggcctgcagaggattcccgcgctggatctctgaaggatgctggcgccctctctgcagcacattcctgatgcccttgctgacacatgtgtcctctgggtcctctcctgaaacctgatcctccggggtgtcttctggcctcacctcttctgtccagttccagcaagctcactttgcttagcctttgaatcccttccttcactgtctgctgtgacaattcgggcctttcactgtcactcaggcctggaccatcactgttgcccatcccatgccatcaacaggtttgccccatcccttcggctccctaccagggcattcagttgtgttgagcagcagagtgcctccaagtccccactggttgagctgcatccgggtcccatcccacagggaccccccctggccgctgcaggtgcatgctgatcctgcagctcctcgagggtgtcatcgctttcccccttcccagacccagcacaccctgcctgcatggcgctgcgctgcaccttcactctggtcacgggtctggcagtcggctcaccaattcgtcctgcttccctgggactcgccggcttttagcactgcaattcactcagcaaactgggactgttggtcaccctacctggcagccagtgataaggtgagggccactcctgggagggaggacacctgtggggaaaattcttgtgttatttatttctccttc

SEQ ID NO: 5858 - DNA, 1190 bp, Homo sapiens
gagtcggccctagacacccacgactcgcagggtccatggttccggaggccgtgagacctgccggggctgacaggtgccagggcccatgctgcgggagcctgtgtgctcagccttcttgcggacggtacctgagggctggggtttccctggatgtggggctgggaactcgtgcggggcgcgaccgaggcgccttttcctgtcccctgctgtcggcagggtctcggctccgctccttctaagcgcgtgtacccgcgacgtgcgtctgcgagtagaaagcccgtgtactgctccacacacagcggccccacctcagtccggtcttccctgcctcccgttggcccttctgctgtgagctcgcctggacctgaggccgggcggtgcacagctctgtggcctgtggcgccgtgctcagcgtgacctacccagaattaagctgaggacaatgggatttagagtcccaaacactcgccccgtgacaatgggaggggaagtgtcatttttctcccttcgaatggagcatgcttggctgcaagaatgctgctcaacatggtgaaatgattttctgccctgcgggctggtgcaccctgtggtccttgacccagacaggtgcggagggtcccactgctgtgattagcagaaccaaactgtgatgtgcacatgtgtgttactgataagaccaggcctcccagctcttcttggtttccaatgcctgctaagtacatgaccttcttagggccattaaccagctttgctgtcttgcacttaatgacctttcctctttatcttccttgttgtgcaggtaaagaagctaagtggaagagtgtttcctcctctggccgtaaagcaggtactctctgcagcaccaggtaggaggggactcaacccccttcttgccttttcagttacatcagttcctactagggattccacatacacacagttggcgtctgttgtgattttgtggtgatgacgagaaaagggttggctaagaaactgggcggcagaaaagaggcaaacattcactgtagccatttatcccgatggaagtggccaggccctgtgggggacattcagcctccgtcagaagtaatccagaaccaaggaacctggttatctttggtcactcatcagaagaataatcatgctcaggggccacaagtgtgtgaggaaatggcaccatggatgggttg

SEQ ID NO: 5859 - DNA, 1143 bp, Homo sapiens
gggaagagaagcagagcgtgggactgtccctctgtgctggaagagggctaacaccagccccgactctccgctctggctaggccgagggggccctctgtcctctgtgttgccctagggctcggtgacctctgtcatagcactgaccacatgctatcctgcctgtgccttcctctagctgtccccgccctactccggaccgccccaaagactccatgggatggacctgagtcagccgaatcctagccccttcccttgggcctgctgtggtgctcgacatcagtgacagacggaagcagcagaccatcaaggtcagtgcgatttaggccacctgagagacacggggggaaggtcaggccactgcccatgagcttgaagggctggcgtgtgatgcgcttctgtgcttccgcaggctacgggaggcccggggcgcttgcgaagatgaagtttggctgcctctccttccggcagccttatgctggctttgtcttaaatggaatcaagactgtggagacgcgctggcgtcctctgctgagcagccagcggaactgtaccatcgccgtccacattgctcacagggactgggaaggcgatgcctgtcgggagctgctggtggagagactcgggatgactcctgctcagattcaggccttgctcaggaaaggggaaaagtttggtcgaggagtgatagcgggtaagtgacaatgtaccaaatgcgcagacaacgcctagggctgctgcccaagatcttgcttgggaatttgggggcttctcttgtcatctgaactgattggcgtgtataacacagtttcctttggcaacacaccttcaaaggggcggcaaggaccttgggctgggggttggtatggctggcttccgcaagctctggtaaatcatttctccactctgggccgcagttctgtttctgatctcagtgagaagcctggtcagggccatgtgcacatggtgtttgtggtgtttggctgtgtgtatttgcacatacatgtgtgagtgcacatgtgtggcagagaccatgaaaagcagcccagcccgccgaatgggtcaggtggcctctagagttgggctgcccgcctggcttcatgaacctgccccagccccaccactcacagcaccctgggaaagtcc

SEQ ID NO: 5860 - DNA, 1099 bp, Homo sapiens
caaaaactattttatagagagttttactgcattggtagatcagaaattcatctctttgacgtcattaagctctgatggttgtatatatgaaaccttgatgccaatacgtccaactgacccagaaaaaaatcagagcttagttagatcactgttgctcaaggctgttgtgtctggtaacacttgaaatggagttgcactcactgcgctggatcaggatcacgtcacagtcctaggaagtccactagcagcttctaaggaatgcctctctgtatggaacataaaatttcaaacactacagacttcaaaagagttaccacaagggaccagtggtcaactctggtattatggggaaaatgtgtttatgctacgtggaaaatctctgtgattccatacaactgtgaagtgtcatcattagcaggtgctcatggaaaactcaagcatagtcaagatccaggaactcatgtcgtgccccattttgtaaactgggaaacacctcaaggatgtggacttgggtcccagaactcagagcagtcaagaagaattttaaggagacgaaaaattgaagtgagtttacagccagaggtatcaccatccaaacaacttttgtcaaccataatgaaagattcagagaaacatactgaagtagaagtatggaaatttttggctctgaagcagacccctgactttcatactgtcactggggacacagtaacaggacttctggaaaggtgtaaagcagaaccatcattttatccccggaactgtctgatgcaccttatccaaatgcatgtgctttcttacagtttgtgccctgacttaatggagattgccttaaaaaagaaagatgtacagttgttacaactctgtctacagcagttccctgacattcctgaatcggtcacctgtgcttgcttacaaattttcttgagaattggtgatgacagtattcaagaaacagatgtcagtatggagtcagtttttgactatagtaattctgtacatgatgagaaaatggaagagcaaactggaattcttcaaaatggcttcaatcctgaagaagataaatacagtaactgtgatcaagagttaaataaaaagc

SEQ ID NO: 5861 - DNA, 1198 bp, Homo sapiens
ccttctataagaagataccagagagatttattcaaggtaatttgataacctaaaatcaattctccattttttatcatatgtgggatttgttgctaagtcgtgttcaacaatagcttttatgttcctaacatatctgaaagcttatttatgaatggatatactggattattgatatactgattttttttttaatggggacatttgccattttcttcccagaaatatgtaatcccctggctgactaggactgttaaacatagtgtggactggatgatgccttcgacaaaccagagaagccaagttggggggagctggtgcctggagtgggccctgtgcacctcacctggcggaggctggggggggctctgtcagcaggaccctagaggagactctcattcgattttaaagaagcacaacgggtcattttcctttgtatgttcctagcgcagaactgtttctaaaacaacttgaagtatagttttgttatctaagcaatttttgttttaagtaagtaagtgtactagaatgcgaagccgttatggttcaggtttttaaaaactggtacagtattgtatttgtctcatctgttgcactgtatttcaatcatctgtaattaaaatgatcatatgtttgctccctggtcttttttaagtaagtaagtaagtatcttagtagatttttcctttgaggaaaatcggtaataaaataacatggattgaatgtttactgtgcgtcaagcacagttaatatatgatgatgtaaagtaactaactttatgtgatttaattcattcagtaaattgtaaatgtatcatgagtcttaagtaagtaagtaagtaagtaagtaagtattttggctgaaacaggaaatactgattgattgattgattgattgattgatgattgtaaagtcagaaacgccctcagctctaaccttgagaaaacgtggacgacttggggaaaggtctggagacacctgagaggagccagtcagggtgatgagtccttcgcatgcaagtgcagtgctctctaaggcctcagactgcccccaccccaaaggaaggggcgttcaccttttcagggccacgaaggcctggatgaaatcacaccaccccctgtgccctctgtgtgttgtcggtcttcttgttaagggtgtggggtccctgtccctctccacacacgttactactgagtgagcc

SEQ ID NO: 5862 - DNA, 1819 bp, Homo sapiens
atgagtcaccagacaggcaggatcttacaaaactcacgggcctctttggtctgcatgatggccccatgcgtttcataggctgtccactgagcgggattgtctgctgagtgggatgagccaactccagtttcttaaggaaaccactggaatctgcagcccccacatgcatctgtctaacgcatgcctcgtgttcgttttgcaaacatgcctgtggtggagggtggtcagttgtagccctgtgcgtctcaaggctgccttgtgaggccattcccagtgcgtgcccttgagctccttaccaccccttttcctgctcggccctttaatccctgacagacctggactgtgtggctgaagggggacctgcagcactgcagaaatgcctctgcgtggtgccatgaaggaaagaaaccttggcctggtctcgagaagcttcccatgcttcaggaagttagtaagggtggggtggcttgcaggattggcctgtttccagggcctcccacactcattggccagattgtgaactttgtcaggcttgtccctccctgataccaagtatgtcgagaaccgatggccccaccctctggctggtgctgggccggaggtggctatggaggattttggcatgcgtggcctgtcgccacctggacagcgtgacctcaggggttgtccactttacctttatggtgaggcctgtcggatggctaagtccttgaaaccctagagctgtgacgtagaatatgtgctgtctgtgagaccgtgttcccaggagcactgactgcagttgagagagacccattttgctctcccttaccgccccccgccccgggtgctttctgcacaaagcctagagcctggcactcaagcccaccggtggcagctcctagtgactggacatgcctggaagacccctcagccttctgtttgcagaacgttcatttcaggagcttctccttcccacagacatcttacacttgctcgacactgccacctgcagaagcctggcgggctctggtcaccatgtgtctatctgaaggttgcactggccagcatgggcctgtcccaagcgagaggggagacacagtggactgaaaggactggttgaaagtggccaatctctatcagcttaatttggcagagaaaatttgtaacaactctgagcacatgctgggtgaagtcacagctcaaggaaagataaagctgggcggaaggaggtgtgcgtggcttctggggtgggacccagaggggaggctctgggacaggggctggggttcagtgccagggccctgaggaagaaatggggactgatctcaaaattccagaattccctgtacatctgttcacgtgcttgtgtccaggtgtgacttgtaaactgtctagtgtttgcattaaataaaatggcaccgagcagattcttgtcttctgatggtgttaaggcacgcccttggtcaagtgttgccacttttccctaaagtaagtaatttatgatgcagagctgccctcctccccctccccccgccccgcccccagctgaaggtatttctcgagaagcttagaattcttgcatttacccctcagtgactggctcagtgtcaggacttccaagggtgactcctcaccgtacaagcagctaaggccaggggatgtggagcgaccaatgtcctggggttagagagggcagaggcaggagcagagtgctgcggggccgctcccgggctacatgggttgcgcagtccggggcctggaagcagcaaaaagtcccaggctcacaaatcccaagtcgactgctctgccgccttccaagcaggctggtaaccagtgg

SEQ ID NO: 5863 - DNA, 1279 bp, Homo sapiens
tgaagaagaggaggaggaagaagaggaggaggaggaggaggaggatgaataaagaaactgtttatctgtctccttgtgaatacttagagtaggggagcgccgtaattgacacatctcttatttgagaagtgtctgttgccctcattaggtttaattacaaaatttgatcacgatcatattgtagtctctcaaagtgctctagaaattgtcagtggtttacatgaagtggccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcagctggcatgagaatattttttttttttaagtgcggtagtttttaaactgtttgtttttaaacaaactatagaactcttcattgtcagcaaagcaaagagtcactgcatcaatgaaagttcaagaacctcctgtacttaaacacgattcgcaacgttctgttattttttttgtatgtttagaatgctgaaatgtttttgaagttaaataaacagtattacatttttaaaactcttctctattataacagtcaatttctgactcacagcagtgaacaaacccccactccattgtatttggagactggcctccctataaatgtggtagcttcttttattactcagtggccagctcacttagggctgagatgaaggagagggctacttgaagctactgtgtgattttgtttgtgtctgagtggcattcagatgaagtctggaggagttaggagaacgacataggcaaggttcagcagccttccaaggtataggaaggtgggtgattaggactgaggctatctaggtttaacttttgtcccacctccaccccctattttgtggggccaaatgcattgctaaacagcaatttcagagtgtatggtgt

SEQ ID NO: 5864 - DNA, 1178 bp, Homo sapiens
tatcctgtttaacctgaaggctccagtaaagttcagtgcccggcgctgggagctctgtgcagggcgctgaatgtgccagtgcgcggctctgcgcgtggacgtggacgcggcatgtaactgaaacaggcacttctgctaatccttgcaggattttttctcctcccccccacccccgcccacctcgcgccacccttcccgcccgccctctcactacttctttggtctcagactaaattttacagggcttccctgcttcccctcagttttcactcttaggttacctcggaacggtaagtatttgacttggcaaggttttaggttactgcttgatcccatcggaaaagactgtttaagaagatggcctctaatgccttttctcagaatcttctctctagtaatgtgtttattataaatgcaatgctaggctataggagggagatggctaatttatctttttctaattatttaattatttttaatttttttagtttgaggcttcctgacatccctccagtgtctctccttgccccccactctccagcctccttcctaaaaacaagtccctctagctcacctctactcccctcctccttctccctccccctcacctccagtgaaggaaacgtttgcattttgtttttctctaagatggtggcagcatgaccctgtctcattgtgaaggctcctggcagggattttgtgctcactgctgtctgtcttatgttcgcttctttctcagagcatttctttaaaagaattctggaattataaaaggtcataatccagctggccttcccctgcaccttaaatgtgtagatttctgtacttaaaccacttattcttctctgtctttcccctttctccctccctcgatatgtttttcaggcaacatcttcgtggtcagtctctctgtggccgatatgctggtggccatctacccataccctttgatgctgcatgccatgtccattgggggctgggatctgagccagttacagtgccagatggtcgggttcatcacagggctgagtgtggtcggctccatcttcaacatcgtggcaatcgctatcaaccgttactgctacatctgccacagcctccagtacgaacggatcttcagtgtgcgcaatacctgcatctacctggtcatcacctggatcatgaccgtcctggctgtc

SEQ ID NO: 5865 - DNA, 1099 bp, Homo sapiens
tgcttgcccactggcccttgaaagtagctgagctgctagctgtgcttactactccctactgaaaaaaaaggcttttttttgtattattttgtgatgttttttgtattattttgtgatgtttgcaagtcctgaggtccaggatgtgccacgggctcacagcatctgctcgcccaccttgttcaggcatccccttcccactccactcattcctcttgctttgctttgtgtgttgacctccagcttgcttttcttttcagtgtgggatttgcagtaaaccgatgggcgatctcctggatcagatcttcattcaccgtgacaccattcactgtgggaaatgctatgagaagctcttctaggtgggtgctggcactgcaaaggacaagtggccaagagactcattaaggagtagagatgcaccctggtctctcctggagtctcagccccagacacagctatctttcttggctcttccttatgttcagggggccttgtgtcctcatgtccctatgccttgtgatactttgagatcttaggtggcatggacaaaggccctcaatgaggacacttccaaatcacaccttccgtccagcacctgagccgagccctctagctaccctgggatactcgctcggccgctgttgttagccccattttgcaacaaggaaataaagatatagaaagggaggggacctggagaaacccaggtagaatcaggacctcaccccaggtctttggattcttgtccagggctctctgttcactgtcactcgcatagcttcagatcaggactgcatagccatggtgctcagtgaaacaagcctctgggccacattatgagaactgcctgaagatgtgtgtttgcatgctcatagccagtggaatttatcacggtgtctgagcacagagcagaatatatcccttgaaggcagtagcaaccaggctttccactagctccatgctgatggtcttctctccagaagacacaccttgagctaggtggtaactcctgatgactggagcagtcacccaccctgagggcctctagctgatgtgtttccagtctcatggctacttctgttttcttttagcgaccccccac

SEQ ID NO: 5866 - DNA, 1161 bp, Homo sapiens
tatgatgacattttctctagaattttaattacaaacaaaaagctgcaaccccagcccatcagaaggtgagtacaccaggtgggcaggctggatggaaatgggccagagaagcaggctctttcctcatccgagatgcggactccctgtctatctgtgggcaccacttgactatccaacctgaccactgcggcacactggagatgctcccatcatagattagccagaactctgtgactgctcatcattatagaccccgccagcagcagtggggcttggcctcacctagatcaatggagtggtccaaacttggtctgggagcaagcagcccagccatcctttgagctcctgggagccttggcaatgctccgagtggattcagtgactgagcagcagattcacccaagaaacatctccttggacacaagaagacttgcctagaccacatcctcctttcagccggtgactctagaactagaaagagattggttcataggcttctgctgtgggcagctaggggaaaattcacccatgtgttctggcatcacttcctatagccacacctaagtgagggcaacagagcagaggctcggagaggaaccctgcccctccgatggcttgtgcgttatgctgatagaagctggcagcactgccctgggctatgatttgcaacagccatgcccaggaggagcactaaagcaaaggtttggagggcagtggaacccttctgaaagcctgtgtggcatagaagtagaagctggtcctcctgggtctgagctaccatttccagtgggctcccccaagaggaacagcagcaagggctagcgaggaacctgcccctccagtggcccacagaagccacagatagaagccagccccaccagggctgtgctgtgacttcccagcagctgtggctggggacagggacactaggagggcctggcaaggaagtgtgcccttctcgtgggcccaccaaggctgaggcagagcttcctagcagacacaacttggaagggcttctcaggcacccatcctgacccccaggctggagaggagccaaaagcacttgttacatagtgattccttttgccctgtgggcctcagttcttgcagtagttgtgaatctgtgtctgaaatcactactttcttctcggatcctttttc

SEQ ID NO: 5867 - DNA, 1213 bp, Homo sapiens
ctatgagtgagaacatgcggtgtttggttttttgtccttgcgatagtttgctgagaatgatggtttccagcttcatccatgtccctacaaaggacatgaactcatctttttttatgggccgcgtagtattccatggtgtatatgtgccatattttcttaatccagtctatcagtgttggacatttgggttggttccaagtctttgctattgtgaatagtgctgcaataaacatacgtgtgcatgtgtctgtatagcagcatgatttatagtcctttgggtatatacccagtaatgggatggctgggtcaaatggtatttctagttctagatccctgaggaatcgccacactgacttccacaatggtggaactagtttacactcccaccatccttttggtttcttttctttcctctgcagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctctaggcagggacctttggcccctttggggagggagagacagacgggcggtttgacttggacacaaagaaagccttggtttctaagcagttgcctccagcctgctttctgcttcctcagctctatgtctctctccttccccttgtcctgagctgctcaggtggcccaggtctgggcaggctggcggcggccctcctgtcatcttggcgggcctgggctgcgtcctcttcctgtggctccactcctccctgctgctgccagccacttgaaagcagagaacccactgtcgcctcccccggctggccttagggtcctgtgcgagacgcacccctcagccgccctccttgagtgcccctggatcccccgcggggtaccagtttcctgctcctccctggctgggcgctcagctctgggctggggaattcagcctgactggttgtccaggaagatgctgtctgggcttcccagggtgacccagtatctccctgagcagtgtgcctgtcacagctgcctccctccctgtgagtaccggaacaggcgtgactggtagggcctctgcctccttggggccattgtacctgctgctgcccgccccaccctgctccctcctggcaccatctcctttgcttccccaaggt

SEQ ID NO: 5868 - DNA, 1103 bp, Homo sapiens
gagacgccgggcaggccgcggcccctccccgctccctccccgcgagccgccagctacagtgcccctcctgggcagggggcggagaagacggcgactggaggggaggaggcggcggcagaggcggaggaggcagcggcggcggaggcgggatttggagtttccctccgcagcggcggcggcggctgcccctcggctccaggagaggccgccacccggggttccggtggcgttaggctgcagcagtggcgcttcccgccgcccgagcttcggaaacttcccggccgcgacgcagggaaccggcgcggagaaccgagcagagcggaggtgagtggagcaagcggcgccccggggacccccaccccccacccggcctggctgcccccgccccgacgtgcgctcctccaccctgcacccccaaagtcctgacaacgcacaccccacgaagccggcgcacgcgcccctacgacacccattcggtgctgctccgcacacccccgcacgccgcccgtgcacctcccgtgtctcctgccacttgcaccggctgcacactcgcgcgcatacaaaccacgcaccacagacccgggtgcctgtagtgcacacactagctgcccctgccccaccactcaccactgtccccaactcatgccaacccaccgagaccctgccacgccccagtacacacccaggcgcacacgcacgcttccaacacgtctctgccatacctgcaccaacatagctccccctaccatgcccccaccacctcgaactccccatctgcccattacagacaccccacccacgttgccagcccagagacactgcagtccacccatcctggagcgaggtcccgtcagaaacccacatcccagtggctgacgctccccacgtcccaggcacacacctccagcatctccaacgcgcactctcatccaccccagcacgcgcgcacacctgctggattcacgctctccagcatcctgccccgcccccatcacaaatagccttcgacaccccccagcacatctctgagtccctccctccctcacccccaacacctggcacgcgggctctagaggctgcagcatttggtggcatccctgcca

SEQ ID NO: 5869 - DNA, 1172 bp, Homo sapiens
gaaacatgtggcttatagtgccaactcagccaccgcctggccagggggcccgacttggtcacttcgtctcttcaacagacctgttgctctcccgggttccctggcagcatcctcaactccctcacaacccccccaccacccccattgagtcgatgaccaagctccatctttccagtagtcccacatctcttgccttgttctccacatggttcaggcttgtctcccagccaccagccctgccctgccccacttccaggccatcgctcacaccgaactccaaagggatctttgtagggcccagctcccatgccccatttccaccactgtgcaaagacctccctggttcccacttaacaggacataaaattgaggcacagaggagcttaaaggcaacacaagccaggtggcatggtggctcacacctgtagtcctagctactcgggaggttggggatgacttgagcccaggagttctgggctgtagtgtgctatgtccatcaggtgtccgtactaagttcagcatcaatattctgggagcagaggaccactaggttgcctgcggaggggtgaaacagcccaggtcggaaacggagtaggtcaaaactcgtgtgctgatcagtagtaggatcacacttgtgaagtgaatagccactgcactccagcctgggcaacacagtgagacctcatctcgtaaaaaaaaaaaaaaaaatggcaacacaaaccatctgcaagaccccaactcaaatccagcgtgggttcccccagcccagggttctctttccttcagacacacagagtttgcattcacaaagagaagtggggaaagaatgccgccttgttttcttcaattccccacacaatcatgtcccaagcaagacctcgcttgcatggatgcaagcaagaggatgcagtggcagagtgtgggttcaaatcctcactgtgccacaagctgtatggctttggctcacttagcctctgtatgcctcagtttctccatatgtgaagtggggatgatgatcatgatagcagctatctcacaggtgaggttcaagttaatacatggaaagctcttcaataaagagtcgttactagcatgctttttttttttttttttttttgtaaaggtgggttctcgccatcttacccaggctagtctcgaactcctgggctcga

SEQ ID NO: 5870 - DNA, 1292 bp, Homo sapiens
gctctgcagcacacccgtgggtgacccctcaccccagaagcagcagtggcagcttgggaaatgtgaggaagggaaggagggagagacgggagggaggagagagaggagaagggaggcaggggaggggcagcagaaccaaggcaaatatttcagctgggctatacccctctccccatccctgttatagaagcttagagagccagccagcaatggaaccttctggttcctgcgccaatcgccaccagtatcaattgtgtgagcttgggtgcgagtgcacgcgtgcgtgagtacggagagtatatatagatctctatctcttagcaaaggtgaatgccagatgtaaatggcgcctctgggcaaaggaggcttgtattttgcacattttataaaaacttgagagaatgagatttctgcttgtatatttctaaaaagaggaaggagcccaaaccatcctctccttaccactcccatccctgtgagccctaccttacccctctgcccctagccaaggagtgtgaatttatagatctaactttcataggcaaaacaaaagcttcgagctgttgcgtgtgtgagtctgttgtgtggatgtgcgtgtgtggtccccagccccagactggattggaaaagtgcatggtgggggcctcggggctgtccccacgctgtccctttgccacaagtctgtggggcaagaggctgcaatattccgtcctgggtgtctgggctgctaacctggcctgctcaggcttcccaccctgtgcggggcacacccccaggaagggaccctggacacggctcccacgtccaggcttaaggtggatgcacttcccgcacctccagtcttctgtgtagcagctttaacccacgtttgtctgtcacgtccagtcccgagacggctgagtgaccccaagaaaggcttccccgacacccagacagaggctgcagggctggggctgggtgagggtggcgggcctgcggggacattctactgtgctaaaaagccactgcagacatagcaataaaaacatgtcattttccaaagcaggctcctgcttccgcctctgctgctctaaggaaggggtcggggtacaggaggcagggggaacctcctccagctggagctgctgccgtgagcaaggctctgctctggaggcctctgcggccggcacccttctggggactgggaagggggcagggaaggcagcagcccaggggaaggccttgtccccctggagccgaggcagttggggagagcaggacgagagtgagctggagagcagccacacccgcgg

SEQ ID NO: 5871 - DNA, 1241 bp, Homo sapiens
gttgtgcttctggaaccagagtctctcccgtttacttcttcaggaaacgctggggccagtcttcaccttctgtcaactggccgggggcagagaccctttctctcatcttgaaagccccagtgcattgcctgcctgcagcccccacccccgatgtctctgctgaggatgccttcagtaactcgtccaggccgtttgtggctctgaattgaggctggcgtggcccccgggcctccgtgtcataggtccaagtgttggcatgtattgtccagtgaatccagcccccacctgtccccagttcgctcttcctgcacacctccagaaagccggccttgcccctccccagccttccttcacagccatcccgcctacgttgccattgcatttgtgaccgagcacttggatctgtctcgcatatcccacctggaaggggcaggaagagcgcatgggtccccagctgatccgtgctatgaggcagggccgggccatcctgccctcagaccgggatactcgagctggccttacccaggcatctctccctcttccccgcagccgaggcctgcctggagccccagatcaccccttcctactacaccacttctgacgctgtcatttccactgagaccgtcttcattgtggagatctccctgacatgcaagaacagggtccaggtgagacagtggggtttcagacaggagggcgggtggggggtgctcctcactgctagttgatgggggacctgtgtcgatagagggagaatcaagattccaactcttggggtgccggagagatcagggcacggtgatgccagatcctagccagtgttgacaggtcaccttcctcacctgctttgtgtgctgtgcctacacgaggtaaccctgggctcaccacccgctgtttcctgaatgagtatctggaccgggagaaagggccaggagtcagcccaccccggttgccattggccagtttgtctgtgtgggtgttttgtttttgtttttgttttttgtttgtttttttgagatagggtctcactctgttgcctcagctggagtgcattggcacgatcttggctcactgcagcctccacctcccgggttcaagcgattctcctctcagtctcctaagtagctgggatgacaggtgctcgccaccatgcccagctaagttcccataagtccaaagaaggaaatggggccttttttgggtatggccctcttagggtaaagcaccccttgggcagccca

SEQ ID NO: 5872 - DNA, 1691 bp, Homo sapiens
cctgctcagtgaccccacaggaagcttacacattttctcagaggcctttgtgctcccacctcttctaccctccccctcttctttcccattttaaaaaagaaaagaaggaaaaagaaaaaaggggcaaggagccccgcggcggcctgggcagcgcctgtgcagacctccctgcaggccgcactgccaactgctgcatttgttgtgttttttaggttgcaattggtgaagttcacactttcattgtaattttagcgtgtggggttttgtcccttttttgttgttgttagctgtgtacagaatgtgtaatcttttttcttttctcttttttttgttttgttttgttttgtttttgtttttttacttttttcttcttggctaattcttggcagggatctttctggaggaaaagctggggccagccagggcaggagaggtgtgaaatctgccacgaggggcctgctgtttgccacccagcccaacttcctgttgctggcccctgccctctgcccttttgcctgtcctcaggccgctggaacaaaggaaggacagctcattcctcatgggcgatcactccgcatctatagggtcgagcctaggggagcttgagggagggctggggcctccttgtcctggatttccagctctccccatgccccctccctgagcaccaccggcaccgcctcccaaacagggctgctggtttccgcagccactgctccacctcccccaaatcgtcatggaaagggtggagaatggaggggaaccaggcgtccttggaggcagcttgggagggtgactgtgtagtgtcacccacaagggaggctagggcaatggagcaggccaccagcagcagctgtgcagcatggaactcaggccaggctccgaggctgggggatctgcttggagttttctgccccccaccccaaacttctgtcgaggagcaaggcttgccagcaagtcagaaggatttgaaccgagcagccaatctttccagccctcccctaccgacctctgcctggagacgcagcagcctgtgtcctccagggcctctggtttgttgtattatagtatatttcgctgtggaaaatgtcacgtttagtcaccttggagcccactcacctggtcctgttgttttaccccatcccttctctcgcgcgcctattgatttgtttctgaggagagtacaccgttcactattgtagagtaacccctgtgactcaatattaccatagtgcgatgtcgttttgtgctattttgaacaattaaaagactttttttgaaataaccactaggtgtctcactgtgtcccggcatcctctcaggaagcctgagcgggaaggctgagacctgcccgaggctcacgggagccccctggagggagacctgagctctggtgaaagcgtagaaggccccagagtgaggcctctgctgtggcctccggtctttggaccaagtcggaccagggtccagcaggttgcttggtagctgccttgcagggcaagggccaaagagccccttgggcagctgctgctgacttcctgtgtctggggcccagatctccctccctcccctcctgcactagaggataggatggggcaagggcctggcaggtcaccagcggcagcctccttgggtgggttggggggaggtgggctgagtcaagtacaccacgggtactgcagaggtggatc

SEQ ID NO: 5873 - DNA, 1203 bp, Homo sapiens
ggaccatcacctaggagaccagaggaagtccgggaggtcagagcagaggccgggtctcatccccatggctcttcgtagcctgcagcggtcactgttttggccacttgaaagtgctgctctgggctctggctgtcctgaccctgtgatgaagggacaaaaatgtgggctccagggaggaggagcacaggcccaccaagagggtattttggggagaaattcatgtctgatcactgagtgctagggaaggaaggcagtggctagattcccagtagctgatgagggatcttgcacagtaacttcccgctcattaagatgaccttggcgagaagcagggtggtcacaggctcttttgcactggcctgaagtcgaggggtttggaagatggcccaggtagcgcagctggagttgctagagcgcccgcagggatggtgctggctcagcccctctcaccaagcttgacggctggcacatttggggaatgagaggaatgggggctcccgggtgttctgacttctgcctccttctgttccccagcaaccaaccagtggttcatcccagccgtgaggggggacattccccctgggtgtgcagcctatggcttcgtgtgtgacgggactcgcctcctggtgtttggtgggatggtggagtatgggaaatacagcaatgacctctacgaactccaggtaaagcagccccaggttctcactctgcctccttggccccatgtgacctgacggtagtggcttcagggttgaggcaagcgggaggtggaagggacgcttgagagtctgccaaggctgctctgaacttggcccacctcagaagaaggcagcaaggaccaacacccaggaccttcttgctccagcaaggcacctcgctcacccccggccatttcctcctccaccacaagttgccccgggtccctagtggtggccttctcatcccacggttcagtctccaggtcttgattttgcaggcgagccggtgggagtggaagagactcaaagcaaagacgcccaaaaacgggccccctccgtgtcctcgactcgggcacagcttctcccttgtgggcaacaaatgctacctgtttgggggtctggccaatgatagcgaggacccaaagaacaacattccaaggtgaggcttggtccttttctctggaaccccccgggtgggtgtgctctcacatgcacagggctccat

SEQ ID NO: 5874 - DNA, 1722 bp, Homo sapiens
cagcacttttggaggccaagatgggaggatcacttgagcccaggaggtggaggctacagtgagctgtgatcaagccactgcactccagcctgggagacagttagaccctgtctcaaaaacaaatgaacaaacaaacaaaaaccctcaattcccacgaacgccccaggagataagggagcatggcccaggccttgagccagggcttctggcagtaggggagcctcccccatttgctaagcggactttcctcttccttctgtaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaatctcgggctctacttgtggactttgttgcaccgaaagccttgagctttc

SEQ ID NO: 5875 - DNA, 1151 bp, Homo sapiens
gagggtggctttgggtgcgtgtaccgggcggtgatgaggaacacggtgtatgctgtgaagaggctgaaggaggtgagtgtcgcaccctggcagggaccctggaaggccatcagataaccctcaccacttctccagcctttccccctcgcttccccacacaactccttcagccctcattctggcgtagggtccctggccccttggtggttctgggcctcgggtaggtggcactggtggcccgaaggccttcgcttcgagagcctcacgctgcccgtcttccctgccccttcccccaccgcaccctgggggctgcagaacgctgacctggagtggactgcagtgaagcagagcttcctgaccgaggtggagcagctgtccaggtgaggccagagggggagccacaccaggtcccgtggggcttcagaccgcacaccacaggacctggctcccttgggcacctgaggcctggcaggcccgggcgagctgaggccccagccagggctgcccacccagtctggcctgatggaaagtgctcccctttttcaaacaggtttcgtcacccaaacattgtggactttgctggctactgtgctcagaacggcttctactgcctggtgtacggcttcctgcccaacggctccctggaggaccgtctccactgccaggtaggctcacctggcccggcacgcttcccaggacccaaagcactcctgacacctggctggagccgggcgcggggcctagggctttcagcctgtgtgagtgggtcctgccagcaggccaggcctgcacttccagctccccagcagcacccggctcaggatttggcccacggtggggtcaatttttttttttttttttttttttttttttttgaggtggagtcttgctctgtcatccaggctggagtgcagtggtgtgatctcagctcaccacaacctccacctcccgggttcaggcgatcctcctgccgcagcctcccgagtagctgggactacaggcatgcaccaccacacctgcctaatttttgtatttttagtagagatgaggttttgccacattggccaggctagtctcgaactcctgaccccaggtggtctgcgcgcctcagcctcccaaagtgctgggattacaggcgtgagccaccacgc

SEQ ID NO: 5876 - DNA, 1160 bp, Homo sapiens
agggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtcccctgcgcgggaccatctggaattggtttagcccaagtggagcctgacagccagaactctgtgtcccccgtctaaccacagctccttttccagagcattccagtcaggctctctgggctgactgggccaggggaggttacaggtaccagttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagccctgctccctccgggtcttcctactcttctctctgctctgacgggatttgttgattctctccattttggtgtctttctcttttagatattgtatcaatctttagaaaaggcatagtctacttgttataaatcgttaggatactgcctcccccagggtctaaaattacatattagaggggaaaagctgaacactgaagtcagttctcaacaatttagaaggaaaacctagaaaacatttggcagaaaattacatttcgatgtttttgaatgaatacgagcaagcttttacaacagtgctgatctaaaaatacttagcacttggcctgagatgcctggtgagcattacaggcaaggggaatctggaggtagccgacctgaggacatggcttctgaacctgtcttttgggagtggtatggaaggtggagcgttcaccagtgacctggaaggcccagcaccaccctccttcccactcttctcatcttgacagagcctgccccagcgctgacgtgtcaggaaaacacccagggaactaggaaggcacttctgcctgaggggcagcctgccttgcccactcctgctctgctcgcctcggatcagctgagccttctgagctggcctctcact

SEQ ID NO: 5877 - DNA, 1132 bp, Homo sapiens
agcactgcttgcccctcctctcgtctggtctggtctggtctggtctggtctggtctgagagcttctttggggctctgacaggtatacaggctctcatctgctctacagctctcttgtagtacattcctctctgttccattagtcaacatgttcttgcctacttccagcatctagaaatttgctgagtgtatcttatccgttcagaggtcctctcctgctattgcctctgttagaaatttcttccctttcatatgtctgtacttcggtttctttgaggtttgaagggtcaagtggcaattacatgtaggcagttggccatcctctggtgaaggctttaaagcccaggaataacaagatccattatgtctaaaactagcaaaaaccctacctgtcacatggtgaactgaattagaggtgatggggacagaagccagattggagtgagtggaaggtgagggagtggagattgggtatagacaactctctttaagaagttttgttgtgatggtgaccagaaaaataggagtggggtagagggggatgagggtgtttttcacgtgggtgaatatgagagcatgtttacatccttctgggaatggcccaggagagaggggagcgtgagaaggaggaaatggggacctggaggagcagactccttgtgtggaggggggaagcggcatctagagctgttgcaggaggtgggctttgagtaaatgcttcctctttggtaaagacggggaacgggaacggtagaagttgcacggaccctttgttaaagctcagaagctgagcgagaattagagcttaagtttatggagtagtcagaataaagtacccctaactgtattcttgcacagtgcaggaagccaggggtctgaaatcaagatgttgcagggctccattccccccagagcctctagcatggatccttccttgcctcttccagcttttggtggctgcctggcagtcctagactttccttggcttgcagttgcattgctccattctctgcttgtgtcttcacatggccttctctgtgtccccgtattcttctctggatgcttgtcactgtattaggcccaccctaaatccaggatgatctcatatcaagatccttcacttaattacagaa

SEQ ID NO: 5878 - DNA, 1164 bp, Homo sapiens
accgcgagccttctcagttgtcaggaaactccggtttcaccatcaggcctggggggtggggaggcaagtgtcacatccccccacgctgcagcaggactccgcctcaccgcgtccacacacagcaatgggggccggggccaggccagaagggcgcaggcagccgtgtgcccagccagatgctggcgttcagcagtgtgggccatggtgctggacgaggctgagtaggcaagggagtggctgtcaacacttaggctggagtgggcccttccttttcctcccaggcacctgggtgctactgtcgggcctctcccacatgggcacttgaggtggtcaggagaaaccttcctgccttctgagaaaccactcgccatcccagcttggaggggcagggcggggcaggaggcctggcggcctggctgtgcttggtggtggcaatgagaggcctgtgtgggcggcaggcggacgggaacaacctgaacccgagctcacacgctggcccccctttggggacccaccctgccccaccaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggtgaggaggggtggggggtaggtcagcaggggtgtctggcaggtcccggcctgttcccctggggcccctctgtgacaacagactctccagcagctctctgctttgccctgcaggctctggctggggaccagccctcggtgcagccccctctacggtctcagcagctggccccacagtacacctacgcccagggcggccagcagacttgggtacggcctggccagctagggacactggggctagccagctgggtgttctgtgagcccctagtttaccatgtgtgaggagggaccccagatcctcccactgtccctcacccatgccctgtgtctccactgcaggccccggagaggcccctggtgggtgtcaatgggctggatgtgaccag

SEQ ID NO: 5879 - DNA, 1181 bp, Homo sapiens
ggattacaggcatgagccaccacgtccggccgcttcatttatttttatggccgcataatactccattgtgtggccagaccacattccatttttccgttcacttgctaacagatattgaggatgagcttgcctttggtgatcatgaacagtgctgttaacagtgagtccaggtgtttgcgtggacatttgctttcatttctcttgggtagttgcctcggagtgaaccggagcatcacacagtccctctgtggtcaactgaggaactgccagactcttcccaaggcagctggaccattttgtgtgcctgccagtgtagctgagggagcttctgagtctcctccaggctgctcatgcccttgcccttgcccctgtgccctgcaggtgaatgtgggagctggcagccaccccaacaaggtcaaagtatacggccccggagtagccaagacagggctcaaggcccacgagcccacctacttcactgtggactgcgccgaggctggccagggtaaggcctggctgtgggtgggagggcaggtggctggggtgtccctgcgaggtctcagcctccgctcctctccccgccgcaggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggtgggtgctgcgctcctggccgctaagatgtcattgcggatgacgtctgccctcctctaaggccttctcctcccactgcctgcaggccacgcccaccagccccatccgagtcaaggtggagccctctcatgacgccagtaaggtgaaggccgagggccctggcctcagtcgcactggtgaggacaggtaccccatggcaggttgcggggcatcaagggtaggagggcttggggcagggtgcccctacatggtccctgtgtgttcctcaggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtc

SEQ ID NO: 5880 - DNA, 1197 bp, Homo sapiens
tccgccgctagccaatcctcgcgttgatgacgtttgggctcgcggccccagcctcccagctctcagggcacggccggtctgtgccggctgctcccgcggttaggtcccgccccgcgcagcgcgcgcagcctgcggagccagcggccgtgacgcgacaacgattcggctgtgacgcgacaacgattcggctgtgacgcgagcgcggccgctcccgatgcgctcgtgccgcccccgccgtgctcctcggcagccgttgctcggccggttttggtaggcccgggccgccgccaggcctccgcctgagcccgcacccgccatggacaactacgcagatctttcggataccgagctgaccaccttgctgcgccggtacaacatcccgcacgggcctgtagtaggtacgcggcggcgggcgggaccccttccgggccccctcctcgtgctccgcctcgcgacctccccgctgccctccccgcgcgccttccccggcccgcggccctgaccgccccgtgtccggccaggatcaactcgtaggctttacgagaagaagatcttcgagtacgagacccagaggcggcggctctcgccccccagctcgtccgccgcctcctcttatagcttctctggtgagagcctcgcctgtggggacagcctgggacgcggggaggatggggtcgcgagggtgtggcaggggggccggtcgagagcggcactggagaaaggggagggaagtctgggggggcaaacagttctgtctcctcctttcaatccagacttgaattcgactagaggggatgcagatatgtatgatcttcccaagaaagaggacgctttactctaccagagcaagggtaaggcaggggttgggtgggcacgctggcaccttcacccgacttcgtcagggaccccgctcacagggaggacctgagacctcagtcccaaccactccagcagccttaggagggagaaactgttacaggtcccgaaatgggattcagattagggccatcaggccaggcggggcacaccgatgccccctctgctaccgctgccccccttcccaaggctacaatgacgactactatgaagagagctacttcaccaccaggacttatggggagcccgagtctgccggcccgtccagggctgtccgccagtcagtgacttcattcccagatgctgacgctttccatcacc

SEQ ID NO: 5881 - DNA, 1180 bp, Homo sapiens
cggcctcccgggttgacaaaggaacgcgggcccagatccccgtatggcgcttcaccgccggggcctctagcctagaaggaggcacggagcgcgtgtccgagacccgtgcaagctcagggacactctcgcggtcgccgggaggcccacctagggtactttccttttttccactctcagaaatatacgtctgtcacagttaacggcaaagcctagggcaagagttctacgcccaagatggccagccggaagcgggcttctcgcgaccatgtggcgaagccccattcgtcagctggccgcccgcggccctggtacccggtcacctctctgatctgcgcatgtgctgggctacgcccgggcgcaagcgccaagagcggctgcgtctatggtcatgacgtctgacagagcgtccacccgtcttcgacaggactctatggttcttacgcgcgcagacagaccgcctatataagccatgcgcaggcggaggagcgcctctttcccttcggtgtggtgagtaagcgcagttgtcgtctcttgcggtgccgttgctggttctcacaccttttaggtctgttctcgtcttccgttccgactctctctttttcgttgcagccactgaagatcctggtgtcgccatgggccgccgccccgcccgttggtgagtcttgaatccgtgtactttcactgctgggaaacgggcggggaaagaagtgcctatggccgctgaaaacaattgtggggtggagcctcccccgtgcggcggccctgtcttgggaactgaccctatgttttacacctcccggctattttttagtctgcaatattactgtctgttccttcgttcccgtgtcggtgtggaagcgacggttccctcgtatctctgcctgtgtcctgcaagctcaccgcattttcgggcgctagatacgctcttggggcctttgtgtgcgttctctgtcttatttccgggcgacgtgccgcgtgcgttgtcggacgtgaagggcagtccgggaaaaacgggtgcggccgcctcctgtgtcctacagggggcgccagacgcatttccactcggcttggaggtggatttagtgccacgtgcccgaaagtcttaaattgggtgacctgagctgtgcaatgataatgcggcgattttgtagtacgcagtgtcttgaagagagaattttta

SEQ ID NO: 5882 - DNA, 1192 bp, Homo sapiens
ggctgtggggtcaggacaggacaggtcatctacagcacaggacccaggaccaggaccttgttttagaggaagagtggcccctggggagtgtgtggcacagcagggccggggcttagcttctggctcccgggttgcttgggctggggctgtgggcactcctactgctcctcatcactcttggcggccaccccacagaaaatcactgtgctgatcgggaagcccttcagtgccctgcctgtactcgagcggctccgggcggagaacaagtcggctgtgagtttcctcctgggtcccccgtagctgtccccggaccccctgctgctggcttccagcagggtgcctccaccctctccatcccgtcaccctcccagggcaccctcccagggcaccttggccaagcttcccgaggggtgcaggccatccctggtcctttccctcaggtggagatgcggaaagccctgacggacttcattcaagaggaattccagcatctgaagactcaggcagagcagctccacaaccacctccagcctgggagataggccttgcttgctgccttctggattcttggcccgcacagagctggggctgagggatggactgatgcttttagctcaaacgtggcttttagacagatttgttcatagaccctctcaagtgccctctccgagctggtaggcattccagctcctccgtgcttcctcagttacacaaaggacctcagctgcttctcccacttggccaagcagggaggaagaagcttaggcagggctctctttccttcttgccttcagatgttctctcccaggggctggcttcaggagggagcatagaaggcaggtgagcaaccagttggctaggggagcagggggcccaccagagctgtggagaggggaccctaagactcctcggcctggctcctacccaccgcccttgccgaaccaggagctgctcactacctcctcagggatggccgttggccacgtcttccttctgcctgagcttccccccgaccacaggccctttcctcaggcaaggtctggcctcaggtgggccgcaggcgggaaaagcagcccttggccagaagtcaagcccagccacgtggagcctagagtgagggcctgaggtctggctgcttgcccccatgctggcgccaacaacttctccatcctttctgcctctcaacatcact

SEQ ID NO: 5883 - DNA, 1108 bp, Homo sapiens
tttaaggaaaaggattaaaacagggattggccgggtgcggcgatgcgcgcctgtagtcccacttttccggaggctgaggcgggaggatcgcttgagcccggggactcgagaccagcctggccaacatagctagaccccgtctctaaagaaaaaaaaaagacaaaagaagagaacaacaacaaaaaaaccaaaataaaaataaaaataaaaacggacgggcgaacgcgtcgggtgggcgtagggttccgcgaagcctccctgtccctcttgtctcgtcctagtcggtctagctgggccccatcccctttcccactcggagcgtgagcgcctggagacacgtacagccaaccagtgagaaggagtggccgcgagtggcatgcacttggtccaattacctgcggccctgccggtcggcccgcgctggggccaatggaggtgcgaggcggggctcgggcgggggcaacggtcacctgatctgcggctgtcgaggccgctgaggcagtggaggctgaggctatgatggcggccatggcgacggctcgagtgcggatggggccgcgatgcgcccaggcgctctggcgcatgccgtggctgccggtgtttttgtcgttggcggcggcggcggcggcggcagcggcggagcagcaggtcccgctggtgctgtggtcgagtgaccggtgagcgggccggggtgggatgcgctgtggcggctgaggcgccctcgcccgactccggcgctgtcctaggcgaggggtggtgaggcccggaggtggactgttccttgctcgggggctcgcagcgaatctgccggcgacagagctccagtccacatgcgcccccgtctgacagcacctcttctgtgccctgccagggacttgtgggctcctgcggccgacactcatgaaggccacatcaccagcgacttgcagctctctacctacttagatcccgccctggagctgggtcccaggaatgtgctgctgttcctgcaggacaaggtgcgcccgccccagcccactctcccccggtcatcgggaggcagccaggccccctccccccatgacactgacgcccattccccaagggaagcttcagtgaccttgtccca

SEQ ID NO: 5884 - DNA, 2330 bp, Homo sapiens
gcccgcacgcagccctctccctggcagatgatgcttcaggacttccaggtatggagcgggcgtggcccagcttcaggtgggggagcccaggctagtggttgagagacgaagagaggcttgggcttgggcatgtagttgagagtcctgtccctgcgctgcccctgtcccagttcttgctgggcctcccaacggtcctttctgacccgtgtctgtgtgtctgccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatgcgttgggcctcttgtcgctcatttctgcgctgggctttaggcgcgtgctcgccggagggatgcgggaggatggagcctggcgagggggaggcgaagaggcatccgcggagaccgggaggggctttagcaagctgggccctaaccgctcagggtagggaggggcggtcgggccgagtcccggtgcgcttcggcgtctcaggaggccgtcgtgacaatggcagccttcgcgtcgtgagggggccgccccaggctgccgcagcggcgcgcgcccggccgcggggccgcgccgagactcccgggggggtgggcgggggtggggaggtgggcgggcgcgcgcggggcggggcggggcggggcgcggcgggtggggcggggcgcgcgcggctcccgcgcacggattcttcctgggccgcagcaccggccgccggcccgccccgcccgccccgccccgcgcctctctagactctcggcgagcagcgtcgcccgcggagccgcgctggtgctgtggcccgggccctggcagccctcccgggaggcgagccggggaggcggtggcccctgccggttgcggcggggcgcgggaagaggcgggactctttgacgcggcggaggggtcgggcgacggccgacgcgccgccatctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgtaagtgcggccccggcgcccctggccctgcgtcgtgccctcgccatcccccgcgatgatgcggccgccggcccatcctctggtcactgccatcttctgcgctccgctccccgaaaagccggcgccgtgcccaccccgctgctcccccagcgacgtcgcctctgctcgttgccatgaccccatctccccgaagaggcccccttcctggccgcctcctgggctacccgggtccgacccccggcgccctcccatcttccctacccctgcccgctggaccggaaaacgcacccccactcggcccgatgcccacgaccccgcccacccatcgcccccacccatcacggcatccacccgtcgcccgcacccattgcccgcctagcgttgcctctcagcgtcccttcccatcttgcgctaatcccggtggggatgaagtagaaggacctggggtcagggggcctcgccagagtgggccctcagcccgcctcctc

SEQ ID NO: 5885 - DNA, 2330 bp, Homo sapiens; identical to SEQ ID NO: 5884

SEQ ID NO: 5886 - DNA, 1194 bp, Homo sapiens
acaaacgcatggctggcacggcctttgactttgagaacatgaagcgcaaacagaacgacgtctttggagaagctgagcagtgattgtggccgcccccagcccctgctgccccagcctgtgtctgttctcctcgagggctccagcatcctctgcttcccccaccacgttcccatcacccacctcattgatccactgaccaaatccttaaccctagcgatggcttgggagatggggggttggatagcatcctctttcttggcccttccttatcctaggaaaagagggttcctctccttgtgtgtgtctcttccccccacccctaattcttctgctctgtttgggaagacgtggaggaaaaggtgacttctgcccccaccgctcttacccccactgtagtggcctttggagatgcccccacctcccccccaccaactctcgcgtgttggagagaaggggccctcccagcacaaagttgcattcctcccccctaatttattctaatttattaactttgacccaccctttctgagcctgcagccttcccgtgtggcctgagggctgtcgagtgagctgccccagcccctcccagcccttgcccagcctgggggagtggggaaggcttgggcatggccccgttggaggttgatttgctgttttgtttcttgtctttgtgttctgtggtacttgctgagagaaaagaaaagtgagccaagcagaaggaggtgggaaaacggacccaaaccccagtgtgccctgccccatgcctttcctttagtggtgggaaacccttatcttgcaaagtgaatgtgtccccttccccaccctctagtgtatttcacagaaaacaaaacctcccaataaaacggttgaaacctgaatctctggatcttgatggttatctcccaaaagctgggtacctggcagggctttggctgcctgggttggggctctggcttagcttcactctggactgtaaaaggtggcattcttcaccagggaattcctcacccagagcacgctggggccaaattgacttaaagcttaaggctacccagtgagtcgatgctggcaccaggactgcagccctcagtgctcaatgcagggggagtgtggtggagggcgggtgtcaacgtggaggaagcagagggagcgggggtcctggcctctggcttgaaaggagagggcagaggggac

SEQ ID NO: 5887 - DNA, 1156 bp, Homo sapiens
ggcccaagccagcttccctgtccacagtctcctgggtggtgcgctgagccccaaggctgctctcagtggggctggagaccaagaggcagctctgccttgtaggtgaggagatcgagatcaccttcagctactgggatggctctgggcaccggcggacagtcaaggtaggcagcgtgcagcctgcttcctgctcaccatgggcccagcctccctcaggttccgtgggaaggaactgaccttcctgacttgggaagccccagggatcctgaggataactggctccagggcctggccccctgtctggggagtgaggcccaggcctggctgaggctctgcagcgtctggcagggccctctgggcctctgccttgttgagagcccttctgcaggcttccgccttcccttcccaactcctggattcccggatacagatgagaaagggcaacaccatgcagcagttcctgcagaaggcgctcgagatccttcggaaagacttcagtgagctgaggtgtgaggtgtgcgtgtgtgcacggtggtgtgtgtggcacctgtggctccagcctgggtgccagacacccagtgtgatgtgggcgctgtctgggcaagcaagcagcgtgctgggcactctcctcccaaaagagggggtcaggctcctcttcccttccctcccaccagagagctttgctgagagcggcctgccttggttccttagcccaaaggtggagggtgctgggcgccagtcctgtgctcactaaaccatggagcttccctcacagccaactggccgctgcttcccagccccagcatgggctctcctgggctggctgtctcctccctccctgggcaggggtgctgtcctcttgcccacgccctcctgccttcctccctcaggtccgcaggggtggagcagctcatgtacatcaaggaggacttgatcatccctcacgtgagtcccttcagccccagtacccgcagtgggtgcagcaccctgggctttggctcaggctggtgggggcagtgtgcgcaggcggggggtgtggggaggggccgagatggaccatcaagacgccgctttcctgcccttggctcccagcatcacagcttctacgacttcatcgtcaccaaggcacgggggaagagtggtgagtgccgccgac

SEQ ID NO: 5888 - DNA, 1147 bp, Homo sapiens
tgaatggatgaatgccattattatgggtgagttagttaccttgaagttcagcccccttttttcctgcgtctcatatgcttgcttccaccttccacctttctgccacgggatgaccctcaccagatgccggcgccatgcttttggacttcccagcctccagaaccatgagccaaatgaatctgttgtctttataaattacccagtctgtggtattctgttatggcagcagcaaatggactaagacaagcctctactgactacccagttccaaagccatttccacatttttaggtatttgttacctaagcaccacacttcctggtgccaaaacctgtatccatttcctggaactgccatttcaactgggtggcttaaacaacagaaatggattctctccccattctgaaagccagaagtctgaaatcaaagtgtcagcagggcgttactcaccctgaaagttctacaggagggtccttcctgacctccccaggttccagtggccccaggcataccttggcctctggctgtgtcactcctgtctcttcctccactgtaccatggctgtcttccctctgtgtgtctttgtcacttctgttcttataaggacatcagtcatgttgcattaaggacccaacctactccagtatgaccccatctgaactgcaaaggccctatttgcaaacatcacattctgaagtaccacagattagaacttcagcataccttgaggggacagaattcaacccataatagaagccatcctgctccagtcctcccaaccaacccccatcaaaatcgggagacaggctgcaccccctgccacactaccccctgccacactgcctttgctcaggttggcctcatccatgcagctagacccccagcctgacttacttcacccctgctttgttcctggctgtgcagtggcccaggccagccctcagcatcctttcttttctcccaccagtaacagaaaatccttctgtcttgggtccctgtggcctcaccagtaggacacagagtatggaagtgtccccagcctcggcctgagccacatccccctacttgtgtcctgctctgcggtcacttgttctaccatgtgtgctggtcctgacctccccttcagatctcaggtgacctcagggcc

SEQ ID NO: 5889 - DNA, 1135 bp, Homo sapiens
gaacgcgcttctggacagaaaacagaccctaaggaaaggcagccagaggctcacgctggatcctgcggtcttccctatctgcgcctctgtacctcccttgcctttacaaagcgcatggatcaactttggaacaggttctaattctgccccagatccatctgcgtcttcccacgactcacaaatctgacctcagggtgcaagcgcagccccagccctctaagcctgggtaggcagggctctcccacccgagaaagggccgaggggagacttccggggcgggaccgacgtgggcccctcccactcggcggccggtgggttcagcctgaacgcaccgcggaggtggggccgacgagggatccaggggcgggacaggttcggggcgggacaggttcaggcccctcccatgcggcggccagcgcgagcggtagaggcgggtctggaggcggggcctgcgtggagccagacggcgcagctgctgccgggggcggggccggcgggctgtggccccgcccttagccgccattgccgggcctgcctggccaccctgcgcagcggccttgcgtcctctccgggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacaggtcgtagcaccgatcgcgcccgcccccagcaggggtcccgcacaggcttgcccctgacccccacccaaacctgtccttccgctttgcccccaaacagtgcacttgccggcggtcccaacccagcaggagaagtggacatgaggttggcaggtgggtggcttccacagcgaacgggagggagttgaaaagggcacctggctggaggcccagcgtcgcgacatctgtgtctggagaggcccgggtgaaccactgggtttggttttggaaatggaggactctgcacaaacactc

SEQ ID NO: 5890 - DNA, 1204 bp, Homo sapiens
ctgcctcagcctcccaagtagctgggactataggcgcccgccatcatgcccggctaattttttgtacatttagtagagacggggtttcaccatgttagccaggatggtcttgatctcctgacgtcgtgatccacccgcctctgcctcccaaagtgctggaattacaggcgtgagccaccgtgcctggccagaattacagatctttacagcaaatgcttatattttaagaagtgtgtctgtcacctctagtcttggtggctcagatgaaggataactgcatttctcaaccagtgatgtatttacagtaggtgctgcttttcttttgtgtgtgtgtatcttaggaatcttttgggtgagttgtgaggctggcacctacattcggacattatgtgtgcaccttggtttgttattgggagttggtggtcagatgcaggagcttcggagggttcgttctggagtcatgagtgaaaaggtatgtgttacggggctagaagttttagagctggttcttaccatctgccagcctttgatggcactccacttgcttcatgtcgtgggaaagatgctttccaaagtgttgagttcagtccagggcagcttccctgttctgttaattaaactttgggacattaaaatgggctaagggagatgattgggtagaaagtattattctattcatttgcctcccagcctacaaaaatgcctgcttggggtctaatacttcaacggttaaagatgcctggaagagggcgcggtggctcacgcctgtaatcccagcactttgggaggccgaggcgggtggatcatgaggtcaggagatcgagaccatcctggctaacaaggtgaaaccccgtctctactaaaaatacaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtcccacctgggcgacagagcgagactccgtctcaaaaaaaaaaaaaaaaaaaaaaaaaagatgcctggaagagccaggactgaagaggctgaagacataatgagcttggactagtaaacaagtgacattcagttttaggaagtttggggtctgatgggctgagatacaaataaactgaattattttcatacatggctgcttttc

SEQ ID NO: 5891 - DNA, 1204 bp, Homo sapiens; identical to SEQ ID NO: 5890

SEQ ID NO: 5892 - DNA, 1161 bp, Homo sapiens
ttgtgatcttcaacaagtcctgtgtgtgttggagttagtgggcaaattctgaatgctctggagaggagtttgaggccctgctgagaatacaccagggaggaaccttgttctattctttgtagtcaccatgcccgcttccagcattgacaccattctaatgttgacaccttgatgttccaccaggcaagtcagaagaagctgatgatcaagcagggccttctggacaagcatgggaagcccacagacagcacacctgccacctggaagcaggagtatgttgactacaggtgagggcaggatgtttcagagccggggtgggtagagacggcacacttgctgccttgatgcaggagtatgtcaacaacaggtgaggatgggaaggtagagcccacttgccatctggacgcaggagtacatggacaacaggtgaggaacaggtgagcatggaggttgtagagcccaggggagggggagtcacttggtttggggcaaacttgctaaatgcaggaccacaggaaccagctcttcagctcccgtgagattttggctgcccaggccagttaggggtgtgggcctgcacggcagacagttatccctttctagtctggctcgtgggactctagagggagtcagtctgcaacagtaagtggtgagttcttctgtccagcgtcagtattttgatggtggctttagacttgccagataacactacataacatcagtactgccctggaaagccattcagtgaatttgacctattgctacctctttttcagtgagtctgccaaaaaagaggtggttgctgaagtggtaaaagccccgcaggtagttgccgaagcagcaaaaactgcgaaggtgagtggcatgctgtcctcagtttggaatgtgcttagggagataatcctaagaggcactggcattcgtcttactttgtgactgtccgcagtccagccatatacgctagcatcagaggtgcagcgcatacacaggtaatgctgcctcataccctggggtgcttgtttgggctctgcaggctcctctgatttgtattctctgtcctatctgctgggaggaggaatgtgggctcaggaatcagatgggcctcgactcctacctcagctatggcagcaacacagtgatggaatgggtggtggtgtgtgt

SEQ ID NO: 5893 - DNA, 1161 bp, Homo sapiens; identical to SEQ ID NO: 5892

SEQ ID NO: 5894 - DNA, 1153 bp, Homo sapiens
taagtctccgggggctgggggaaccagggtttcccaccaaccaccctcactcagccttttccctccaggcatctctgggaaaggacctggggctggtgaggggcccggaggagcctttgcccgcgtgtcagactccatccctcctctgccgccaccgcagcagccacaggcagaggaggacgaggacgactgggaatcgtagggggctccatgacaccttcccccccagacccagacttgggccgttgctctgacatggacacagccaggacaagctgctcagacctacttccttgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttaagaggcttccagagaaaacggcacaccaatcaataaagaactgagcagaaaccaacagtgtgcttttaataaaggatctctagctgtgcaggatgcaaacgtctcggggtcagtgactgcctcctgcccctgttggtccctaggcagtgggggcagaagctcccagctgacctgtttctctgggatgagagggaggagagaagggcagtcagcaggggcagctgttgcagatgggaggaatagtctcccacaaaaaaggtttcagtgacagacacggggtctctaaaaatagtcatgctgagagcctaatggcccttggcacaattgctggtgttggggtagaagatgtcttggagtttgctcaagtggttgagagggagggaggtgccatcgacttggaggaactggcaccaagccagggagatagaaatccaggcaaggctgtggggcaggttagggagcaaggctgcaggaatgactcaggaagaaggtgggggaggtgacaagcccccaggcaggggccctgtggccatggggatcttcttaaattgagactagggggtgaatagtccagggcagctaactttagttattatagaaagggcagtagcagatgggtctgctccgtctcgcttctaagaaggtgggcaggacaaatggcagcctcctgcagaggcccagtgagaagcctggccctcggccacgcagga

SEQ ID NO: 5895 - DNA, 1153 bp, Homo sapiens
ctctgaatgcgtggctttggcccagcccgtgtgtggctccgacgggcacacgtaccccagcgagtgcatgctgcacgtgcacgcctgcacacaccagatcagcctgcacgtggcctcagctggaccctgtggtgagtgaggccctggggccgggcgggccagggtcctgtgcctccctcagcctgggcctgccgacccctgcctggctctgtctcctgcagagacctgtggagatgccgtgtgtgcttttggggctgtgtgctccgcagggcagtgtgtgtgtccccggtgtgagcaccccccgcccggccccgtgtgtggcagcgacggtgtcacctacggcagtgcctgcgagctacgggaagccgcctgcctccagcagacacagatcgaggaggcccgggcagggccgtgcgagcagggtaggccgggggacgctggcgaaaactgctgggctctggctttggacaagaagcccctgggtgactctgctccccttccccgcagccgagtgcggttccggaggctctggctctggggaggacggtgactgtgagcaggagctgtgccggcagcgcggtggcatctgggacgaggactcggaggacgggccgtgtgtctgtgacttcagctgccagagtgtcccaggcagcccggtgagctctgtacccctggctctcggcgggcggcggggacggggctgcggccgctcacactgacaccaccctccaggtgtgcggctcagatggggtcacctacagcaccgagtgtgagctgaagaaggccaggtgtgagtcacagcgagggctctacgtagcggcccagggagcctgccgaggtgagccggctgcacgtggggtctcaggcacaggcggggcggcgtctgggtttccgtgtctggatgtgggcgtgcccgtgtgctgcgttgggcccctgtggacgtgtgtattgtgttgtaagtgagcatcgtccagtgttggtgcctgtgcacatttgtgcagctgcgtgtgtgggcgtgtgtgtccatcagtcagtgggcgtgcaccaggccaggcctcagtgctgagaggcagcgtgaaccatgcggggccccaccgtgtgggcactttctctgcatacgtccatccggtcgatgtatcacatcaattaggta

SEQ ID NO: 5896 - DNA, 1154 bp, Homo sapiens
caccgcagcccggggcgtgggcctggctggctgccccagtgagtacctgagctcagccccgaccccgggcctggtgcggctgtgcggccacgtgaccttgtcctgccctggcctttcaggtgcctgccagtgcaacccccatggctcttacggcggcacctgtgacccagccacaggccagtgctcctgccgcccaggtgtggggggcctcaggtgtgaccgctgtgagcctggcttctggaactttcgaggcatcgtcaccgatggccggagtggctgtacacgtgagtgacagggcccaggactggccaccggctatgccctcctacctgttcacccccatcactgtgcttctcctcacctgcccaggccctggcctgacccacacctggctgggggctgggcagagccagggttggggaccaggctctggaggaggtggggaagcccgtccaggtgcggacatcacgttcctccccgattttccccaaagcctgcagctgtgatccccaaggcgccgtgcgggatgactgtgagcagatgacggggctgtgctcgtgtaagcccggggtggctggacccaagtgtgggcagtgtccagacggccgtgccctgggccccgcgggctgtgaagctggtgagtgagggccagcgctaccctggggcttcatggggtggggtggggtcacccgagccacagaggtttcccatgcccgtgccccagacgcttctgcgcctgcgacctgtgcggagatgcgctgtgagttcggtgcgcggtgcgtggaggagtctggctcagcccactgtgtctgcccgatgctcacctgtccagaggccaacgctaccaaggtgaggggtgtgggatgtgaaggggagtggggaggaggcctcgccttgaacatccttgttctctgccccaggtctgtgggtcagatggagtcacatacggcaacgagtgtcagctgaagaccatcgcctgccgccagggcctgcaaatctctatccagagcctgggcccgtgccagggtgaggcctgacggccactgccccagaactgaccaggaaggcctgacgctgccctaaatccagccccacccgccctgagccacctgaccctgtcccaaccggtccccccgccaacctccctctccttg

SEQ ID NO: 5897 - DNA, 1066 bp, Homo sapiens
tgcccaaggcctacggcacaggctttgtgggctgcttgcgggacgtggtggtgggccggcacccgctgcacctgctggaggacgccgtcaccaagccagagctgcggccctgccccaccccatgagctggcaccagagccccgcgcccgctgtaattattttctatttttgtaaacttgttgctttttgatatgattttcttgcctgagtgttggccggagggactgctggcccggcctcccttccgtccaggcagccgtgctgcagacagacctagtgccgagggatggacaggcgaggtggcagcgtggagggctcggcgtggatggcagcctcaggacacacacccctgcctcaaggtgctgagcccccgccttgcactgcgcctgccccacggtgtccccgccgggaagcagccccggctcctgaatcaccctcgctccgtcaggcgggactcgtgtcccagagaggaaggggctgctgaggtctgatggggcccttcctccgggtgaccccacagggcctttccaagcccccatttgagctgctccttcctgtgtgtgctctgggccctgcctcggcctcctgcgccaatactgtgacttccaaacaatgttactgctgggcacagctctgcgttgctcccgtgctgcctgcgccagccccaggctgctgaggagcagaggccagaccagggccgatctgggtgtcctgaccctcagctggccctgcccagccaccctggacgtgaccgtatccctctgccacaccccaggccctgcgaggggctatcgagaggagctcactgtgggatggggttgacctctgccgcctgcctgggtatctgggcctggccatggctgtgttcttcatgtgttgattttatttgacccctggagtggtgggtctcatctttcccatctcgcctgagagcggctgagggctgcctcactgcaaatcctccccacagcgtcagtgaaagtcgtccttgtctcagaatgaccaggggccagccagtgtctgaccaaggtcaaggggcaggtgcagaggtggcagggatggctcc

SEQ ID NO: 5898 - DNA, 1197 bp, Homo sapiens
cccttgcggaggcgtcagggttctcacagcccctttttaacgggaccacaaggggaagctcatgctgggcccagcatggaggcaggtccaaggcccagcaggtgcaggtgggcggggcggcctgtgccacatggctggaatttaccaccttcctctgaagcgttttcactggtatcatgtgtaggcttgtttttctcccactgctgagtgagtcatcttgtttttatgtagaatcctgtgattcctggcgacagccagtgggcccggcccaggttagggatccttcagaactggggtccaggcctgtgtagcccctgtgccccgttacccctgctggccccgggcaggccttccggggcccccggcttctccctgccctgtgttttcatttgtgccgcctcccttcgggaaccttccagaacgtgcccacactcccgctgcagccaataggcaccttaaatagccacttcgtgcggctggccgcggagctcggagggggaaaggcgacgctgacctgtgccccgctcgcccgcagagctacatggaccccatgaacgagtacaacgcgctgaacgaggccaagcagatgatcgccgtcgccgacgagaaccagaaccaccacctggagcccgaggaggtgctcaagtacagcgagttcttcacgggcagcaagctggtggactacgcgcgcagcgtgcacgaggagttttgagcgcccggccgcgccccgcgccgccccccacgcaccaccggggcggcctcgcgggtgactccgggctccgtggctgtcccggaccccacctcttccctgccgcccgccaccggccgaccgaccgcggctgccccagttgatgagcggcgtgtcccctctgcagcgcgcaccccggcggggctttggctgtgacgcggtcggggcgcggggctgggctgtggccccgcggcgccgcctcctccctggtccctcgaaatcgtggcatctcacttctgagaacgaaatctcgcttcagtcactctgccgaaggcgctgacggcatcgcggccggaacctctgggcccggcccctcccagggccgccgctccgtgggaaaaaacagctcctccatttccttgaaaactgaacgattattaaaaatagattaaacttcgctggaaatgagtagccaggaagttcaggggagggtgccgggtccttcccgg

SEQ ID NO: 5899 - DNA, 1207 bp, Homo sapiens
tgcctgaggtggggagctggcggtcctgccgcatgcagagctcgcgtgggcttgccttcgtgggggccaggacgggaggcagggtggggggcaggctggaccaccaccatctgccctggcagcctggctgctccagctcctgacagcacctgtgtctgagcagccgtgttgggggcgctccctctctgcccctcagcgagagcctcggacctcccaaccccttgtgtctggtggggatccctcctgggatgaggaagaccccctcgggctctcggctgacccccacctcctgcacagctgtgcccaggcccccagggtggtccatgcggggcaaccccctgcggtgcacaggccccctgtctggagtagggatctaatttatttatttattgcctggccggtgactcgggggaggaggcgaccctgtcatctgtcccacctgctgctgccccttggagcagcctgcaccttctctcctcccatccggcaacagtctgaaagtacgtggaggacgggaccggaagacgagagagggctggacatcctgcccaccgtgtcccagccagggcagggagggaccatggcccgcagggtcaaggggccccgatgtgcacagctgccacagggagggaggtcttggggagatgggcagtcaggtggcccgtccttggtgagtgcacacactgcgcgcacacatcgcggccttcctggcttctctggcccccacgtgtctgtgctgtagatactgtatcaaagtcccagcgtttagatggttaacatagagctgcttctgtgtaaatgctgcttattttaaacactaaaaagcgtttaattttatgggacagatgtgtggcctgtgccccttctctccggctgggctgccttggaatgaggcacagggagctggtccagcctcccctaggccctgctgggagctgaccctgggactctgaccggagaccctgtgtgggcctggcggcgtgctggcgtcagatcctggtgggcagttttctgtccatggtgctggctccggggtcctggtggtcggtgctggccgtggtgctggaccccgcccccaccccacctgggctctgtccctggtactggtgacagtcatgatgctgtctacccactgggcaaagggcagagtaggaagctgggtgccacccctacctcggcgggctctgccctgggcatatgcctgtgt

SEQ ID NO: 5900 - DNA, 1100 bp, Homo sapiens
ggtctgtgtgttgggaacaggggatgtacgtagggcccctatgcggggagcacccacggcgtcagaggcaggggccaggtctccattctgcttcctgccattaacacgactaacagcctgcgctctcgggtggggcatgcggggaggggaaggggcctgccctgttctcattacttcctggtctgcagggtggggtgtcagcccagtttgtgcctaggatcctgatgaaaagtgtctgtagaagtgggagactaaatgtccaacccccctgctcacgccccagcctcacgggggtgcatcctgcagtgggccggggccctgctgtcacgcaccgtccagcttgcgccctggcgcaggctctgcccagaggctcccctgggggtgcagggccctgagtcccccgccttcagatgctggggctgaagcggggctgtctgtgctttgcagagctggaagaggcgccgctgacggtgaagagtgacatgagcgccgtcgtccgggtcatgcagctgccagactcgggactggagatccgcgaccgcatgtggctcaagatcaccatcgccaatgccgtcatcggtgagtggccgtccccgcgggcggatagtgccaggggcagggctgcttgcctcgaggctgcgggctgaccgctggtgccggccaggggcggacgtggtggactggctgtacacacacgtggagggcttcaaggagcggcgggaggcccggaagtacgccagcagcttgctgaagcacggcttcctgcggcacacggtcaacaagatcaccttctccgagcagtgctactacgtcttcggggatctctgcagcagtgagtgggggcttcgggcttcagggcgggggggaggggaacgccggaggcccctccgcggccctcacctaccctcccccgccagatctcgccaccctgaacctcaacagtggctccagtgggacttcggatcaggacacgctggccccgctgccccacccggctgccccctggcctctgggtcagggctacccctaccagtacccgggacccccaccctgcttcccgcctgcctaccaggacccgggctttagctatggcagcggca

SEQ ID NO: 5901 - DNA, 1163 bp, Homo sapiens
ggcgctccgacgcctccgtgcacgcccgcgcccccgcgcgccccgcatccgctcggcctgctgcctggaccccgtgggacccggcagagggcacgcgagtcgggagccttcgcggtggcgcagagcgaccgggcgccacctcagcgccgcgcacccggcgtccccggggtccctccgcccgacccgagcgccccggcgcccacgggcccacagccagcggcgcgcgtcgcatgcgccggatcataatggagcgcgggcccgcgcgcgggggcggggccggggcggggcggggcgagcgatgatcgcctgcgtctgcgcatcctcgccccgcccccgccgtgcgcccccgtgacgtcaacgccgcgcgctcgggcgcccccccgcggccacgctcaggaccccgggccgggcggtccctttaacggcgcggcccgaggggcgcaggcgggagggcggcggggctgagcgcgccctccgtgctgcgtccctcgcgccgctcccgggccgggggcggatgggcggccgcgggccgcggggcagcagtcgggacgcgcgcgggagccgggggcggcggccggggcctgggcggtcgggcgggggcgcccgggggcctcggagcgtcggggccgagagcggtgcgggccgggcggggcgcaggcgggcgggcgggtagcgccccgcgtccgagccccgggccgggccctgagcgcgcgggctccgcgccgccgccgcgccatggcggagaccaagattatctaccacatggacgaggaggagacgccgtacctggtcaagctgcccgtggcccccgagcgcgtcacgctggccgacttcaagaacgtgctcagcaaccggcccgtgcacgcctacaaattcttctttaagtccatggaccaggacttcgggtcagtcggccgcgaggcctgcgcgagcctggcgcgggctcgggggtcgcacctgcccgcgcggggacggggcgggggtcctgagccgttcgcgcccccggggacctgcgaccgcgacgcgcctccgctagatgcggcgcgggtggcggcctcggcccgtgtgcggcgcgcgcccacctgtccgtggagcggggcgatggcaggcggggttcccggcgtccctggccccagcttcccggccccgagtcctgccttggc

SEQ ID NO: 5902 - DNA, 1230 bp, Homo sapiens
gtcgccgacgagggcacctactcctgccacctgcaccaccattactgtggcctgcacgaacgccgcgtcttccacctgacggtcgccgaaccccacgcggagccgcccccccggggctctccgggcaacggctccagccacagcggcgccccaggcccaggtgaaggaggcctccctgggacccgggaaggcgggagcccaccccaccgggggttgctctgcgcccgctgtcccttgcccgaggcccgcggatcccagcgggggccgtggcccgggtcggggcgcaggtcttgctggtacctgacgccgccccgaccccgcgttccccgcagaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggtgaggctgccccggcaaagccagcggccccaggagactgaggtgggcgggagggtggtcctctgggctgggggacctgcggaaggggcggcactgcccccaatgtgagtctccttcccaggctacgaatactcggaccagaagtcgggaaagtcaaaggggtgagtgcccccctcccggccctcctggggaccagggcccccttcaccccacccagctgtaacctcctcccaccctcgccatccaggaaggatgttaacttggcggagttcgctgtggctgcaggggaccagatgctttacaggagtgaggacatccagctaggtgaggcagtgctgggacacgagggcacaggcgcggctcccagtcccgggctgggaagtgcatcctgggagcggggacctcagcctcctctcctcccacagattacaaaaacaacatcctgaaggagagggcggagctggcccacagccccctgcctgccaagtacatcgacctagacaaaggtgagcggcgggggcgacctcagcccatctcagagccctgcctgtccccattccacctcacctgggaccaacgatggcaggcaccagccaggcccggggcccctgccacctcaggctcagaaatccctggggagtcctgcgggggggtctgccctgtgtctcccactgtgatgagggtggaggacagccgccaacccgttggcgcccttggcttccagggttccggaaggagaact

SEQ ID NO: 5903 - DNA, 1129 bp, Homo sapiens
caagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcaggtgagtggccccctgcttggccctgggagggcaaagtgctgagaacacgtttctttgccacgaattacttggcggtccctctctctgcgtcttgcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagcctttcctgcgggtctggagctccatttgccgggtgtgaggtctctcaggattgaggctgctgccagtcccaggtgttgcagaagacccgggcagcagggtggcagattggccgtccctctctctagctggctcttggccgccgtccagagggtgctgggcctgtaggagccccagcctcgctgtgagcaaatgtgtgctgtgtgcagttcaggctaggtgctgtgggatcactgtgaacagatcccacagcccctccctgagcaccacattccctggggaggccgacccggatggcagaagtacagggggacaggactggggtttagggagcacccggaatgcacggggtgattcaggtgtatttcatgagtggagggtcggggagggcctcattgggaaggcaggaaaggttctggtaccactggcagtggtggatggtgcccgccaggctccgtggacgtgatcctccagtggccctccaagctttccggctacagggccagggtgttggccttcccaggc

SEQ ID NO: 5904 - DNA, 1101 bp, Homo sapiens
tctgtgcctttctgtcctgtatttactgtatttagaaaaagcagctagaatatttctccattaactcttgagattcacaggactgtctagctctgagtcctagcaatagactccttagaggagtagtacgtttatctagattttctctagataatgcaggcggaagacctgggttcccgggtggggcattgcagttcttcctgtgtttggcttccaggaattacatgaacgacagccttcgcaccgacgtcttcgtgcggttccagccagagagcatcgcctgtgcctgcatttatcttgctgcccggacgctggaggtcagtgtgttgctactatggagagattctagtctgatttttttttctccagcctccagtaaactttactgtgttattcttcaaattactctaatctgggccaaagcattttcgtgaccaacaggctgttttttaattgtcctgagtcttgctggccgtgaagttgaggaaagtgtaatgatgatagtgtttgtttttacagatccctttgcccaatcgtccccattggtttcttttgtttggagcaactgaagaagaaattcaggaaatctgcttaaagatcttgcagctttatgctcggaaaaaggttcttcggcattttttcatgtaacgtatgcgtttgtgtttggccagaaacacctggttctgaacggacaccttctggcttttgcaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctgggtgagtctgttagagtgcaggaatccactccccacaaaggcaaagactggtgactctcccccgcctccattctggggtatgtgctccttccagacattttttttttttttttttttgagacagggtctctgtcacccaggctggagtatggtggtgtgatcgcagctcactgcagcttccaactcctggattcaagtgatcctcccacctcagctttctgcatagctaggactacaggcacatgccac

SEQ ID NO: 5905 - DNA, 1117 bp, Homo sapiens
tgctgtccagggggggtctgtggccctaagattggccggcctctccatgcatctggccagcgtccccttggagacaccttcaccctcaagcgctgcagaagcatgaggtgagggcctgcagcgctctgtaccgtttagggtgttggaccagccgggagcctggcaggcctggcccagcggccagggtgagtgttctcagaccccgggcagctggtggttctccagggccaggtaccccttttgtgtgtgcgacctctgactaggtccctgtgggaatggggcagatggcggccatcaccactgggtcccagggcagaagcttagataccggccttgagcagcccgaccttccaccgctgcctggatcccaagcctcagccgacccaggggaccttggtggcaacggtgtgactgacagcaccacccctagcctttgcatgcccaggggtcgagagccagtatccggcccagacaatgccacccgccatggaagaaaagctgaccctgcccacctgctgcagacccgggccccgggccgaggttgctttctgtgacgaccgcctggtgacgctggacaccaggagggttatggcactgccctcccctcctggagcccctggcactgaccacctggacttgacctgactcctggtcactggccaaacacccatcctcaccccagccaccccgggccctggctggtgccgtgtgacacctgtagcccacctgtgtgtctttgctccgcccacccctgcgtggcgccggtcaggcgcaaacctggcgccagtgtctaaatgtccatcattctcagaccaacagagctgtctgtgtgttatttgggaggtgggagggaaggaaaaggtggattccccttctccccacatcccctgggacccttgggtatgggctggtgtctggccccaaaccctctcctggcctgggtggcattggcccaggcagcgtgtgcggcacgctgccttgcagttcctagcaggacaggcagggtgccccctgtttgtctctgcaccttcttgtcctgggccagctgtgttggcgggggaaggggaagacggtacctgccgtgcttagaaatagcccattcccacggcgacacact

SEQ ID NO: 5906 - DNA, 2287 bp, Homo sapiens
gctgaagtcccagaggggaggggccgctgcctgaggcctggtctgccaccctccgcaggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggaggtgagccgccccgccgtggagccctgtgtgccctgccctcccagccctccgccccctcagccccttcctccccaagcgtccagcccgacccagccacagctccatgacccgccacagtttatcggacagacgggcaccgtgcatcgtatcacggaccgcggggacgtgcgcgtgcagttcaaccacgagacgcgctggaccttccaccccggggcgctcaccaaggtgccgggggggctgggctgcgcctcatctgcttgcttctgtaaccccttccacgtacccccttggccttggggggtcaggcaggactagggtgccagctgcacccacgagtccccagccctgaaggaaggggagggactggtgggtggaggtgggtggggtcaaggagaagagggggttgggtgtgaaggaacccagaggagggtatgtctctgggagctggaatgggcaggttagggcctccctctgttccaggacaccaggaaggcaggacagcttcgtgggcgggagggaggcggctgggctaagatgctcctggttagtgctgtatgggggccgatgggggtggctggttaggacagggaggtggatgcttggcctagagtggtgggggaggtagtgagggctgcctgggaagcaggatggcagggagggggctggaggtggtggcggtggcagcttggatggccctgggaggggcaggcccggggcaaagcgtcagagctcagctctggatctggggtcctggataccaggcacctttgaggaggcgccgaagggagtcatgagacgggcttgtagagtgagttccctgcatatgagggctcaggtggggcagagtgggcccgtcctgcaccccatggtcctggggccccacccccacgctggctcacgggccctggccatgttgcctgctgctggtcagcgtacagcttcccagggccagccacctcggcttcacacctgcccagagctggcttctgtctgcctggacactcctcccatggctctggggctagggacacccagggctgccttggacacctggggctctcgtccagccagagcctctggcagtgcctggggtcggggtcggggccggggccgagtcaggcctgcctgtctcgtggagctcagcaggttgccctcctgttgcatgagcctgggcagccacacacagctggggggcccctcacgcccctctttgtcgctcagcaccactccttctgggtgggcgacgtggtccgggtcatcggcgaccttgacacagtgaagcggctgcaggctgggcatggcgagtggacggacgacatggcccctgtgagtccccctgccacccccgccgctagcgccgctgccccccacacctgcagcctgctgtgaccccctcccctccccgcaggccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagtgcggcacagctcaggcggccagtgggaggtggggctgcccctggccaccactaacctcagccctgcccccaggctcactgagcgtggccctggacaagcttcgggcccagaagagtgacccagagcacccgggaaggctggtggtggaggtggcgctgggtaacgcagcccgggctctggacctgctgcggaggcgcccagagcaggcaagctcctgaccccgtcctcccatactggccagtctgagagtgaggggcagagggccagggactcacctgctggcactcttggcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggtgaggcctgggaggggcccggccggcggggctgagcctgtgcgtcctggggtgaggcctgggaggggcc

SEQ ID NO: 5907 - DNA, 1164 bp, Homo sapiens
cccaattccctgtataacagcattaaaataatctgcctgcctggaaagatgagaacactgttgcacaacccaaaatgtgtctttaatttgtgaaaaattaccatggtgagtcagacagtcattttaaacagctgaacagagactatcatcagcaaatagagctcagctttgtagctgcctttaaaatccttgtcccaaatccggtgagctctgcttgctgccgccgcgctcctgggtgatcactcagacgggtcagtgggaataacaggccaacaagacagctttttacatgtgtccaaaggatggcctttcgaaggcctggaagtatttcactgttggaagaagtaaacaagaatgacattccagatggaaatagaattctctctcttgcctttgaccaacatggtactaaggggtttcttctttcccaatgtatgtacgtgccctgctgggggccttactttatagaatgagagcatccgagcttccctaatgaatctggctagttctgtgtctggctgaggatacaggagtgggacatccactctcggatccctcagagcacagaaaccttcagctttgctgtctctgaagtatttcctccagtttccctgcgggcccctatgtttgagtttgatggctgctggatcctcactcaacgaaaactcggttggaaactgttccgcctggcagtccttttttgttgttttccatctcatttcccttccatctgaaagtggcattcagctgacttgctcatttagactgttcacggagtctgaatctgccaacgtggtgttggaggctccaccttgaaaagggccacagtcagggcaactttccccatacaggaaaacttgaaaattacatcaacagtctacgtcacagccaaattatatttcctttataccaaacaaaactatggagaactaaaagtacatcacacaaaacgtttatagtgttttgcatgtgacctatttcagtatttatataactagattagtgctttctagcaaacggttctgttaattagcgagtcactgttgattctgctgtggtggtaagttgataccgtgtaactaatcccgtggatgcctcctcgttatttttgtccaaacgaagcagccgtggtagtagctgtctatgattcttgctcagcaaagt

SEQ ID NO: 5908 - DNA, 2291 bp, Homo sapiens
ttaaactctgtttaaaacagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttcctttttaaaatgtattcctttgtgttcaacagttaatcaaaaccagagagtctagggcagcctctctgatgttgtcaatgatgtaaattcagtccctggtttttaattttctgtctgatgtcacagatcattgttgcacacaaacgtggcatagaaaagaacatgttcagaagccatggggccaagcacatgcggggacggtctcaaatgcgtgatcagagaatccttcacctttgctgaaaagtgagctcagatccagcaccatgttcctcctgacccatcctgtctatcttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaattttaaaaattttgattgtttgccatattgggtgggtttactcttagaatcgcatgctgtagaaatgctcaaaagtgcatatgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaaaaagttctgttgcaaacgactgctgttggattctgagggtggggagggagagagagggagggagagggagtgaagagcctgccctcctatatggattcttcagggccctccacatctgaggtggctcattcccatcacacacagattgtcctggtgttcatttcaaggccagtgttcagcagcagcgtttggaaagcaggttctgtgggaccccccgccccgccccccgcactccttcatagcagcagtagtggcttctccatcctgttttctgcaacattctatacaaaactgtgctgtgaccttgcggtaggcctggatctggcaaagagaatacaaatgaaaccccttctttctctttccgtccaacaactctgtagagctctctgcacccttacccctttccaccttttgtatttaattttaaagtcagtgtactgcaaggaagctggatgcaagatagatactatattaaactgtactgttatttaagatgtaataaagcagtttgacatgagggactttggtgtggtgattatttacgggtccacttccagtttgcaacgcgcccgcttccctaagctgtccctgttgctgtgaggtctgacgggcctgctcatgccaggcggtgccatggccgccaccacgtcacagaatccatgagtggcgcattggctcctcggaggggttcctgggaagctccacctcacaggccagcagagcagggaggtccacctgccatcgcccagacccctccccaggcataggccttgcccacagcaccgtgggagtctccacaggcggctgccttgcctttctcctctgccatttccctcccttagaatgtctgaggatgttactccagagactagctttccttgggactgaactgagtgttcctcttggtctgaatataaagaactgcatctagtaagaaaaaaatgagcactggccatggtagtgtggaaaaccatggctgtgtgtgtcccaaatagccgctcctaggctccagaaccatccactt

SEQ ID NO: 5909 - DNA, 1098 bp, Homo sapiens
ggctcagcaggtgtgtgtacagctggtgctccaagtgatggtcgtgcagaagcaggtgtcatgcaggcccacacatagcctgacataggaaccagctattaaattgtggtgtgggacatctgtgtggtgtcataagaagagttgcgagatctcaaagaactcagagacctaggaggagatggtcctggatggacagggagaggaggaaggaagcaggaagggaacagcaagtgcttcaaggctggccatgttcgtgtgcgtgcattggagggcagggcacacaggttcctgatgaccagccagactgagacttggtaagaggtacggaaggggttcagtgcagaatgccacagtggaagccactggagaactgtgggaagggctgggaagaggtaggcacagtgggcgagccaacagccttgacaaggatgggtgatgaggagaatcgtttaatcacagatgttgatttacagaaatgtttttattttcaagatcacaaacaacatcgacccagtgggaagaatccaaatgcgcacgaggaggacactgcgggggcacctggccaagatctacgccatgcactggggcacagactccaggtaggcgtgggcatgagcaggatgctgcttgttacattcaggggctgctctgttgtcctaggggaaaagtacctgaacccatttgctgtgctgtgcagtgaagaaattaggaagttgaatcagaactctgggcacgcaaggtgcagcgttcacaggtgcatattccctgtccagttttccacttacctgggctgaaagaacactgccatttcttcactgtctgaatcacattaatacaagttctgatttttctttctcccttctcctgtctctttcagtttctagacctctgtcttcccagttctactgcatcctacttatgtgaacttggggaagttacctctctgtgcctgtttctcagggctggttggccctcgccctcttgtgatgtcagtgccctggctcaggaaatcacagaacctgccccgaggatcctgagggattaagtgtattgagccttagaacagcattgtgctgtgtgtgctttgctgcggcagac

SEQ ID NO: 5910 - DNA, 1226 bp, Homo sapiens
tatgcaaagccaataaataatcataattatattttatttacctggccctacttagccattgtataagttctgatgaatgctgaagaaaagttctctggtttgtaatgagaccatagttctcagactttccttttttttttttttgagacggagtattgctgtgaagcccgggctggagtgcactggcgccatctcggctcactgcaagctctgcctcccaggttcacgccattctcctgcctcagcctcccaagtagctgggactacaggcgcctgccaccatgcctggctaatttttttgtatttttagtagagaaggggtttgaccgtgttagccaggatggtctcgatctcctgacctcgtgatctgcccgcctcggcctcccaaagtgctgggattacaggcttgagccaccacgcccaccttaaactttcaatttacttttctcacctgcttcattaaattatccaacagttgtttattgattgtgcttgtctttctgtttcagatctcacattcttgaaggtggcattgaagagcactaagatcggaagatgagtgagcttgaccagttacggcaggaggccgagcaacttaagaaccagattcgagtatgtagttgtgtgtgcttggttttattaatcatttgagtttcaggttagatgttacttgttttaggaaaaatggtttacaggatgacttgttctatgttttatatgaaattgaatcttagttggcccaggatgtactaattatagatctagatacttagcctagtacattgtttttgggattttgctttctgtatacaatttgttatttgaatatacaccagatgtctccgtagaatttataagtgtcttttgcattctttatcataaccttgaaaatttgtgataccctgggccactgatcagactgtgatatctacctccctcccctgaatattgggactattgacagcagaaaacttgcttaaaagtaagagtattaacaacaataaaaaaagtatttcaggtatatctgatgtattttttcctaattttgaaagatcttccctagcggtgatgattggaatctacagcttctgatagactgctagatggagcagatatatctaaatccaagatagaggccgggtgtggggggctcatgcctggaatcccagcagtttgggaggccaaggcgggtggatcacctgaggtcgggagttcgagaccagcca

SEQ ID NO: 5911 - DNA, 2955 bp, Homo sapiens
tttcagatcgaagacctgcaggtgaagctgcagcacgcggaggcggaccgggagcagctgcgggccgacctgctgcgggagcgcgaggcccgggagcacctggagaaggtggtgaaggagctgcaggaacagctgtggccgcgggcccgccccgaggctgcgggcagcgagggcgctgcggagctggagccgtagattccgtgcctgccgccgcagcgccgccgacaacgcgggtgcaggggggcgcggctgggcggtgcagctccgcccggctccgcccctgcagcccacacagcacaacgtcttaccgtgcctattaccaagcgagtgtttgtaaccatgtagttttggaacccactgcaaaattttctactggccaagttcaagtgagtaagccgcgtcccccaactacagctggagacggggccagctcggcggcctgctggtcctctgcttgctggaacattctaacatttacacttttgttataagctatttaaaaccagtaaggagacttgaaattcagaaaatcaacacatttttaaatgactaacttctaaaagccccaacacatgacgccatctgaagacccgcaacggagtgggggtggcggccgccccaccctccccacccggggaagccatcacagctcatctgcccgcggctgcgtgaggacagcaggggtttttcttcagagtctattttttcagcgacaaggacccaggtcttcctgctgctgccagggagagcagggacagtgccgcgtgcgagatgagctcgaacactgcccgccttactgccgcctaccccgcccgccacgccgccgtcgatgccagcgctgtccccacgggtaccaggaagtgcagagccgcacaggagctgccccggagctgaggggacggtcttcggctcctctgcaccccgtgattctgcccacgctcctccaccacgaggcactgacctgcgtcgggtggtgaccgtggctggcggtcacgccctcagcccctccgggcacacgtgccgcctgaccgggcgacccttttcagttcggcaaacgtcgctcccttcattttgggactgaggctgcagcattggaacaaaagagcattatttcaatttttctttctttttttttgttcgttcatttaaacgtatatttagaactgcactttgtccacaaccttcccttctctttctattccccagtgaactgaggtttttaccgatttatagagcagtcaaatccgaagtgctcgagtgcttagaaaccccctctggtgcttggttgaacaagggaatcacaagaaaacgaaaatgcaaaaactgaacttcgggggtcgttctgtgccttccagcatcttgtacagcaaatcctgactcgtgtctttttacccccaagatatctgtcttcagtagcgactgaatctgccactctcagaataagttccttgcatttattccaaataatctcgtttactctcacctgtttatgcaaattgtataaggtttcttatgcccaagcttgaaaaatgatttcccagtagacaagaggcggctacctatcctacagttacggtatttatttacataagaagatcttacaggagttctttgcttgaatccgttctaacacccgcggcagctgcacgcgctcacagaaggtggaggttacttgcccaggtacagacgacctcggggcagtgacgagcaaagaccagagactgctgagccctcgcatctgggtggcggaattgcctgcggggttttgcccttggtttactgaggggggtcttggttgctgctgaagccccccaccccttctaaagtgcaatgcaaaagggacatcatgtatatgcagcgtttgtttggaattttctttgcttttgttttctttgcggttgttctgtgtgcatggattccacacctctgccgtaggtagatccgtcagcgggcattattaccgtgtcttgtaaagggtcggttttgttatgcaacatgcagaatgctgtttttagccttgttttaccagagttgttttttttttcagttatttcttcaagggaaactaaatgatttagttggagcaaagctttaagtgtgttggcgtgcttctgtgtggctgtcctgtgtcgccaggtcgaagatcacagtgaggtagaggccctgccccatccccagggccgccaggcttgctccgtttgctttgagtttttagaccccagagggagatgagcttttccaagctgtgtctgggccagagcctctccttgcccttgctccatcccgacggtcaccgttgggtccacgcctccaccgccccatcttgccccaaacggaaagcgctgtatctgcagtggcagcccttccccacttcggctctgggagggtccagccagtgtcacctgggcccaccctttcctgcagctgccaggcccgtgcggtcagtgggacccggacgtgggcaggcgagctcgggaccctcccaggcagttcccacagctcttgcctcggctcaccagggtcacttccactgtcaggggcctgagggggcagctgtggctgcagggctgctctggactgaggggtcccaggccccgaggggtgcacgcctggctccccttggcacaggtgcgagtccgtttcttttcagcagaagggggaagaggtgtccgctgtgtgggctgctgactcctctgtgtgtgaggcccttcatctaagtgattgtgtattcagtttaattctcattatatttctatactgaaagaagatttttaacgaagggaaaaacaacagcaataacattcatatctctggagcagctaactcatacacgtaatgtctgcttttcgtacagaactagccaatgtaaaaacagttcacctgtaaatactttttcctttttcaccgttgtattatacatgtatatgctgggtcctttttcagaaactcttttct

SEQ ID NO: 5912 - DNA, 1872 bp, Homo sapiens
ccccggcgagtgcagtgtcccggtggctcctcttagggtgcccagtgccccgcgccagcctgcccgaggaggagggtgttagggggaagttagccgagactgcggactgtgcccttgacggtgtggccttcgtgctgcgggcctcactctgtgcccggggtgttggctgcagagagggccctgggccacctcacatcccccttgcccttcctccacgggaggctcacgaagcactgggattgatggggtttcaaacctaggcctcgtgggctgtggaaggtcttgctgtgttgatgtgggcgcaggaagccactggggctccgattccacttgtctgatgtatagaaaagatgggggacctttggccgctcagatttggggacagtgtgactgactggagagcggttgtgcagtaactgagtctgtgtttctctccccagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgagggagtcaaattttctttttaaaaaggagcttcaatgatttgtaactgaaatatcaggttctagaagaaactggcgcttaaaccaaatcgcatggatttctttttcagtgacgttcaagtgtttctcacggatggaattctagtcagctgcaggcgggaagccaggcgggtggagcccatgggagcaagggcgagtggccggtccccgctgtgccaggtgggcaggcaggagcaaggcctgcgagggaggaacgggccgctccccgccagccgccttccccagcagccgcaggtggtgccagccactccacagagcccgagggatgatctagcctgattcctgcgtgtccgaaagaacttaacgttttaaaggtgattgtcaagtaactgtgtggggttctaatgccagtttcctaattccatctcactggagatgtttaaagttggcctctatcctaatgactcaaaacttggttcttaactaccatgattgcttttgagggcccggaattataaatatatattatattttaattgtttgagattattttgacacatttctttgatacgtagagtgttttgtttttaatttaaatctgtcctcatgcaaccctccatgaggggcagcgaagctggcagggagcagactggctttgtaggttcagcactcggccccccactgcgggagaggcggaacccacttgcatgtcagcgtttttgattcgagaaaagaaatactctcaacgttttaccaagtgattttacctccacctttactaaagtctttacctaaaacatggcagtcgctggacacaggaaagcccaccttttgtttggccttttcgaaaggtgacccatattgcacagcagaacatcacagctgtggtcccagatgagacactgacatgcgagtgaaggcctctcctcctgggccccgggctgcgcaggctcctcactctgggcggtgtttcctgtctcagaattgacacggtgaatgcttagtgtctggattttcttgtaccagtgtttacatatctgacatcgagctcctctaagaggccacgttcaagcttgtgtgtccctgacccaagatagccagtgctgctcccaggtggtacttctggtaccgtgttgagacacttgggattctcagactgtggacaggagtgtttgtcatttttcatactgttttcttaataagcgctcaggcctaaggtgtgacaggaagtcgcacgcgcttggccagagc

SEQ ID NO: 5913 - DNA, 1819 bp, Homo sapiens
atgctgccctgctgctgctggaaggatggggatctttcacctttagggatctcagcacaattagaatcgtaaagtgaattctatctatttaattggatattggactctgctcatataagctacagacaaaagccaaaagactctcgctgtccctgtgctgctggtatttcattctctgtaacttcagttctggtgttttccttgagtatctacttggcttctcgtggtttttcccaccccagctgccccagcacgcgggacccatagcacaccccttagcgcttgcctaggttgctgaaaacagggaggcacctggtatctcgagtgcctgcagttgcaagtatgtttacacctggtgtccaattttgtattttaaaatgtaatccatttttacttcagctcatccaaaagcagccagcagaccggttgactgagaccggtctgtggctgtgggccccttggtgacccgctgctcttttggaaatgggtgacctgaagtgacactttttccacaattaacccaagttgtgttaatacttcaggtctgtttcccagacccagaaagctttacagaaaatcattgtaagacaatttattaatttgagaaagtcaccttgacagttctttgcacacaagttttacacctctctggattcgaagtttgtattgtattcatagttaaagggaatcgggtactttgcttgttgaataatgcactttaaaacaaggaaccgtatcaggccagcatggtggctcatgcctgtaatcccagcattttgggaggctcaggcagacaaatcgctctagctcagaagttgcagagcagcctgggcaacatggtgaaacccgtctctaccaaacagacaaaaagcagccaggcgtggtggcacatctgtggtcccagctacttgagaggctgagccaggaggatcgcttgagcccaggaggcggaggttgcagtgagctgagatggcaccacttattgcactccagcccgggcgacagagcgagactccatctaccagatccttatgacgcagctgatgcctgccttggttcctaccactctggtgtagacagaggactttgtccaagtctcacactaaacatgcccgggcttcgatgtgcctggaggatttccccacagggacccacgcacctccctgtatctgcgcagcttgctcgtgtggctggaagcgctgtcgataagcttcacgcactggcttgccagttcttcagctctaggacttgtagctttaagcaaacggtgtggcatgggttgagtgtggccacctgcaggatgtgcagggctgcctcagaagctggctggggactctagcctctgtgttcataaagacattaagaagtggatggatgttgttccttttttgaagttgtcattaaagtaggtgcaacaaccaagaaagtgtctcttccctctttgaaagcctgccccatctctgccggctctgcacctgtgggcctgttctgcctgtaccatgcggactgcctgtcacagcagtgccgagtatggttctctgcagaaagagatcacgatatgcaacaacctaggtttgcaaccctgatccccccacctgtggtgccaaccaagtctggctgcctgccgagcaccagctggagagattgatggaatggttctgggtggttctaggcacttcctgcaaatagccagggtggagacccacgcacactggttccgaaaccagagtagacatgagacttcctgaggaactgactcagctggtcggggacctgcagctcccatcccgaggggactggacctgggggtggcgctgct

SEQ ID NO: 5914 - DNA, 1050 bp, Homo sapiens
ctccagcccctccccggctctacgcaggagaggccactctcctctatggcacgcgcggcggcactctagcagccaggtggcttctctatgggcttttccggcacaggtcggaagtggcgcgcgctgccccggaagcaccctggtgggtgggtgcctgccagcagctgaggcgccatggcggcggcagcggtgtcagagtcttggccggagctggagctggctgagcgcgagcggcggcgggagctgctgctgacggggcccgggctggaggagcgagtgcgggcggcgggtgggcagctgccgccgcggcttttcaccctgccgctgctgcactacttggaagtgagcggctgcgggagcttgcgcgcgccggggcctggcctggcgcagggcctgccgcagctgcacagcctcgtgctgcggcgcaacgcgctggggcccggcctgagccccgagctcgggccgctgcctgcccttcgggtgctcgacctgtcgggcaacgcgctggaggcgctgccgccgggccaaggcctgggccccgccgagccgccgggccttccgcagctgcagagcctcaacctcagcggcaaccggctgcgcgagctgccagccgacctggcgcgctgcgccccgcgcctgcagagcctcaacctcaccggcaattgcctagactcctttcccgccgagctctttcgccccggcgcgctgcccctgctcagtgaactggcggctgctgacaactgcctccgagaactcagccccgacatcgcccacctggcctcgctcaaggtcagcgggggctgcccgggcggggcgggatggggccttggagtagccctggagaaggaacccctctcggggccgagcagttcctagtgacgccccctggggcactgggcccagggaattcctacaaggctgaaaggagccagctgcggggggcatcacccctgggaagcagatgccgccttccaactcccccttctcctggccacaccaacatactaggtggcctctgaactcccccgcattctgttaactggactttta

SEQ ID NO: 5915 - DNA, 1255 bp, Homo sapiens
cacacgggctggggctcagctccttggagagggcctgcctgggactgagggggccagggctgggtcaggattcaccagcttgtgttgcagacactggagcgattgcctggccctccctaagccctatatgcctcactcataatgaggctgtctctgaaccccggagggcgggacctacaagtccttcctcttggcgcattcccacactccagtctggatccaggtctgcaaggccagcccgaccctgacactgcacgtgggcgtagtggggagcaccctggagtggagatgattgtcagcgggctcacatgttatggttcatccacatgcgtgttgtgtgctctgcggtgcctcctggcaaagggtcctggctcgggtcagaagctcactcccgtgccctcgtccccaaacaagcagtggcaagcactggggttggccctcgttgggagcagtgcccaccttccttggcccacagcagataggtcccgagcagcaggactggaggcctgtggcggtcagggcaggggtctgtgtctccaccccaagggctgatggtccctcccctgtgcgccttcctctcaggcaggcttgctctgtcccttcctctctgcttccctcccaggcctcgccagggctcccttctcctctgcctggttagactcgggcacccaggaaagcctggccagggctcctttgggcctgggccccctgcactgcctggtccagaaggggtggtgctgtccgtggccagcaccccggggcccgggaggggtgggctactagagtcagagcgggtttggggctgaccagtttgggagaggagaaaagatctgagaatgtccttcttggtttgtcagtcatctctgccaaaagtggtgatggtggtgtccgtatgtttggcgtctttgggctgggtttggtttttgctgctggtagaatcagggtcctcgggcatgaacgcgagcccaaagtgccagtctgcgattggaaatttccagccactttaagccagtgctgagtagggcttctgcagagccatgtttgagccaaggtcttggaaggcattgccccatgggctcaggtgactcggggtggagtgagcacgtctgcagggccctctcatacacgcctgaggcagaagcagcgtcccccgtgaaagccaccttccgaagctcctgcgttttttgcaaacttggcttcccccaggggcaggctggactttccctgccccctatgattgaagtcctcctgcttt

SEQ ID NO: 5916 - DNA, 1180 bp, Homo sapiens
tgacatctccaaggaagaccagatcaagaagctgcatgacctgctggggccgcacatgctcaggcggctcaaggctgacgtgttcaagaacatgccggccaagaccgagctcattgtccgggtggagctgagccagatgcagaagtgagtgatgggctgaccccggagcagcctgtgctcgccctttcccctgggctggtctcctgggtcgattcccaggtgggcggagggctcttcagcctcactgaggtctcggctaatgctttgcatacactttcttcgtggggcctcttctcaggttttagtgaccagagtttgggtcgcttgagtgctggcagtgtcccccagtcacttgcagggggactccaggccggtggcttcacctcttgggggtcccttgggtctctctgtaaatgggtgcttggccaccagcttccagccccactgcagagcagagagagccctcatggaggcgggtctgacccagcctgcctttcctcgtgccctgctgcaggaagtactacaagttcatcctcacacggaactttgaggcactgaactccaaggggggcgggaaccaagtatcgctgctcaacatcatgatggacctgaaaaagtgctgcaaccacccctacctcttccctgtggctgccgtggtaggtttccccggccatcatggcagcttctccatgaccgccatggtaggtgcctgtggccgccatggtaggtccctgtggccgctgtgataggttctcctggccattgtggcgatttctgtggctgtcatggtaggtttccctggccatcatggaaggttgcctgtggccactctggtaggtgctggggaacttaccgtggaacccgctgctgtggtagggctggtgcggctgtgagccctgcctgggaacggggggcctggagccagggccgtgggacccacggtctaccccgcactgtggggcctggcctggctcgggtgtgggtctcatgttcagtgggcagacaggccatcaccccattgctcagcacttgtctgttccctgcggcccctttggtgcagagtcagagaggagaggggagcccaccaatgccccacctcctgctgtgtctgcaggaggcccctgtcttgcccaatggctcctacgatggaagctccctggtcaagtcttcagggaagctc

SEQ ID NO: 5917 - DNA, 1083 bp, Homo sapiens
agactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgtacgaggctttgttttttttaaggactggcatgtgaagaaaagctttgtcctcacgaattagttgctgtaccaacagttacgttggtctttattaggcttagaagaaaagatgtcctttatttccacttttcttcccttagttgtgctgttttgccgcagtgagattcaggggttggctgtcactgaactctgtgtagaatttctccagatccagagtctggggatcaactttgccagcaaatgccgttttctgatggggaataggtagtgtcaacttgaattccatcacaaccatgacaccagctgcgcccaaagcacactgtagaccagtttcctttgttttgactcacacctcacttgcctgatcgaaaatagttgaggcacaggggctgactggggtcgtggagagtttcaagcc

SEQ ID NO: 5918 - DNA, 1392 bp, Homo sapiens
tggattcaagggatcctcatgcctcagcctcccgagtagctgggattacaggcgtgcaccaccacgcccagctaatttttttatttttagtagagatggggtttcaccatgttgttcaggctggtctcgaactcctgacctcaagtgatctgcctgccttggcctcccaaagcgctgggattacaggcctgagccaccatgctgaggctattctaattgttactgccgatgtcgatggtacgtggctgataactcagagccttggctgggtgtatttgccttacctttgccatttttgaggcttgggaaaacaccttgaattgtaatgattttgagtgctgggttttataaatgttaaaatgttttagaatgcaagcaccaactgtctagtggagttcttgtgtcctttctctgcaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgcca

SEQ ID NO: 5919 - DNA, 2088 bp, Homo sapiens
gctggcgggtgcctgtaatcccagctactcaggaggctgagacaggagaatcctttgaacccaggaggcggaggttgcagtgagttgagatcgggcctttgcacttcagtctgggcaacagggcgagactccatctcaaaaaacaacaacaacaacaaaaaaaaccggacggacttgcccatcggccctcacgacacgcgtgcagtgggactctagccaaggcggtggccgagccatcattacaatttttctggagtaaaggatccacggtgggacatcaactggcacttactctgtttaggaacttgagttgaatcatttctaaacttgtcctttagaccacgcctagggcagcaaattccacttcctagaactgcaaaccgggagaggatgtagttagattctggcatcctgccccggctctttgagggaaaagttctttcccctgctctaagtagggcgggcccagcctccattcccattgggagccatgaagttgtcttgttgataggtctagggcagctgttggcagctgctggccttgtggatggtaagctgactgtgttggcatttaatgccatcctccatctgccagaggcccaggaagcccaccttcacaccaggcccaccagctggaaggagcccaggaggcaggtcttagggtttcatggtgaaatgctgtctgacaccagggaaaacttgacgtactctgctttggagaggaattccaggggtagggatggtgggagaacattcccaccctgtttataatcccagagcagaagtcagcaattacttagggataaaagatgaactccattttttttattttcttaagacagtcttgctctgtggcccaggctggaggctggagtgcagtggcaccatttcggctcaccgcaacctctgcctcccgggttcaagcgattctcctgcctcagcctcctgagtagctgggattacaggcttgggccaccatgcccagctaatttttttgtatttttagtagagacggggtttcaccatgatggccaggctggtctcgaactcctgacctcaagtgatccacgcgcctcggcctcccaaagtgctgggattacaggcgtgagccaccacgcccagccaagatgaactccttaaggacaggatttggtaagtgattgacttctttttagttccatgatcttgagattatttttagctttataaatttagcagtggcagggcccgtggagaatcaggttaatgaggtaaaggctttctgggtatttgctgccaaggccacatcaccaattttctcgatttaaaaaactgtcaagagatttatttttccattgcaggttttaaagtggagattctgaagtggaaaataggtactgtcagaacaaagctacctggaaacagcatagagtgaagcctttcgtgagggcttgcaggccgctgctgagtggcagtttacagaagaggtcgcggggtgagcctcttagcaggacagaaaacaaggcagcagcgcacctgccaccccttcacgagctgctccttgagcctaaaaagtaggctttattcatcccttctgttcatttaccaacctgggggattgatacgaccggggaaaatgttcctaaaccaggaagctgcgttagccgatcaggctttgtaagatctcgccaacagctagctgcttaggagtacccccacgatacgcacagcacaccactgtcccttcactgcactttcttcctgccttaggtagttgggcttgcccaccctagtttgcttttgtagtggtttggcaaggttagaaggcctcggcctctctgtcatgctgggaagtgcctactctctgggccactgctgcagaggccgtggcacttgtcatgggtttggaagacccagccatctgcagcagaggcagcctatcccattgcaaggagaggaactgaacggagtaattattctactcttctttttacataaatgtttatttaaatattctaaattggattttctttcacagatactgattattctttccagttcttaaataaaactgcacttgatttcactcaaccacagtgtgattgtctg

SEQ ID NO: 5920 - DNA, 2214 bp, Homo sapiens
ctcgctgggctccgcgtcctaggaccgccggcgcctccccacggacgccaggcaggccaggccgctctccggggccgcagcaccaaagacgcccgcctccgccccgcgcgcagacatgcgccacccctcccaggggtgagggggcgttggcctcagcgtttgtcttccggctcctcccagctggccttgtcccaggggcgacggctgccccggacgactgcgctgggcaccgcatgtcccgggccgagtgaggtcgggcctggggagctgagtgacatcccaagcttgggcttgggtagtgagtgacatgtgcacacgtccagctgcgccatcaccagccctgcgcaacaggacgtcgggagcagggaacctgagacagggccactgcgggatcggacaaagccccgctttggagaggctgagctggagccattggcctccccaggggctttccacccacactgcaccataaccgccacacccttcggggggggggagggtacagagggtctctaagcacaggggtgttcagagcccgaacaagctttgatcaggtttccctgcttccgacctgtcctgcctcagtttccccatctgtgatgagcaggtgaccacgttaactctcagggctgtttgaagtctcttggttgtaggccctcgccactgagtggcccaggtgtgagaggtagtctagagccctctgcggcctttgtggaggtccgttttcagcatgtggcctggtgtggctccctaggcctgaggcctcccactctcagtgccccctgcccccttgggaacccacactccaccccagctaagcacaacactgtggaccaccaccaatggcacctgagccaccttgaccaccattagtgtccccaccctcattactctgccgtcgttgcctgtccccaccacatcatctccctccatggctcccaccatgacgctggcaggtgcaagcggagagcacgagggcagcagggcctggccttccgtgtccctgcgtcatccccagcctcactccccacccgtgcaggcctggccaggaagggatcctggcaggggcttccaggttctcagctcaaggcctggtcccgggcaggcgtccaacccctgggagcaatgtatttctttgccttccatcctgggcagaccccttacaggcctgggcattgccatgggccctgggtcttcccaggctaaggagaaccaggaacagctataaccttgagctagtgaaatagggtagatgagaaggctgtctcctccagacccctacccctacacagtggccccacaatatgaagacctggggtaattccaaggtgagcatagagcctgcctgtgcccagttccttctggccctcaggtggccaagcccatctcttcatccttcagatagggtcccactcccagaagaagctgctggggtgggggtgggaggctgcctaagcctgtctgtgcttcagaggcccctccagtccctggctgtggggtaactgggggtatgagctgtggccacaggtgagcaaggcagggaactgcaatccagccctggccgcgggaggggccatctctggccaatgctgctgtgccttcaaggactgacaagttacgtaggggcagaggtcgccagctagccagtgtctcctccatctggggggcgtctgtccacttgtcaccttaggttttcactcatttgtcaccttggggttttgctctgtgtgtttcatatccaacggcaatacttgcagggggacagagtcctctaaatactccaatcctgcggtttttacaaacataaagggggagaccccaagtggaggaccctgggcctggagctccctcccaaactttgtccagcatccagcctgttccctgggctcactggggagggagttgtcttcatagcacacccagagccagggatccctttgtagttttttgacaacggagcatttctcttctgtacaggacccaataaaaacttccttatgatttgcacctggcattccaaggctggtttcgtagaaaacccttctacaaccccacagcagggctggccagctgcccttaatgtcttcctctggaacctgagttcttctggtagtgtgacatttttggggggttggacttgctctctgtcttcagacaaatgctcaggtcccaccagcgagtgaggagtgagatggtcctggagtagcaacagga

SEQ ID NO: 5921 - DNA, 1203 bp, Homo sapiens
ccttgccttcaatccagggcctgattccacactgcccccgggacccacagaggagcttagcgcgcagtgggcaggcgctcacctgctgacagggcctggggtcttgaagctgcgactcatgtttagttctcagaacagccgtggctacctggcttctctgggactcctgacgggggtggtggtggtcccgggaatttgctcctagggtcacagtctgtgtgttggtcactgggaaccccaagggctgatcaccacctccctgccctgtggctttgcttaaaggtcttcaccatcagcccttccctgccagggcagtccagggacatgtggcttcagggggagaaagtgcccctctgccctccttctctctcatggaaacagcatctcagggccccttccgtggcctagcaggtggcaccccaccctgacgaacacaccacctaggaagagcccaaacattgggaaggttctctttcctccgggagccattgagccctttggggaccttctcccctccttggattgtcactgttgcacaaatggcatcctctccagaggcctcatcctgcttctcctctgccctaggatcatgcggccagatgatgccaacgtggccggcaatgtccacggggggaccatcctgaagatgatcgaggaggcaggcgccatcatcagcacccggcattgcaacagccagaacggggtaagggtctgggccccatacctctgggccctggaggccgcaccagtgtgagttcaggacaggagttccccggggagccaggcctgcagccttccctccccttgtgcactgggccttgggaactgtgggagaagtggcccaagtatttctgcaccggaccctcagagctatgcttggttttggcctcagccaggaggtgtaggaacccaccagagatgaagcgtcaagcaagctgacaggccctccctccaccactccccgccatgccgagtcccccgccaacctggccctgatcagaagcatgccccgcctccgtggggtggagtttattgtgatggccaacagctgagacataagaggccagacagcagatgtaggagaggtcccacctctgccctgaccaaccctggtggccatggcaccatagcaagtgccgtggctctctgtgacttggccacttcctggctttgaagctcacaggcctggtaccactgtgccca

SEQ ID NO: 5922 - DNA, 1114 bp, Homo sapiens
ttgcagtccagcctgggcaacaagagtgaaactctgtctaaaaaaaaaaaaaaagaaagaaaattagaggctatatgtgaagggcctcttagaacagagtcattgctgtattgctataagacacacatggctattcattgccctttcattgggatagaagccctgtgagggtggggatgtttgtctgttttgtttacagatatgtcccaaatcactggaacaagcccagcagttagcagatttgtgtgttcgctgaatgaatggccatgttaggacataattggcattagccatttatgtgaaagtgagcatgtctttgtgttaagttgaaagcttagatttccaaaaaatggaattagagtgttcctgtaggtaggatggtctcagatttcctaaggttctttgtcagtgataacggctgaaacaaaaccctcaccaccttttaagtagccaggattgatcactcaccttactcatctgattactcatctttatctttttaggaccacctttcactcacctgaggactccacagaagatggtatattatgggaaaccttcttgtaaaaacaactatgagaattatattgacatagtgaaatatgtgttcagcgcttacaagagagagtcccctctcatcgtcaacactatgggatgggtttcaggtaagcctgcatgtgcacatctgcaagggaaggacaggcagtgtgagtactgttggtttcagacattcacgttaaagcccagtgttttgttttttgtttttaattgaggcagggtctcactctgtcgcccaggctggagtgcaatggcgtgatctcggctcactgcatcctctgcctcccaggctcaaacaatcctcccacctcagcttccagagtagctgggaccacaggcgtgtgccactctgcccagctaatttttgtagttttagtaaagatggggttttgccatgttggccatgctgatcttgaacttctggcctcaagtgatccgcccaccttggcctgtcaaggcatgctgggattacaaacatgagccactgtgcccagccgaagtccaacgtattgatggtttctttgtcttagaacaaatgcatccatttgtcgtagga

SEQ ID NO: 5923 - DNA, 1168 bp, Homo sapiens
atcctcttctgtggtgagctggttccaactgagccttacctgcctcagcaagggcctgctcttcctttccttgggttgctttcccagtcctggacttcacagacctgtcttctccctcctttcaactctgtttgcatatgttctgtccgtgtgtttttgctttatgttttcagaggttgccttgacttgattctacatcactcacctggtctagagccagggcctcctgctgaatgtttcctgtgcagtcatgtcttaccaggcattttctttttctctggagtctcctgcggaggcagtgaaggctcgagagaaagcagaaactgaaaatagacgtggataacttcaggaatacagttggcaacacttgttgatgggttggattttggggcaggagacaaagggaggaaacaatttatcttctctggctcacaactgtgtgaggcttgattaatttagtactgaagaaaaaaatatgcattttttcaccttaaagtttaaattgttgatttcagagtccaactccccagattaaacctgaatatttagccttgaggtctgttggcatcagaagagagaaaaaaaggaaaggccttcagttaactgagagtaccctttcagccctggaagagttagtcaatgtttcctgtggtgagtaatacacattgatcaccctgaatgtctgtccaccagacccccagaggaagattagtcataattcgagtccaaggaagacggctaattctagcgatcaatgtttgtttcccattcagaagaagtagatggctgccctgtcattctagtttgtggatcccaggatgttggaaagtcaacatttaatagatacctgattaaccatttgttaaataggtaagagtgcttttcttatggctttgacacattgctaggtttttgtcatgaagtgggatttttgatttggagggaatgcttcttggcttctagctagagattacatacaggtctaaagctgcccagctgaagcatctggtcctcactgccgtctgctttgcagtatgtgacaatgctctagcgtaggctgactttgccttacctgcaggcagacttccaagaggagacacttggtctcagagtctgtatttataagttctggggtggggggcggggggggggtgcgtgtgtgcgtgcg

SEQ ID NO: 5924 - DNA, 1076 bp, Homo sapiens
tggtctgcgaggccttgcccctgtggaactctgggttcctgttttctcagtcttttttgcggctttgctgtggttggcagctgccgtactccaggcttgtgtcggccactcagatgagggctgtggtgcgagccagtgcaggagagctgcgcttgggattgtgccctctcctgtgtctgtcctccggacctacccaggtctccaccatcaggaccctgtctttgggtttagaagaccaagtatggggaaaaccaggcaccagcctctgcagcaatgggtccctctagcctgtggacaccagctgggggatccagggtcaggccccctcctctccccagtttccctctgctgtgggttctgggctgtcatgtctccaccacttaaggatgtctttacactgacttcaggatagatgctgggatgcctgggcatggccacatgttacatgtacagaactttgtctacagcacaaattaagttatataaacacagtgactggtatttaatgctgatctactataaggtattctatatttatatgacttcagagacgcgtatgtaataaaggacgccctccctccagtgtccacatccagttcaccccagagggtcgggcaggttgacatatttatttttgtctattctgtaggcttccatgtccagaatcctgcttaaggttttagggtaccttcagtactttttgcaataaaagtatttcctatccatttggagtcattgcctttgtcctcctgctactgtcttctgggactcttgggctgaggacagatgtcaggggaacaggcagcatggagcccagggttcacactgagggtcttaaacagccttccaggccctttctcatctcagattgtagcaagtgatgaagcgttggaaaagacatgccccagaggctgggtgtggtggctcacacctgcaatcccagtgctttgggaggctgaagagggaggatcacttgagcccaggggttcaagaccaccctgagcaatacgggaagaccttgtctccatttaaagagagaggcctgagaagtaaatgctgtggaacagatgatgccc

SEQ ID NO: 5925 - DNA, 1240 bp, Homo sapiens
aaagggaagaatgctcaagcaagtcatgtttgttttcagtgggatgggcccgcgttctcactgctgggggcttccccttcatgtggcacctttgtgccaggccaccaggcagactcttcccaccttctcccactgaagcaccaaggggcttgaaccgtaatttggctaatcagaggcattttttttgtcctagtatctttcacacttgtccaaccgtcttatttttttaaaagttctgttgcttgtattaacacgaaactagagagaaatagtttctgaagccagtttattgtgaagatccccaagggggaggttcggtagagaaaaatagtaagctggtttagaaactgacgagggcaaacagccaggacgcattggagaggaatttgccaaagatctaccctgagataacgcctgtccagtgtcttcaccacgtgaataaccagcgctccaaagtgtttttctgctttgaaaaaaaaaaattccacaagcttttaaaggtgcatttaagaatccatgtgactttagaatggaactgccggccctggcaactgtcacgtgtgctagaaggttcgatgcctctggaatgcatgtgatactcatctccattttgtttccttgattgcatttttgttcttttagcagatctgtccctgtgggtggtgtctaagaagtcggacaccttggtttttgtgttagattgagctgggcagctgcaatcagcttctttatatgcaaattaggcacgacccatctgtggttcctggttggtggctaatgaagtgaggggagggagggatgtcaccccaaaagtaggccctcccattggctttggccaggccagacacttcacatcgtttacatggttctgtgtaattttaaagtttatgtgtataaagcgaagctgtttctgtgaaactgtatattttgtaaataaatatattgctactttgaggttcatgattcaaggttcaggcgattgcgttctgtgctgaaggacaattgtgtttcttttctccttgctacctccccaaagcatgattacatcaagtctctgggaaggcagcgtctcagtgtgcacttagcaggatggaaaatgcccacggtgttaaggtaccttgctggtgaattccttagaaacaaaccacaggacgagtagatgtgaatggtttttgcagtttcttcatcagattgaggattagctcaagccccagtgagtggttagcctacttttgatttt

SEQ ID NO: 5926 - DNA, 1505 bp, Homo sapiens
cctcgaagcggctgctcagtgtgtgggctgccagccaccttccaccttcctcagctgcccacctgggagcagagacgccaactagcccttgacccatgattcactcagagcccatgatttgtgccctaaaaggggggctggggccctttcacaggtagaattagagtgagcgcgttggaaactgcggcttgagtggcgggggatgaaagcagacctctacgttccagcagcagttgattttcagcagcgggtgctctgcctcgcctgggcccagccagctgctggtccgggtgactgctgagccccatcagtagaaaggtgcatgggaatggccaccttctgatcacctgcgtctgtcttttcctttacagcccacaggatcgatacagatggataaactgccaagaaccagatttttaaaaggccgcaaaaaatcttttcctgggagtctacaaatttggaaatgaaaaaacccagacatcagatgtttttattttatattattattatagaaggtggtaccattatcaattatgtgaagggacatgcagacaccccagcttttgagggtgctgggggtaggactgaggcagccccactgggaaccagactgcagcctggcccatggctgttttcccaaggatcagttcctggagggaagggctctggccctgactccgctgtgtcccgagcacacgtgctgaccgcagcccgccgccctgtagttcttggctgggtctggaggtgtctgtggagcaccctgccctcaccacaggagcgtgagccacttctgcagtccacgctgaacatgggaaacaacctgaaaagcaggcaggcctcccggtcagggagcctctgctgtgctggcttcccatgaccacctcctcttgctgaaatattactgcttgaatctggagcagattgcgggtttataaaactgctttttatctgagaacaaacgggtttggaaattagtcgtcttttttccccactcccagagctgctcaagtcattccaccggccccctcggcttgggacagggtagtgtaactcccgatcccagggcctagccctgacacaggtggcttcccgtatcccggtgggaaaacgccctgccaccagcgggcttgagctggcctgtgtccctccaccgcctgcaccacccacctccagagtgcagtgctgggcaagggcagctcaagaggacaggaccaggcgcttggcaagacatcagacacacccaacccaaaggcgtggaccccaggcccggcccgtggtacccagcaggtggcactgcagctccccgctcctgcaggtccagcgtcctcacaggaacaccagggcctgtgctccggagccttccttcagacccttcctccacgtgcccacttgggatgcagaatgcagcggagctaggaccccctccacggcctggacctcggctgcagtaaagttacgtgaggcctgtctctcggggcctggaagtggcagccatcagttgctct

SEQ ID NO: 5927 - DNA, 1503 bp, Homo sapiens
ggagtgaaaaaataaatgatatgtaagcaaacaaatgagtgaaataaatgttatataaaggaaatgatctcttctagaaatcatcaggtagactgattattaggtagtcagacataccatctagtctgaaagtaattattttttctctaactcatttagaagagttacattttgatgaaatacattaattatgtagatatgtatatgtaaatcaagttaattaaaatgatgattttatgttcagacctagaaaggccagcttctgtattacctgagtagctaactgcaggcttaaatcccttatatttataagatttgtgatttgcttttgaaaggataaatctcttttatagtctaggggatgaagtagtatttacgaacaaaatagtcatatattactataattcttcttacctaagaaacttaacattttttcaactgcttaataaaagatttttgggctttgtgaggttaattttataatttttatgtgcttcatcaaaacatggggaaagaaccttttaaaataactttcggttatgggcagctgcggggattttccctgttcactcacatgtcagggagcacaagcccgatcctgttttaaatcctcttgaccagattcctgctgccatcaatctgataaatgggtaaatgagtattattaactaagaggaatagtggggcctctgatgctcttggtctcacattgactaaactgagctgctatttctgactttgtcagtgtactttaaaggagattttatctattattttctctaaatttattgttttcttctttgtagatgatcatgggaacagcaatagtagtcatgtaaaaatctttttaccgaaaaagctgcttgaatgtctgccgaaatgttcaagtttaccaaaagagaggcaccgctggaacactaatgaggtagataagtttctttttttaagggtataattattttaagggcaaattttttaggttgcttcacatagtcctactttatgttagctttaaatttaaaatactgatctaggaaattgtaaatgacattatttaatctggatttgacagaaaccaaccaacatgttttttgatctgtctctgatctgcttggcttgcattgaaagatacacaatgtgcacgttgacttaactaaagtagcatgagtttctgtctgtgttttcttgcattttagtgtcttgcatttagtggttaaccctgcctgcatgccagttaaacgttagttgttatgtcttcatgaattaataaatatacagtcccactgttccacagaatgtgtagtgtcttgacaatgtgaatttttgtagagttggaaagggcaggtttcataggagtgaaacagcttttcgtcctttctaatgaagaaagtttgcttaatgctaagaatttttattaagattgaaggctgtacagtagattatgtatttagcatccaattagaaagtagatttatgaagtagaatgaaaaaagttaatcatct

SEQ ID NO: 5928 - DNA, 1214 bp, Homo sapiens
gtaatgcttagatgttcttttactgccaaccagagatattatttctttttctttttcttttctttttttttttttgagacggagcttcactctgttgcccaggctggagtgcaatggtgcaatcttggctcactgcaacctctgcctcccaggttcaagcaattctgctgcctcagcctcccgagtagctgggactacaggcatgtgccaccatgcctagctaacttttgtatttttagtagagacggggtttcaccatgttggtcaggctggtctcgaactcctgaattcaggggatccacccacctcagcctcccaaagtgctgggattacaggcgtgtgccactgcctgaaatattctttagtatatttctccctgacacttttctgggcccaagtttatggcagaaactaagccaaggagaaaaagaaagagctgtcaggcatttcattgtcttaattgcggagcacagatattagtgtcagtgagtctctgcgtggtagagctggtggtcagagtggacctaaagccagaaatcacagcatgagccaatgaaactgctgaatatactcagcctcttggtttctccaacttctgaggctgtctctagcacaggtgtcttcatgaggtccctggttgccctctgaaactatgatttgatttcctgcatgttctccttcttgctgccgtccatgaatccgagacctgctttcatggttatcctttctcctgatgtttctctgatcatcataactcttggctgccatgccccactctggcctccctggagcactgtccattcacatgcccaacctgttgaacagaggatccttggtattattgtgagtcattttctgaccccacagccctgctttagagtatttctttttgcctgtcctttgcacgtgctcagtaagtgtttggactgtcagaggtaggtggataggcaaaaatctctgcactcatggtgtttatattctaatggagcagagagacaatacgcaaattgtatattgtacaaaaatgcgacatgttgtcagataagtactaagaaggaaaatatagcagagtaaaaagacagagagtgatatggcacaatttcagagacatttgaaagtggaaagtgttattgatttggaatgaggtctagattcaaatcctgattcccttaccctctaggacaactaacttaacccctatgagcctcagtttc

SEQ ID NO: 5929 - DNA, 1115 bp, Homo sapiens
ctagcatgtagctaatattaagatcttcttgtgcaaagggctcccctatcacagttgaacatacagtgtcataaaactgggccaaggcagcttccggggctttgcatgtgtggaactgccagtgttttcatctcccccgggggatgtctctcttgttcctcccctgacattcccaggagatccctaattaaagctacagatacggtttaaaaatatactcaccagatgttagtttaaaatgacctataactggcagcagagatggaagaggctgacggtgtctgaggccttccggtcgccttttcctaggctgtcattcggtatgcaaatgaagcccagcagaatctgagagccagctctgccaagccataaaaccaactgttttgaaagcaatgcatcagtaattcttatcacctggcatctggagtgcgggaaagctcccttcctaactagaacatgtcatagcatgacttaggaggaagctctcattttgcactccgcggacaatttaaactgatgaatctgcttgctgaagctcatacagatccctttaggacaaaccattttttaaaccaaatccaggctctgagacacccctgctatgactttactggacctatatactacggagaagagggcttgtttggcagcacagcttttgtgtgtgtgtgtgtggggggggggggggggggtgggggtggggggtgtcagaccccgaggctacccttctggggttttgtttagattcttctgtgcaagttcccaccaagttttcagtgagttagactttcagggtaatcccggtttgccttgcaaagctgaggaaatgaggaatgtcatgggtatcaatatctttcctgagaactgaaatttaccagtagcacattcctatcgggcatttatcaaaacaaacatataggtcaaatgaccgtttactcagcagccacctgtcagtgccttgggacgtcagcagtcccggggatgcccgtcaaagcagctgagtgatctcggccctgaacattgccaacttcccgcctgatgccctggagctgaggctccagcttgaggcttcccagtgctttggataaaaagatgggtctgcacctgagagccat

SEQ ID NO: 5930 - DNA, 1209 bp, Homo sapiens
gcagatcgaagaaggcagcattcccaactgccctcccgaatggacggccactttggggtgggcgccaggcagttaagcctgctggtggcctctacttcctcctgccgtggcgccgctcaagcataccccagcccatctgcagatcaggtccccttaggtgaattcctgcccctgctcccttgccaagtgtctcccactcccagtaagcccttccttcaaactgcctcttccctgcagatctttgagaccaactctctaaggcttttctgatgcctaagcccctggagaccacccttacctcctcctgccccatccccaagctcccaaagtcctatgtcatctgtgcagaggccctttgcacatgcagcatgggagccactcatcctaccagactctaggacccccgaaggcagcgactgtaatgctggtgccaggggaacaacctgggccctgagccaggcagaggcaaccctggtccccaagaagcctgcagtcagttctggagaacaagacataaacctgggaagatgatcgaacaacgctgacaaagtggactagaaacaaggctgaccagcgcagagcccaggggccctgggaagagccggagctgtgagaaccgctgttggctgtgggtatgctaggtgccaggagcatccgtattctcttttaagcctcacccagccttgtgagctaaacataacatccctattccacagacccagaaacaggcccagagagggaaagtgacctccccaaggtcacacagccggaaagtactgaagtcaggttttgaattcaggtctaactataaattggtgtcccagggagttcaatccaggaggcctttctgtgggtgtttaacataatttagaggatctgagggaatgggaggagcatgttccggtagcggccagggaattgaggcacagagaccattctatgcagcagaagacaagtgagaggtggctgcgtggcatgagaagtcagggctgtctgggagaggaagcatcctggtggggtcaccacggggccaggatgctgaggggccagggccagtgctctgcctccgtccgggcctcagcccacctctggtgctggggtggtccgtcctgagcaagccttgggaagggaatctggctgctccccacacagcagctgcctttctgttgtctgagctccactcagttgaacaaaatttgccgtccccct

SEQ ID NO: 5931 - DNA, 2528 bp, Homo sapiens
tatatgagaaccgaaacatgacttctttcattgatagatggatgttagtggatgtttccttttagcaggaaggtacagttacttggatccttttgactctagtctccttcctctagccctctatagaatggagagaagccagtagtaggaaatcagcccagtctaatttctgatcacatttagactgcagcattggatgttggcttgggattcacactgagagactaacctgctgtttcccctgcctttttgcatctctcctccttcttagtgtgggttgtctcttcatgaagaaccagcggaactcaaaactgctgttcaagaaacctcttcaagacttttgacttagaacctgctatattatcaagcttacctactgttatctctaaaattttttttgtgttaatgtaaagttgaatttctaggaaacgtgcctttgttttttaatatgcactccaaattagaaggccggccccgtccacattttgcacagtgcctttacagatttacgtatgggctgatgaagaggccttcttaagttccagagtgctataatctagatgtaatgttgtcactaattaattgccattactcccagttagttacccttgtcatttggcattattttcagaaccacattttaaacctttgggtaatcagatttccaacttatgccttccagaaaaaaacactactgcctaacacaaatctgtgataacaacaggctgtgccttattttgataattttctgattccctagaagagaaccctctactttttgtaagcactactgactctcgctgtatttaagatgctggtgaagagcttttgctcttgcattagatttgaagatgtttacattgttgttattgttatgtatcacttgctaaaaatattgttttaatcagagataacctctttaaaaaaatttttaaagaactatggctatgaccaaagcttctattttgccaaaaagttaaataccgataaaatggccttaagtgtattcctgacagttaaattcagaaacgtgccaaatggaactcaaggtgccccttcagaattaaaatcattaccttgtgtgtgaaccttctacatcttcataggcctttcttccttttgaaaggctgtagacagtgtggctccccttctgattcagtattttgcatgggggttagagaaggtttgaggtagactctgaccgtctcataaaagagttctacccagcagttggcagattatcagctgtggactccagcatgtttctgataattatgcaagcaacaattctgtagcctcaagtaagaccacctgtgaacttgatcattatctggcccaaatatgaagataaactataactttggagtttgtttcctatttgtattcacattctgcttcctaaatcagttttctaaattatgcctgcaattaggcattggtcaggggtgaatggctcttttcacagagagtagccaaccagagacctttgctttgatatcatcaactgcagagaatgctgttgatgggaatgctggaagcagaaactttgtcatcggaaaaacttttcttgtatgcatgagactcaacatcaggatccacagcttaaagatgggaattcaggtatgaaagaaaacaggcaaggaggcactgagggagaaagacacagactttatcgctctgtggctcattgttactggaatattctaaaactcttgttcacatgctattatgacttataaagcagcaacagctgaggcgcaccaggacacagcttccatttctttaacgtctgttcccttaacatcgctgaaatgatttactgttgaagagatgccttgcggtgtggccagctgtgaggagaaagcagctggcagtgttaggacattagtccaccttcagcgcagggtctctggccgggtctgactcagaaaccttggtactcgccccttggccacagtgcccagacccatgtaacccactggctcctgcattaacccagaaatacctcgcttctatctgtgcacttagctgggaacttacccactgtaatcacctaaataaagtgtttataaacatgattgtggcacctgtgctccttgtagaggaatagctgcacctggtccgagtcctaaaaatgccattccttgctgctccccatacctgtcccttagaagccccgaaactgtctcccccttttctcaccagcccctctctaggtactctacccttttggtacccagcatttccgcataccccagtgaacagaagaaaaccgctccccttgtgaaaagtgctttttagtataggcgatgaggaggaaactggcttttacacaattaccaaaattcaggatgtggctttggagttccctaaatagatggtctttctaaagtgatgtgcagagccgaccccgtctgtggtagactagatggctgctggcatggaccctgggatagatgagtggataggtgagggacatccccagacacatggctctgttcctgtagatccttttttcctcatgaatg

SEQ ID NO: 5932 - DNA, 1156 bp, Homo sapiens
aagtgttcagacatttaacactgttgacccccacacacaattttttagtacagttataactaagaaaacaaaaatcccctccaaaaaattacaagttaattgcgaaagaccacatttaaatttttgcccatgaaattcagtttagtcgtttctctgaaacagtgcttcaaaaaagactgtttccccgcattgtgtgaaatgcaggagacccacgtacttgtatttttaaaaaacccatttgcaacatactattaaagttggatttaagagaacatggtagaagaaaatctaagcaatactacaccttttagcaccctcattatgttttcatctcagagcaattaaaactgctatacaaatcaacgttaagataactaaactgctgcttttttcgtattcagttgtctatgaaaaccgtttccctaggaagtacttactctgcttgaaaatgctcctaaactttaaattttggggtatctcagggttgcaatgaaagttttttgaaatctttttttttttttttttttaaggcttgtaaacatataacataaaaatggcttccaaaagagctctggtcatcctggctaaaggagcagaggaaatggagacggtcatccctgtagatgtcatgaggcgagctggggtaagtcccacatcgatttttagccattcctgttttaaatgtttttggatttttaaatcattttgaataaaatattcaaagtgctctatgaaatatttcaaatatacacaaaatttcagagatgacataagaataaatacctgttgatccactgctcacatttaacgcttgttaatgtcttgccatatttccttcagacccatttctcttttgttttgagctctgtcgtccaggctggagtgcgatggcaggatcttggctcatttcggtctctgcctcctgggcccaaaccatcttcccacctcagcctcccaaatagctgagactacagatgcgtgccaccacacctggctaatttttgtatgttttgtagagacagggttttgccatgttgcccaggctgctctccaactcctgagctcaagttgtccacccgcctcaggcctcccaaagtgttaggactacaggcgtgagccactgcactgtccttagacccatttcttttttcttctt

SEQ ID NO: 5933 - DNA, 1264 bp, Homo sapiens
ttccccggcacttcagaattgacacttgagctttgttgtaaatagtgatgtgagtaactgtcattcaccgacatctcccccaacacttaaagtcttagcagctgcatttaactcacgcatatttgtttcattctaacagtggtttctgtcaccctttgctctgcacagttttaaaaatacctttgtagggggcttctaagagcttggagtgcctagtaaatgtttttgaatggttagctacagtgttgggtttatatgctgtaatagtgaatttaattggtaagtaatcgtctttctcgtcacatagcccattaggatgtcaccttttctgtttctactttgcaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaactactgattgtttcttgttttgtctctcatttcttttgtgaaattaaattccgtatcaccttcatttgcagctcttaactgtccatatggcactgaaataaaagaacagtgaccacattttacacagcaaggaggaaaggcatacaaacagaatttaagaggcttgtgattttctctgcttattagctgtgtgtttttaatgtgctattaaaaaataccaatgagggctgggtgtggtggctcatgcctgtaatcccagcactttaggaaaccgagccaggaggattgcttgaggccaggagttcaagaccagcctgggcaacatagcaagtctccatctctacaaaaaaatacaaaaactagccaggcatggtggcatgcacctgtagtcccagctacttaggagcctgaggtgagaggatcacttgagccccagggggtcaaggctacaatgagctgtgatcacaccaccgcaccccagcctgggtgtcacagcgagaccctgtctccaaaaaaaaaaaaaagaaaaaaag

SEQ ID NO: 5934 - DNA, 1313 bp, Homo sapiens
acatttccagtttctcttaaaaaccgtgtttggtttcagttgggataggcttgttttgtctgttgaaaatgtttctagttttttttctttcatttttctctcattccatttctgccttaactttagtttgttcacagggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctttggcatccatttttccaaagaagagtcgagtcctctgaggtctgtgcttgaaagccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactacaacccttgggtgtctcccgtgcactgtctcattcctggagagtgggcggggatcctggctgttaccccaggtggggaagggacagagggagagtcggctgttccctgctgctcgggaccctgtttgcatcccagagtggcttccagaaacatcctctgtctgggaagaggctttccctggtgagggtgctgtctttctttggaggctccccaagcagcgggatgggccctaagcaggcactggcattgggactaagagcatcttcccccaccccttgccattcaccccacacctctaatccgtgggcgttaccagcatgtatgggcatgtggcaccctgcctgctcaggagacacatcggaaccaccccatcctagcggcctcctgcctggcccccatctgcc

SEQ ID NO: 5935 - DNA, 1631 bp, Homo sapiens
tctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaatcttttattttaatacattgtaggaaatcttcataattggagaaagttctgcagcatggctttttacgtctgtaaataaataattttagaacagcctttttttcttccataaactactattgtgatctattttttccagccatgtcactaattgtgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagatttctgtgtacacacacttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacattgcactggtaaaccatttgagtcccactcttcatcctggaagtgggaactggagtcccacccacagtgcattcagaaagcatgctgtgtgggggctgcttctcaggaggccaggcccttctgagcggaaccgtcctggagagagcctgccctcgtttccaggctgcagccgtaacgcactttctcccaggctgagggcgggtgttctggggtgtctgccctctgtcggccctgcttcctgccaggacgtggcctcttccgatccttttctctcagacactggaggtctcttctgccattgtgctggtcccatcccaagaattgtaggacagagaccacactgggtcggcggacacaaagtccatccaggacccaggccgcagagggagcaggaagagatgctgatagtttgatctagaaaccagcagctactggc

SEQ ID NO: 5936 - DNA, 1216 bp, Homo sapiens
tcaagtgatacctactagtttggggagccaagtgtctgtccgtctgtcctgctggcagggcagcttagccatggacagcagaccctgagcctgagctctcaacggcacagcctggcgggaggatcctgccatcccgggctgcctccactgggctttctcttggaccccgcttctgctctatttaaggcctgtgccttgggacagctgatctcagctgcttactgtaactgtatcttggccaggacagctgttcctgggcactaaatttgggagcatttgtcagtgagaagggctgctttcttggaaagagagctgaatttcccattttgtatgcaccaagaactctgacccatggtttcttgccccaaagcagaaaaaaagtaactgatgtcagaactactggttggggcctgaacacctgttgatctttgtgttacagtccctgtgtagcagctgttgaagggaagttttctctgtacctacctgttttccaaacctgttgtcaccatctcttcccaggcctggagctgctgaagactgctattgggaaagctggctacactgataaggtggtcatcggcatggacgtagcggcctccgagttcttcaggtctgggaagtatgacctggacttcaagtctcccgatgaccccagcaggtacatctcgcctgaccagctggctgacctgtacaagtccttcatcaaggactacccaggtgagtgttccccgagtgccatctccctttcctgccactgacctgcagcagggcagctggagcatctggctggctggtgatggctgcaaggaggggatggggagggagtgtctgaacttccagctcccgtaggggattcaccactgggtttgcccccagttgtgcatacacagggcttcacagaggttcttgtgtagctaaggagctcgggtgccagcagcgacattgcataataagttgttcacagtcaggagcagaggcagtctgtgctccattagacaggtgagggaaccaagccttcagaatcagaacagccacttggtactgagatgtatcatgcttcctgtgagctgggaatattcattttaggctgtgtgtgtgcacaggatagagactgtgaccacctttctacaggagaggaagctgatggctggctgaataatctgcccgagagcacacagcaaatggtggggcaagaattcagaccaggaaatctgac

SEQ ID NO: 5937 - DNA, 1139 bp, Homo sapiens
tagcggatgatctaagggccagggcggtctgagttggctagtgcaccggggattttcttaaggcctttgacccggggactggtgtgggaggaaggcaaaggcctggttgtttatgagcaaggaggagtcaggtccgaggatggagcccttcggggtcactgccctgggccctgcccctctcctgcacatcaggccccttggacaaggcccgtgtgtttgcaggaccctcttggggcagcagagcaagggctggctttgagagagagcctcacttttttgtttttttttttttttttttttttaagtagagacggggtttctccatgttggtcaggccagtcttgaactcctcacctcaggtgatctgccctcctcggcctcccaaagtgctgggattacaggcgtgagcgaccgcgctcggccagggcttcactttcaagctcagtgctgctctgaggggtggacacagccctgatgtcagtagctgaagacctgcctggccacactcagcagcagttagccttctcctcccgcgccccgtgaacaaggctgtaccctgggaggttgggctctgtctgaattccatcacaggtcctctcctgggccttgccctgctttgttgcctccttaggaggatgtcttctggtttcctaggaagggctttatatcttaacatccaccctgcattcaaaacccaagttatcaagaccacagggcaccacaaccctcctcttggccttgcggtttctattcttcagtgactcccagaggtttggcttgattggcagcttagaagcacatgattgaacttgagcagtggttgaaactcagagtcagatgcctgacccgccccaatcccaggcacagagtctgacctcacacccaggctgtgctgtgtactcagttgttcagtatcgacttgagcttgacgggcatcaggggccagggagtgaaagggaagagaagccaaatctggctgctaagggctctcagtcctggagggcaggaaaatagtggccttgccgctagacctgatgccacctgcccctccagctgtaccccctcaacaccttgggtaatacctcaagccccacgtcctcttccaagccagataggaccccaagtgctgggtgatcctt

SEQ ID NO: 5938 - DNA, 1224 bp, Homo sapiens
caggcctgcggccctccctggtggcctttgccgctttcctatgctcctggcagcaaagtggttcatctctagcaagtggtctctaactttcccaggcagagtccctgtctacagggcaggctccctacccactgacttcctggaacagaagccaagctgtcaggagggagggacaagctgtgggcttataacattttcttaagaaacacgtggtggtttcttgccaggcaggaagtgtttgtttccacatcgtagccacctgaaccatgtctgatccttccttgttcctcgtctgtctctctttgcaccccaggcacccaggcatgtggaatatgctcatagtggcgatgtgcttggcccttctgggctgcctgcaagcccaggagctccagggacatgtctccataatcctgctgggagcaactggggacctggctaagaagtacttatggcagggactgttccagctgtacctggatgaagcggggaggggtcacagttttagcttccatggagctgctctgacagcccccaagcagggtcaagagctcatggccaaggccctggaatccctctcctgccccaaggacatggcacccagtcactgtgcagagcacaaggatcagttcctgcagctgagccagtaccgccaactgaagacggccgaggactatcaggccctgaacaaggacatcgaggcacagctccagcacgcaggcctccgggaggctggcaggatcttctacttctcagtgccacccttcgcctatgaagacattgcccgcaacatcaacagtagctgccggccaggcccgggcgcctggctgcgggttgtccttgagaaaccctttggccatgaccacttctcagcccagcagctggccacagaactcgggacctttttccaggaggaggagatgtaccgggtggaccattacttaggcaagcaggtgagcatcagcatggagcctgccagggctagggtgagctgggcgctggtagaccccagcaacaaagccgctcgctcattgtggagctaggccccaaggcattgtgaactcagagctcccatggtctccttgaaggtgggcaggaggcgagcgggtaaaggaaagacagcagcagggcaggactgttgggtccttgtccatgtgtctggcctcttttgtcctttgcaaagcccccgttctcgttgtttcccagtctgggctctggcttctcacg

SEQ ID NO: 5939 - DNA, 1150 bp, Homo sapiens
ggtggcacttgttagtctcatccaagggcaggatgcaggaacaaaagtcaagtaacttacccaagatcacatgctagtaagtggcagtcatactctggggtgctgcagcccccgccatggtgccatagcccccacagtgccgagcctcctactggcagtggccaggcagggcggggcgaggggctggccagtatctacagaggcaatctggcctttgctgggaatagagctttcttcatgtggatttctgtagaggctcacggatttgacgccttctcttacagtagttctcattgacagaggtggcttcaagacttcctccctcccttctcgtggtgaggttggctttggtgtgcaccatttttataggccctgtggactgggggaagaggatgcaggatgaatgtgcgggctggggttttggtgcacctcggggagatctgatgttctggcctctctttagatcctccccacttctccacctccctccaccaggccgcaccagcttctatgaggagtacggtgtcattcgcgacgtcctccagaaccatctgacggaggtcctcaccctcgtggccatggagctgccccacaatgtcagcagtgcggaggctgtgctgcggcacaagcttcaggtcttccaggcgctgcggggcctgcagaggggcagtgccgtcgtgggccagtaccagtcttacagtgagcaggtgcgcagagagctgcagaagccagacagcttccacagcctgacgccgaccttcgcaggtgggccctggggctgggcatggggcactgggctgcccacttcgccgggagcagctttccaaatgcagacgcccttgggtggagtggaggggacttgaggtgggatttcccccagggtgctcggaggcaaggatggcattcccctgtctccctggcctcctaccagcctaaagtggcaggccagctggtggtgccctcagggcgaaggacatcccaatggccatggcctcgtgtcagccccagttcagtcccagatgcttcccaagggtttgtcgtgcgaggctcagacagacctggttcctgcctcatagggtctccccagtgaggccgcaagccttttgcctggccacagctggagacacttccagcggccaagtgccatgcc

SEQ ID NO: 5940 - DNA, 1133 bp, Homo sapiens
accgccgcatgagccttagcctgcctctcatcaaccgcgccaagaaggtggcagtcctggtcatgggcaggatgaagcgtgagatcaccacgctggtgagccgggtgggccatgagcccaagaagtggcccatctcgggtgtcctgccgcactccggccagctggtgtggtacatggactacgacgccttcctgggatgagggcgcctgtgccccttgcccgcttcgctcctgtgctttccttcgcccgtgtcttccctcccttctcggccccgccacctgcccagcgtgccctggctctccagaaccttctatcccacagtcaggccccagagagggcaggacaagccttgtcccgatgcctttgaccggcagctctgtgtattggtggatagatgcagaaacaaggaagaaatggagtctgctcctgagaagcttcaaattcaggccaggagagaagtcttaagaaaagacctccagcagttacacattcatatcaaccagcacaacacgggatggcgcccaaactccggcgttcacaagaggagacgtgacgtggtgggctgaggttaatcagggaaggtttcctgggggaggtgatccttgaactggctcccggggaacattcagagcatgattggtagacagaagggtgcagaggcgcccaggggagtacattgccccgtgcaaagcaggggcattggggactgtcttgagaccctgagggggtcaagcccctccttccccagctgcccctccttctagaacctctgcacatctagcctctggccctcctcttcactgcctccacctgctcccgcttgccatccctgtctcctccatcctggctgtgcagtaggaattccaggctcctccctgtgtctttgctgttcttcagactccatttatagagaatgagggctgataacaggaatacagtggcaaagactagactgtggaaagggttccagaaatcttttttcttttttaattaaaaaaaatatttgcagagatgagctcttgctatgttgcccaggctggtctcaaactcctgggctcaagcgatcctcccatctcagcctcccagagtgctgggattacaggtgtgagctactgcgcccagccccagaaatc

SEQ ID NO: 5941 - DNA, 1112 bp, Homo sapiens
cattgtaactcagtcatgggagctgcctctttggaagtgcagatttattcctgtaataatcctgcctgcttttacctctcgtccactgaccagcaagtgtgagtcccggtgtcagtcggcacagtccagtgtccatctgcatttgctcatgcagagggggtgagttgggcactccctgttgttggttttccttttgcagcacactgggcagtctccctataaaacaaaaaccccaccttctgtgccttctgctttagagcagagctccccctcccatttcctcagtcttccctgcaaaatctgtccaccggggaaggcagcaggaaccctgggcagcgggtgttctgggaaggctagtgacagcagatgtcatccaggaacagccacacacggttctccaggccgccgtcagcagctcaaggtggggtatgagtgagaagctgaggatctcgcagcttgttgctgagcaaggtgcaaccgggctcatgctgtcatcagcacaagacgggatggcaagggctttcagacgcatttccaagagtccagcaagccagggggaagatgatccctttgccgaagtgtaccctctagccaacttttgggagcgcttctgtttgcaaagcgctggggatgtgcctgtctctgtgtgacccacgaacgggaagggagagcactggagtaatgacacttctgctgctgctttgattctcaaggctgatctttaaaaccctcgccttgctgacaggtgctttaaaggcagtctgcatcttttcttcccttggtgtgggagaggtaaacactttgatttgctgaaagctgtatggagtatatttgaacagctagtagttagctttgaaagtggaagtgtgaacagacactacttgtgtcgctttgggtccttcactttacccccacagaagtctagaggcgtctgttataaagcgttacggggcgcctgcatgcaggaggaaggacctgtattagctggaaatcatcaggaacccagcttgcctccatctctctgagatgtgctgggtacagcctgcccctcctagttctgtccaccgggaagagccggctggcggcagatccccaggggcagagcccctgct

SEQ ID NO: 5942 - DNA, 1182 bp, Homo sapiens
gtagtcaaggcagggggtggcggaagggccctttatgaaaacacaggtatgatatgatggctgttcctgtgtgttcccgagtcacccaaaaacagttcaaattatgtttgacattctcattttggcacagggtgaaaaagtgtggtctattctagaaacaaaaaaaaaaattaaaacttccaatgtgttgaagcttaaaggattagcatttatccagaacgaagaatgtaaaaggactttgtagatgtcttccccaaatctcactttcctcaattatttttgaacacctctgtcaccactaaatcatttctggagggacacacaggagcttcctgaacgtgcctgtggcaggttttggttttagcacaggcgaggacaagctttttagtacatggcagcatctttcccattttattttccgaaaatttttcaggtgttctggagggacgtataaagttgcactgtgatgatttctttataatgttctctttgttctaacagggctgtatactttgcatgttactccaaagccaaagagcaatttaatggcattttcgtgcctaacagcaatattgtgcatattttctcagctggctctgcaggtatgttaccctagtgagtgaagagagggtctctctctcacttttctaaagcatgcattgtgccagtttttccaggaattagaaattagctccttgcttcctttgcacctaaaattgtttttctaaagctttatgttacaaccaataggagagtgagagcggtttgtagcttgattttattttccttgaccactaaagctctttatttgccctcaaaatgtacatgttctatgcatgctactggtattttgttcttctaaaggaatattcataggtttttcatgtcttctgtttgcccatcaaatgatatagatagatagatatagatagatagatagatatagtttttttttttttttttttttttgagacagagtctcactctgtcacccaggctggactggagtgcagtggtgcaatctcggctcactgcagcctcctcctcccaagttaaagtggttcttgtgcctcagcctcctgagtagctgagattacaagtatttgccaccatgcctggctaatttttgcatttttagtagagacgaggtttcaccacattgcccgggctgatctcaaactc

SEQ ID NO: 5943 - DNA, 1151 bp, Homo sapiens
agacagagtcttgcttgctccgtggcccaggctggagtgtagtggcacgatcccgactcattgcgaccttcacctcccaggttcaagcgatcctcattcctcagccactctagtagtaggcgtgcaccaccttgcctggctaatttttgtttttcagtagagacggggtttcaccatgttggccaggctggtctccaactcctggcctcaagtgatccacccgcctcggcctcccaaagttctgggattacaggtgtgagccaccgcacccggcctaaccttgacagttttaaagttgtgtgctgtggattcgttccccatttaatatgtggcgtaaagtaggtctttctctctctgcagaagtcataaggacgaggctccgggaagagggcaccaagtacaagtcttttgtccagacggcgcgcctggtgttccgggaagaaggctaccttgccttttatagaggactgtttgcccagcttatccggcagatcccaaatactgccattgtgttgtctacttatgagttaattgtgtacctgttagaagaccgtactcagtaacaggccggaaaattgtgctctagaagaataaaactgaaaaactctagagaattttttttccccattgatgtttagaaagtttgagactgaaacaggaaaggccataaaatatctggttcatatcacctgttggacatttccttttggattcatgctttctggaaggtttaaattcattaacgttaatagttaattataactttttttttaacttaagaggattcagggttaagcaccaactaaattaaatcatgctatttaatttaagtatacatttggcttgtgtcctcttttatgctcactatactatgaaggacttaagtaattcagataaacctgccctagaactgcagagaaaaatgataaagtgagaatacaacttgttttataatctgactttaagatcttgcactgctagacagggaagaagtgtcgcattttggctgggcactgtggctcacgcccgtaatcccagcactttgggaggccgaggcagatggatcacgtgaagtcaggagttccagaccagcctggccaacatggcgaaaccctgtctctactaaaaatacaaaaattagccggacgtgt

SEQ ID NO: 5944 - DNA, 2687 bp, Homo sapiens
ctacagccccaggtcctggcccagtccctccactgcctcgaagagtcagtctgccctgccttttcctttcgggcaccaccagccatccccgagtgccctgtagccactcaccactgctgccacctctctggccaatggccctttcactggcctggtgactggaatgtgggcagcgcccacacaggctctggcccatggcttcctactggcagctccaggcacccccctctcaccacgccgtttgctggctctgacactgttgggtgagggtcctggtcctgctgtcttcccttctggcctctgcacaggggtggtgacagtggctacaggctgggcccctggcgtgccctgaccgtgcagcagagtgaggctggggcagcagagagccccagcctcacccctgaggagcacctgtggtctgtccccttggtcctgcttatggctggaccggccctgcaggaggtggtggagccgtgaaggaggccgagctgcagctctggctgctgcttggcctcctgctccaagaccctcccgagtccccggaaatggagagtgcagttcttgggcccagcctggccttcgccatgagtttggggagcgagaccccacctgagacaggcagtaggagcctgtgctgaccttggggaatctgagcttttccaagggtaaggggcccagggtatgcaggccttcagtgacatcaggtcgttgtcatcctttccctccctgacctgtcacgagcctctgcaggtgcctgctcaccatggcccagcgccactctgtcctccgactcaggtgagggggcagcccacagacctgctcctcagtagcagggcctggccaggcccctgctgttctcagcctcagtttgccatctatgaaatgaggtggacccctctccatagcccttgggtgccagctcagtgggtgtggggatcacatgaggtggctcatgaggacacactctggaagtcgaggggctgccacgtgcagaggaagttcccggcctgggggctttatccaggggtcccagtcgagagtggcccgaggccgtccctcaccgggcatgttccctctggctgcccactccctcagggcccacatgtcctgccactcgccactctgagcacgagttcaccttccagatgtggccagggtgtgccagctcctctctcctgtgcgttggaaccccgggggaggcaagagcagatcacaggtgcatgagggttacacccgtcacctgggtctgccgggatgggttgggggggcaggtgccaggcctcactgctgtgaatctgccacgcctgggggtcctagaggctgccccaccccagtgattgggtagcagctcacatcccacccagcttcacaagtgaggaacccaggtgcatcgggagaccctcgggggcttctgtggcctctgtgcccgatgacctgcgtggcttcagacaaggccccagcgttactgggctcagcttgttgttctgtgtggagcgtgaggtgagaaaacccctctgaaaagatgtggtcggggccacgcttcccactggttctgcagtgaggagttggggcgggtgagccaaagcggccccccatggtgtctacctgaggggcagggaaccgcctgcctgtgcactcacgccaccccccagcccacaaagagcccatctgagagaaggacgtggtggagccaggacgggaaagcgtcctgtcggctggccatgctgttgcttgcgtctcgaatcttcggttctcgaggaagtgttgacagtgtgatgctaatgtctgcttttcttggcgttgggtagaagcaggacatctgtgtgtatgtgcgtatttaaattagattatttataataaccagagccagccctcgcgctggccaggatcctcctgccgagctgatgtcgctcctgccctctgccggggtccggaagcgacatctcaggaggtagctctcagcagagtgaggattcctgcctttcgtagagttttgtgtgactttttaaattattcatgtgtcccttaaaagtttcactacgtggagaaaattccagcaccaagtgttgtggcaacagctgagagagtgcaggcaccactgtgttgtggcttgttgaccgggaatgtgtcacccctgccagggaactcttctcctcgcgggggacttgggatggccatcagaccttctagggtctggctggggtcatcctaggtatgggtgaccgtccctgagacataagcgaggtagattcagccatcctcaccctcagacttgaggtccccacccaggccaagccggccccccgtaccccttgcctgggagcaaaccgccaggacgcagcctccacgccgcacctgccacattcagccctgcccaggaaggaacacatgacccttctgtctgtgactgttgctgagtctctgtctcatgtcgtagaattgtggataattgtctagtgaccctctcatcactgtaaccatcgcgcctggcctagatgtcgtgttttggatgctgtgttttcaataaatgcctctggggccctgcttttacccgctggcgtcaggtgccgcgtctttcttcttttttctttctttcagaagggctctgtgccagggctggggtgggcagctgtgtttggggtacagacacgtccacaggagtcaggtttgggagccagtgacaatga

SEQ ID NO: 5945 - DNA, 2342 bp, Homo sapiens
gctgctttgtatgtgggtgactccgtgggtgctgactggagctttgttttcccttcacttctaatataacttccggtgccgtcctggctgctctgtcgctggggagggagacgctggggcaagttctccttcctctgtggctgtcgagaggagaatgccaggtgacggggctgtgggcagggccggactcatgtggccgtcacttctccttgccagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaactaactccagccggagcggggtttgtcttctctcctgttttggttttaaacctacactcccttgtttctttttgagccgagaacataaaagaacataaaaaggctttttctttcttttcatctgcctttacttctcatttcaaggtttcacagagtgctggtctcaacccacatcagtgatacttaactaacttgccttccccagacagaaacatgaaatgacttaaaaaaatagaaaatattcttctcgccaggcacacaagactgtacacccaaaaccagaaacgctgtggctttgcaaagtgtgctcccacacccgcgcacacaggcgcacttaaataaataacgcgcacgcacggctttccccatttcgaaacaggcagacggtctagtgagtttcagcacttgctgggaacaggcgtgtggccagggaggtgccccgcgggtggc

SEQ ID NO: 5946 - DNA, 1113 bp, Homo sapiens
gtcaggagttccaggccagcctggccaacatggtgaaactccggctctcctgaaaatgcaaaaattagccagttttaatggggcgcgcctgtaatcccagctactcgggaggctgaggcaggagaacagcttgaacccgggaggtggaggttgcaatgaaccgagatcgcgccactgtactccagcctggggacaaagcaagactctgtctcgaaagaaaaaaaaaaagtaaactggagccagcagattgcctaagtgtaagacaagcacgtgcctgggggcttgaggtgcgcgggacctctggctcctcacatgagtttcaccgagcactgtggcttcaggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacaggtagggtaatagctctgcaagcgatgccaggccccagtgtccagtagggtgggtgccagcggcaggctccctctcctttcccagggtcccctgccagcctggtgctcgtaggccatgtgccatgctgtgtgcctggggcacttggttccctagagccacggcctgggcatttgggtattagctgttgttgctcagtggggtccacggtgatcacaggctccgcctctcaggaaagcccaagtgtatttgtttctaagccctgccttggcttagccgaagagttcatttatgcagatgaaattgtgtcttcaaaatccattcaagaaacagctttaatttctcctttggatctttagttggcaatttacccatagaaactgcctttgcagatatgaatcggcaccactactccctctatgtccacgggtgccggctgatcttcctcttccgtcaggatccttctgaggagaagaaatacagacctgcagagttccactggaagttgaatcaggtgagtgaattg

SEQ ID NO: 5947 - DNA, 1112 bp, Homo sapiens
ataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggtgagcttcattctctcccctgcgctcacatctgctcttaaaactgatgtatgcggcagcaacctagagtgtgtgttttccttctctcttcccctgctgacttgtggaccaacacaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtaaggagaccaggcgttcttgcatccggctggctttggtgaaggtgggagggacctttacaactggaaatacttgtgtgtgttgtgttcataattataaactgtgacagagaatctgcatttctgaagtgaactttgctgccttgctggctagttttcatactggatgggcttcgggggtggggcagggggtggacatcaactcctaaacgtctattcaacatgttgtgtatatgtgcattttaagaaccactggtggccagatgtggtggcttatacctgtaattccagcactttaggaggccgaggtgggaagatcacttgagcccaggagtttgagaccagcctgggcaacacagcgataccccatctctacaaaaaattgaaaaattaactggggatggtggcatggacctgtagttccagttacttgggaggctgagcgggaggatcacctgagcccgggaggttgaggctgcagtgagccgtgatggcaccattgcactccaccctgggcaatagagtgagaccctgttttaaaaaaagaaccactgatttgaaggaagtatttctccagcatactctgagaatcatccaaaaagggcttctataggagtacatggagtgagttttacatgaaatgagatgtttacttacgaattga

SEQ ID NO: 5948 - DNA, 1102 bp, Homo sapiens
tgcagtgcccagcaggacactgacagtcacagctgtgtgactttttgtgggttacttaatttttttgagcctccttttctcttctattcaatgaggataatagggcctacctcataggattattatgcattcccctctgttaatgcacgtaaagtttttacttggaaaactaactcaccatttaacaaccattctaagcaccataggatatattttgtttcacaaatttggtattcattcagaataagtatttgaaaagtgagtaaattctatgcaattatagttattaaatgacttataaactgtgtttctcttccacttcttgctacatttaatcttctaggtgttcagatatctttggagattataggcagcaataaagctaaggcagctaacctttcaacattcttgtgtcaggctaatattttggtgaaaggaattcttgtgtttctcaaagaactagagctgaagcagaaataagttccaatgagcaagtgtccaatcggaccattgaatgaaatctagtgttttaaacaattctgatgtttcaatgttttgttctgttttcttttgatcttgtgagcagtaagacatattttatgtgggtggtaaaggaagaaatcaagtaacagaatgaggaattgttcccaggaagagttagagttgggacaaatgggttgttaactttgatttttagatcttctctgaagacattaaacatggaatggtcatctttagaaaaataaaagactatgcaactccaccactgaaatggtatcttattacagtgaatgatggataatctgaaattactatagaaaaaaataaacccagaccattttgcctagagcctttcaaccacctttctgtccacgtttttcttttttattctatttattgctaagaccagtgaatgttcttctttgccttccaaaatgttttccagcattagtatgtaaattaaaactgtcggcagggcgccgtggctcacacctgtaatcccagcactttgggaggcggaggcgggcagatcataagatcgagaccatcctggctaacatggtgaaaccttgtctctactgaaaatacaaaaaattagctg

SEQ ID NO: 5949 - DNA, 1226 bp, Homo sapiens
ccctttgtagctggattgtttgtgcagagggaaggaaattgggatggcaatgggaacgtgtaggggttaatacactgataatggaggctaattatattttctgttttaatatctatatgatagattttttcccactttaccaggaattgcaactgcacttgaaataatctttttgtttattatgtgtcttttttcttaggctctggagacaaaattcttgctctggcaagttttgaggttgaaaaaacaaaaaaatgacatggtgcagaagcttgtaacattgatcacattcttaatgtaaatggtgtctttcttctggggttttcagttattgcaaagaaatgaagagattctggaaatgcatcaataacctaagaaaaagcgacataaaaatatacttatggcttgtgtttatgctcttcatcattgtgcgttgtgtgcggttacctgcttgagtgatcctgaacttgttgcgacagagggactcactggactctgttcgttatgatttgtctgtttaagagagaaaacaaagtggacttgatttttattaaggctgtttgtttttaagtgttgatagtgaacgaaaagatgtgaagtaatgatatttttctgcttacaacttatccccactcattggagtgaacagtgacgcaagctcaatagacttcataagtgttcatagaattttacaattctgagtgatcttagaaatcatttctgtttttacaaacaaggaaactgaggtccagaaagagcaagcgactttgcttaaagtcgcatcagagagctgagggtaagactcaggtgtcctgactcccagtttagtatcttttgaattttatttctgtaccatttaaaaaaaataattaacactatttgtgcaagtcagtgtttttgaaaattcagtgtcccaataaaaagtggactgcacactaagggaccatcccccagcctgtaagctgtctgtattaatggggcccgttgtatctcggaattttgaggttggaacaatgggagccctgttgagcgtttcctaaagtgacttagccgcctgcgttgtttgaccagggaagcaacaggaaatggcagctagaggccctccctgtgcgtgacctcttgtcacactcagaggggggtaactgtcagctgttatctactcttcaggttttggagaaacacaaaataagttatgaggaaaagcaaatttctctcctgagtattta

SEQ ID NO: 5950 - DNA, 1106 bp, Homo sapiens
ggtggggcgagggggaaagagtaggggtggaggggtaggaggatttactcttccagcgagagctacgcgcatcccatcctccccctcccccctacccgggctccggcgtggaggcggggcgtggccggcctgctttgggaggggaggggcttcccttacagtgctgggctctgccaggacggctgtggggtcgccttacctcggggtatccactctgcagtcgaccagttcccgccaggagcaaagggtaggaaggagagcaggatctgctgtaggaacgcagctaccgcgccactatcacgaagaaacagcaggctcggggcacgagacgaactggagaccgcgctgcctagctgggtaacctgggaagcagagggtaataagtggcgccttaagacaaccctgtagcagcagcagtggcggccaaaggaggctgctcagggaacaagcggctgtagtagtctgtggggcgactggagtgaccgaagccaaggcagtttagtgcctctcgtgttcttattttttaacctctgactatgcaattctgaaacctcccccattcgggggaccagacagcctgatagacaccttccactctccttcctcccgccgtggtctcgagaacagaaggatctctccttaacgcctttcaccattaagaggaaagcgatggaggagctgagcgctgatgaggtgaggaggttgggggacaccttgagggattagttggcaactcgttagcgctttggacagggatggtattgcgccagtgctgtctggcctttgggcttggagaaggaacggagatgatattttccaagaataacgtgactccccgatagggtctctggttttgttctcctttattctgttgccttctttcttcattctgaactccatttgcttctttccgagtgttcttttagggtatgaacaagaggagagagcatcttgaggtgtttattcttttcttcagggtatgcgaacaagaagggcgagatttacatgaagttaaagtgtgtgtgtgtctgtgtcttcaggaatttaaagaacaattttggatggaatgagaatgtatggtgggtgaatatttttaaagaaagcat

SEQ ID NO: 5951 - DNA, 1224 bp, Homo sapiens
atttgagacggagtttcgctcttgttgcccaggctggagtgcaatggtgcgatctcggcttaccgcaacctctgtgtcctgagttcaagtgattctgctgcatcagcctgccgagtagctgggattacaggcatgtgccaccacgcctgactaattttatatttttagtagagatggggtttctccatgttggtcaggctgatctcgaactcctgacctcaggtgatccacctgccttggcctcccaaagtgctgggattacaggcgtgagccactgcactcggccaatgatatacttttaaaaagtaagcccaagaaaatgacaacttaggaaaaatatttccaacatgtataagagacaaattgtttagatcctaatttatgaagaactcttaaaaattaataagaaaaaagatggaccattatcattttcctttcctgattaactgatattttaaaacattttctcacccagcagctacagtgacattgtgcggatttataaaaggtaaaaggcttgtttgtcttttgtactttaagcatgtcccaggtggatgtggattcaggaattgaaaacatggaggttgatgaaaatgatcgaagagaaaagcggagcctcagtgataaggttggtaagcgatgaagcccttggtacaggtaatagaaataaacacatttcatgtcttgtatctgtagagtctgttagattggggccacccgaaatcaggaagtcctaggcaggtgattatttttattcttttgaggaaaaatgaataacctagattacccttattcatgaaagtgtaactcagtcctttgatctgataatatccatctgtttttggttcagggccatgattttatcagtaaatttaggttgtaataggaactaatttagagcaaattagaattctttctgttggtcttttgcttttttttttttttttttttttttttttgagacagagtctcgctctgtcgcccaggctggagtgcagtggtgcgatctcggctcactgcaagctccgcctcccaggttcacaccattctcctgcctcagcttcccaagtagctgggactacaggcgcccgccaccacgcccagctaattttttgtatttttagtagagatgggttttcaccgtgttagccaggatggtcttgatctattgaccttatgatccacctgccttggcttcccaaagtgtgggattacaggcgtgag

SEQ ID NO: 5952 - DNA, 1197 bp, Homo sapiens
catgtctcctcctaactggagagtttcttaacctttggttctattgccaaatgttagatgagggcttttgagatccatggtagaagtcacaaagatgagggctattttgtcagtcccttataacttttcccccaaagagtttgattacagcagtagcatagtctggctttaacctacagccctctgagtgatgccattctttttggttaaagtacctgtgatgtcccttccaatgcttaacacttggtaccagttcttagtgcttctggttttctaagttgccacctgcagtaagaagcagcccttcttaggtccctgaaatgttaccaaaagttactattgttggctttggagcaggtgaaacaagcagtcagggtggatcttggccgcatgggtgtttgtgctttgttatgtgtacagggatcctaacaggctttctgctgcagaaatgcaaactctgccaaaaataatcaagagataagaatcagaatttcttcttgtcttctctgaagtttgggagcctctggtggagcaagtaattgggattcctacagtgaccatttcaccattgaaacctgcaaagagacagatatgctgaactacctcatcgagtgtttcgaccgagttggaatagaggaaaaaaaagcaccaaaggtaatatgaaatggattaacttaaaaaaaaaaaagcctagttatttgtttgattatccccacccctggagcattcattgatttattcaatcagtaaagcaattattgagcatttgccatgtgccaggcacaatactaggaacttaggatgtgtcgatgaacaaaacagagatccctgccctcgtggaactcacattctaatagagacagagccaaggtttgaacctagatggcctggcttcagagtcctctcttgaccacactgtagctcggtaccgccagtgactcatatggccctgataattctactgctttgttataataaccaacattatagagcctctgtagattgccaaggactgtgccaggtcgacattagcttgtatcctcagttgctctgttagtgcagtggaacccggtataacataggcattcttttttcaacgtatgactaagcaaatgactctcagagagattaagtacttgtccagaatcacgtaaataataagttgcaaggctgggcttaaactcagtaagctaccct

SEQ ID NO: 5953 - DNA, 1180 bp, Homo sapiens
gagattgtgccactgcactccagcctgggcaacacagcgaggctccatctcaagaaaaaaaaaaaaaaataggctgggcgcagtggctcatgcctgtaatcccaccattttgggaggtcgaggcgggcggatcacgaggtcaggagatcgagaccatcctggctaacatggtgaaaccccatctctactaaaaatacaaaaaaaattagccgggcatggtggcaggtgcctgtagtcccagctactcgggaggctgaggcaggagaatggcgtgaacctgggaggcggagcttgcagtgagccgagatcgcgccactgcactccagcctgggcgacagagcgagactctgtctcaaaaaaaaaaaaaagtcactgtaaactgaatgagttcaagggcactcccaaacctacttatcctgccttcccctcctcacttactgacaccagccttcacccaagatgagtttctcagcagtttctcagcggtctctttcttgctcttcttgcctctgttcagatactctccccaggcgctttatgagccctgtactcaggatattgtgatgttccttgttgtgatgttgtgcaaccagaactacatccgaaacccatatttggtggccaaactggtagaagtcatgtttatgaccaaccctgctgttcagccacgaacccagaagttttttgaaatgattgagaaccatcctctctccaccaagttgttggtaccttccctgatgaagttttatacaggtaggttgctggaacacagtgtagcacatggcaggccaacttaggtaaggtcatctaaagctagtggacgacgttgctctaagcctgttacctaatatcctgctacctgtgtgtatagcctactaacctgtggcctgcagaggatgtacttttggttcttcttgccctgagtagttaggaataggacaaccattccacctactggtctctgatgattcagcaggaactactgaaagtcagatgattggcaccgagacccagggtatcaagagcacaagttggtagtgttatctgaatggaattatctggttcattttacctttgaacttacagcatttgttttttaacactatcctataacccactttccaaagtgtgggtgaaacagggagcttgttaaaaatgcatattcttggtccgggtgcgg

SEQ ID NO: 5954 - DNA, 1207 bp, Homo sapiens
catattggagatgaagcagaagggaaatttatcaaatgcagaaactacctactttatgacactctgtagcaaagacccaaaacactcttggccctttttccctgcagacatccagtccctccctctcatgtcccagtccttctggagtcttcggctcaatgagggaaagaatggccttttcttcccatttatacagagcgacaagcatcctctctcaggaagagccctcccatctggggcattaatcctcctttttttcttttctcagtgccagaactgaaagagcagattcaggcgtggatgagagagaaacagaacagcgatcactaaaccgttccgccgcccaccctctgctagacacagccaaggccaacgaggcaagcagaagcagcggccgcagcgaagctgccgttcatgtgttggaggccaaatgtggcaaaccaaccccaggcccacccagagcgagcaaacgctgagacctgaaaggacatggatgagaagaggagcccgcttcctgtacatatatttaagtgacaaacacggtcaaaagcttaagggacaggttttatggttgcttgtgtaataaagcatgtccttcgtatgtcacagtttggggcaacggaagtcttttagtgatggctaatgggtctgggcagcatcccttcatgaatttttttttaatccaatatccgttgatttgattgtgattagagaaccttggacattttgctgctaaagaatcttttttcccctctcccccttcctgaccctacttgcactgctgtggatttttttaagagaagcaaaaacaaaagtaaactcctttccctggccctccaaacatatattctgtgagataactgtgcctgctaccaagtgttaatcctgggatcgtatttttatatcatattcacatatttgtttttttaattggtgttagatgacatgattaataaaaaaggcaagatattttcagaatttgaatttcagttttttttttcttttgaaatgtccctttaagatttttttattctaaacaaaataaagaaaatcctgctgctctggtccttgtgataagcctctcttcggcatctgaggagcagctgcagcaaaatctaggggtgtaagtgtatcaggacttatgtgacttatattttggggagatgagggttgggttttttttttaatgctacgtgacagtttgaaa

SEQ ID NO: 5955 - DNA, 1393 bp, Homo sapiens
taattgagtctcttactaaataagtaactagtgccatgcttttgtgagctcttggtatggcccatattactttgttttttgtttttgttattgttgttttgtgatagtcttgctctgtcgcccaggctgcagtgcagtggcacaatctcagctcactgcaacctctgcctcctgggttcaagcaattctcctgtctcagcctcctgggtagctgggactacaggtgcatgccaccatgcctggctaacttttgtatttttagtagagacagggtttcaccacgttggtcaggctggtctcgaattcctaacctcaggtgatccacctgccttggcctcccaaagtgctgagattacaggcgtgagccaccgcgcctggcctgtttgtttttttaacatgatttttctctaagcttaaataccacaaggccaaagagaaatggtcataatttaaaccattattatattgttgaggtatccctagctattattatagcaaagtgggaaaaaagtgtttattctattgaagttatgtaatgatccgacattaatgggaatatagaggagtcctaattaattggtataatttcacaaagcggaatggtattccttggagagttaaagacattctctttagtaagtgtaaaccaaagggcattttctttattcctgcttctaattccttctagcccagtgaattatttctcttttcactggtaatgtgatgaatgggaattgtttattacattgaagtgacttgaagtgaccttttgtgctttaggtgcaggttgacactgaaaaaaaaacaaaacactgaatttttcacacctatgtctgcattaaaggctgttttactaccggaagttacatagacttcctgcagtcagctgctgtgccccagtgccttactggtcctttgtagatttgccttaatgatttgtacaaatgactgggaggcggggatgctgcctgtgtcctggtgaaccttaatgaaggggccgtcttaggcacagtgcaaaacaagcatttgtcctgtactgttagagccaaaattgtgatgagcaatactgataattgtccagtttatgtcatctttcccagattttaaaatctgttctagatattcttagcttgaaccacttttgattgtgaaatgtattaggtgttgtcccattattactgtaaaatgaagttttgaatcttcttgttaataaactgtggatttcccctctcaatttcttaaacaacaacaaaaaaatgcttgaagattgtctttgagtgtaagatctgccttttcagaaagggagtgttagtttgtaatgttaaaaaataaagacctcattcaataaaagttgaagtcatcttttaagagtgtgatttctctctatgtggga

SEQ ID NO: 5956 - DNA, 1182 bp, Homo sapiens
tgtgcctgtgatctgagccgccgaggtgggtggatcatttgagctcaggagttcaagaccagcctgggcaatgtggttaaaccccatctctacaaaaaatttttaaaaatcagctaggctggtgatgcatgcctgtagtcccaggtactcaggaggctgagatggtaggatcacctgagcctaggaggtggaggctacagtgctctgtgattgcatcactgcacccagcctgggtgacagagtgtaaccttgtccccaccgtgcctcccctcaagaagattttcgtatgtgcaaaaacactgccaggctaggaaaacaaagtccttaaatagcttaatttgaagttagggttattccctatgactgctaacaggtggccatatttttcagtagaaagttagtcacaagatatttgttgagcacattcgacctctttcccattgggtatgattgtatcgtctcatctctgaagcttgcttgctgaaaaccatttgtcaatggtttattctttctattcaggtgcagtttcagtttgttctgctgactgacacactgtactcccctttgcctcctgaattacttcccactgagatggaaaaaactcatgaggacaggcctttccctcgcacagtggtagcagtagaagtccaggatttgaagaatggagcaacacactattggtctttggagaaactcaagtatgaaaacattcataaaggctggttgttttatttaggaaataacaatgacctgctcaagtgagctccctccagctctcctctctctgaggacactgttgcttacttccctgtactttctaaatgctgttgttggccaatggtattaccatccatctgttttcttttaagtgaataaatgcactcctcacacactctgacatttgtagatatttaagtttaccctccatagaccctcttataaattttaaatattccagtttcatcatatttctgttacagatttggaacttatttattttttctatcctggacctcaggataatcaataataaacatggaagttataatctggcttcttttacatgtagtataatgaggtatttcccccgtctcagtgtatttgagatgtcacatacagttgacctacaatattcccccttatgacttttcacccggtagaggataggtggccattcttgac

SEQ ID NO: 5957 - DNA, 1102 bp, Homo sapiens
tcaagaataaaactgattctttttttttgagacggagtctcgctctgttgcccaggctggagtgcagtggtgcaatctcggctcactgcaacctccgcctcccgggttcaagcaattctcctgcctcagcctcctgagtagctgggattacaggtgcccgccaccacgcccggctaatttttgtatttttagtagagacggggtttcaccatgttggtcaggctggtctcgaactcctgacctcgtgatctgcccacctcagcccctcaaagtgctgggatgacaggcgtgagccaccgcacccggcctgaaaccgattctttattgactagtctcatttgagctgaggaagttgataaatctacatgaatagagtgcgaagcagcccatgccgtgttactactttggtatcattctctcatgccaaagacttgagtttataatccagcaagagctttttccctccctccccctgtgtagtctcactcaattcttgctaatttttttttctgctttagcggatgaagaagctcctgattatggctctggaattcgacagtcaggaacagctaaaatatcttttgataatgaatactttaatcaggtgagaaaccgtcaggaagaaggaaaaccctgtggaaagagaaagaatgttcagcattggagatcagttctcctgtaaaactgaaaaatacagggtgctggttgccacagagtagttcaatagaatatgggacatgtctaacaattatgaaggtaaaggtgtatagactcaatattcatattttattcattgcctttcctcagacagccctcagtccatataattttccagtcactattatttgttggacagataaacagaagtaaggcaactggggaaaaatacgtttttatactactttaccatgtatctgcccctgcctttttttcagagtgacttttcgtctgttgcaatgactcgttctggtctgtccttggaggagttgaggattgtggaaggacagggtcagagttctgaggtcatcactcctccagaagaaatcagtcgaattaatgacttgggtatgtagacatagtttactgtgcttggggacatttt

SEQ ID NO: 5958 - DNA, 1159 bp, Homo sapiens
acctctctgtttcaccattgctcaggcattcaggaaagtatctgctcactcccacttggtgagtcctcggccttgaggttgctgactctcaggcgttaggcagctggatgacttcccgcttcacgcagcaaaggccaggggcttgcgcgcctctgcagagttgttgctagggagacttgtgtcatcatccacaaccttgtttctcacttcctggttgggctcatctctgaagaacaggtctcccagcttcgctccttatcactgcattgtgaagaggaggaaaagtgaatcacggagagagaaaggaaaggatagaatcacaggctgcgtctgcacctgaaaagtgacccgcggaaactctatggcggattttttttttaactttcttcttcctgttaaaacataggtcactaactgtgatgttatttgttttctaagtggtatgtgagattttctaatgtagttagaagtttcattgtctgatggacacaatatgcccttccggttctattcaaaccagcaggatctgtcggtgcttagagatggctgcctggactggaatcaaatctaatttcagggaaatgaagatggaatttgaaggtcacttttaaaattaagtcattgatgctgctgttacagagtgtgacagaggatccatgtctgtgacacaggacggtgggaagcctgagagagagtgaaattatgtgatacactgaaatgacttttgtttttcttctaactcatacaaaactggtttggaaagtctttgctttggaagcgtcagacattagaacaggccaaactggactgtctgttcatagcgtgcctgaataagaaggcctcttagggagccagagggagcagagtggtcgtgtcctgcgtgctcttcaccctctggggcgcccctgctgcggctggcaggtgcagacagcctttgctggtccccagcacgtccagggtgggtgctcccttgcccgacagaaccatccccactgtgaggctgtgagagatttgtggcaggaactgtttatgaggctctagttgttgctgttgtggcgggaaagttaagaaacatagcccttaaggaaaccacctttatgtattttcttaaagcacgcctttaaataagcaaaaactttaaaaggcaggaaagagaatt

SEQ ID NO: 5959 - DNA, 1490 bp, Homo sapiens
gggtgcttgtggcagtggccgggcacctgagccccagctcgttgttaaacgtgctgacggcaaggggcaatggagtgagtttcccaactaagaaaccactattatatattttttcccttcagtcacatagacttcagacaactctcctattttttatggatttttcagctcatttcagatgaaggaactaagtcattgtgaactgtctcttgagatctaaaaacaagatgacttttcctggcacatattccaaagcaaagactttgttgcctgctgcttattgtctaatttacagggatatttaattttgtcaggtctatgtatatttatccagctatacttacttgcacagtggattggagagaaaggattctccagtgtgcacactcatcggtactctttctgcatttccctcgtgctgtgtcccgctcgggttccaatggacagtatcagggcttgtttgacttaggtctttcagttttcctttcggttcccttttaaaaatgtgattgttaacctgcctcttgaaagattcaaccgggtgtggtggctcacgcctgtaatcccagcacattgggaggccaaggcaggtggatcacctgaggtcagaagtttgagaccagcctggccaacatggtgaaaccccgtctctactaaaaatacaaaaagtagccaggcgtggtggcgtgtgcctgtagtcccagctacttgggaggctgaggcaggagaatagcttgaacctgggaggtggaggctgcagtgagttgagactgcaccattgcactccagcctgggtgacaaagcaggactccgtctcaaaaaaaaagaaaagattcatgatgctgctgctcccagaaggtttgctggatgtgtttacataggactctaacttgtgtgcactacagttgttcaccagggccagtgattcaccccagtgtgtggccagaccatgactgtgtagcaggaatgttttaatttgtgcttccttagtaaattgaaatatcagctgagagattatttgctgctgttattcaaaaggccatttatgaagttagtatttgagccccataagatctttaaaaagcctccaatcatttaaaggaagaaatcagagttgctataaaattcagtaaaaagctcatagccaaacggctgtgctcagatggaaagtctgagctgaggttggtctcttgccaaaccgtggctgttgtgtgttgttcttcatgtcttcgagttcattttttttcattctgcctattctggcatcagctcacttgaggagtccctcagccttcttgtatttaaggcatcgtcttagactttgtggctctaaagtacctgtctgttgagatttcaagtctcttgtcaccatcctcacacatgacaacaaaacccataatgcataagtggcctttttgaaccaagactttgcaaactgatctctcccccgtgaaggagttgagcacattagcaacaatgtacattaattt

SEQ ID NO: 5960 - DNA, 1051 bp, Homo sapiens
gctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactgatgctctttctccagattcttagtctcacctcggccacatggagccattatccccattggcagaaagatttttctttaaaaaaaaagactagaataacacaagaaaccacatttaggattatgcttcactcagaggaggcaggcagggaggacacaccaggggctttaatacactgggcatgttttctttctccaattgggcaatgggtacatggacgttcactgtaacgtgctttttctttcgtcttttttttttttttttttttttttgctcctggcaagctgtgcgtgacattctttatggctttttgtatgtcaaatacttcatactaaactttctagagaattaaactttaatgatgggctcagcttggtctgatttatttcctttcccacacctgtctctacttgctctaagccaggcccagggattttgaacaagctaagccggctccttaaactaggcttttcactttatcttacttactcagagaagataaaacctgccagtgatattgttgtgtggcctggggccagtgtgactgttccctgcagcggtttgacttcatgatgatttccctggagtgttaaagtcctaagagttgcctaagaggagcgagcagcgcctgtgcctcgacagctggtgtctacagtgtgacctctg

SEQ ID NO: 5961 - DNA, 1154 bp, Homo sapiens
gcctcagggtcttctccagcccttgccagccccctcttggcctctctgtccatttcctgttgccactcccttccccaagcctcagtcagagccatccaagtggagttcctcatggcacttcctagggccacttgtccctatcctaggaccttgctccccagcctcggccagcctctgcagccccggaaggcctggccagcccacttcccagcccccaggagctccagcaggtgcagggtgggatcgcttaggtccctcacggaacgccccgaagcgccggtcacagcacctaatccccgaatgtgacagcccgacacacacagccggaaggaagccctcatgaggcgacttgagagccagcgacctccctcgcggccgcatagcccaaactctgtccctgatagggcaccgagggtcctgggggggcatacggcaagcccacccaccacacagcctgggacctgccacaaaggctggcgagggtggacacacacacacgcacacacacgcgtgcacacacagcgcagccacatggaactgtctgtctgtccgtccatttagtgagctccttctgtgggccagaccctgtggtggggcttggggacagcgcagtggccacagcagcaggggctcggctcacactcactgtgtacaaaacaaaatgtgcctctccatggccctcacgggaggaatgggcgtgtcagagtctccacataggcgggaaggctgagggcagggccccccggctccatggtcagaaggggcttcactctaatgatcaccccctgccaactttccacatgccaggaaacccgatgagaggcctacccaggcgggaatggcaatacctgggtccacccaggggccgcatccctgaggtggacttgactcatacgcacagataaccgtcccctgatagacacagtgcctggccgtcccagccagatccttcccttgtagccagtggccagtacggatggctcacttggcccagacgagacagggtgactctagcccagccaggcccactgccagagaagggtcttctcagcccactcccaggccttccagtcctgtgaccctggcttcagggccttagacacttgcccaagccgatgcccactctacccaggttcgtccacatctccaagtct

SEQ ID NO: 5962 - DNA, 1215 bp, Homo sapiens
gcccccaacccatgccccatgcacctgcttatcgatcactgcctgtctggatgtgtctcgtgtcagagccctctggtgtgaacttgccgagtactgagaggccaagacgtgagacaattacaagcaggggagagaagtggtaccctgtgacaagaggcagctgtggagaaaggggcaggctccatgcccggggtgagcgccatctgggcaggaggcctggcttccagctgtgggggcttgggaagggcagagcctgggaggaatgattttgaagccactactatggagattaaggggatgagaatgtaaatctcaagtaaaaaggtaattgaatgtaatagcaaacactgctcgctctatgttaattttagctcttcccctggatacaagacgctgtattagtgttttattaccattttgtttgcactaataaaatagtaaaatttatttcaaggaagttgaaggatggttttacaatgcaaatttgaagaaattggacttttcatttatgcctctgctattttaaaccctgacgggtgtaaattagctacagggaccgagcagaccccactgatggggacttgggaggcgggagccctgacagaggttccagacgagctcagggcagaaagcagacagtatcacacggagaggctgcagcgggagggtacttgggggcctgattgggtgggacggggtgctggttgagagtgtgtcaggcatgaatgagtctaggtgtaggagggcatgtcacacacagagctggcagagagacacacgtggccacagacctcagggcttcatctttcctctcggccctttggcctccttcttgtcctgacatcgggcctctattaacctggtgaacccctaagggtaactgagcaaccctaccctctgtgcctagagagggcaggtagaccaactgctctgctcccgttcacacccgtccccttgaaaggggctgaagattgaagagatcatcggagcatggaggagagactttgagccaaaaaggaaccagggaaaaagacctaggccagaaaccagcccagctgaggtcccaccttctccctctcccttccaacccaggcatcctggagaaacttggccgggactttctcaatccccccgcatgccttcacattgagccgaatggtcccagacattgtagtgtccatgaatccaaaagctagagaactgaatttttaaaag

SEQ ID NO: 5963 - DNA, 1654 bp, Homo sapiens
gagtatattcagcagtatttttgacatttttctttagaaaaaggaagagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaatttgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataaaactgatttaaataatatgtgtctttgttttgcagccctgaatgcaaagaattcatagcagttaattccccttttttgacccttttgagatggaactttcataaagtttcttggcagtagtttattttgcttcaaataaacttatttgaaaagttgtctcaagtcaaatggattcatcacctgtcatgcattgacacctgatacccagacttaattggtatttgttcttgcattggccaaagtgaaaatttttttttttcttttgaaatctagttttgaataagtctgggtgaccgcacctaaaatggtaagcagtaccctccggctttttcttagtgcctctgtgcatttgggtgatgttctatttacatggcctgtgtaaatctccattgggaagtcat

SEQ ID NO: 5964 - DNA, 1219 bp, Homo sapiens
tttttaacatggaaattttagtcaatacctgggctgaagtatcagtgtttccaacctacctacccaaaaaaaggattcaaggttattcctcaatcagtactgccataatatataaagcacttacagagatcaataagaacaagtttaaaaacaaagagcatggacaggcagtttacagaaatgccaacagccagtatgaaaagagactggctttttaaggtaatgaaatgtaatttgagcagtgacattacactgggtgggcaaagatgactgtcactctcgtggtttatgtccccttgagtcaatgggtaaggctggaattaaactggcaagtggagaaatgacagcagcctcacctggagtctgtttttttgggtggagcaacaactgccatgtccacagtaatgatgaatgcttctcgagccacgtcgctgccaaggtcttcacaggcatttctaaaaatgaagaatccttgactgcagacacgcaagttaaaaatcactaattatgttctcgatccagggaatatagttaataacttttgtgtagactccatactgacctgcttccccacaattcatggaaccccaggacactattcctcccacaaaccacctctctgtttcactatctagaaacaccagtgcccctccgctgtcacctctgcagctgtccttgcccccactttctaagccagcacaaagcatgttagcagttacacttccccttggatagggtggcttttcatatgcagcagtacatttttgatggtcaacaatcggtatgtcgacatacattagatttctagcaagaaaacccctttgggttaatccccatccagatgcagttccaatgtcatctgtcctcataaaggattcagcttcttttcttggcagacaaataggcgtgatgttgctattgattacaactttgttattcaatttaatcagtgctatgtcattgtcaaagccagcatcatgagtataaccttcatgtataaaaacagcttcagaccaggcttgtgtataatgaggtgatagtcttttcagggtgcccattcgaatgtccagggcggatgcatcatgtttttgctcatagacggcatgagcagctgttaggacccagttgtcatataaaagtgcacctgctgctgtggttccacctaatatcaggacttgccaaggaaaatcaccaggttttgccttttgccctccatata

SEQ ID NO: 5965 - DNA, 1274 bp, Homo sapiens
tagagcggcctcccaccccccgaactagagctgtacttttcccttctcatttgttacctgccctctgaaacatggctcaggacagtaggcaggagccaggcgactgcccagattcacaagctggtgaccaaggagagtggggatctggcattgggacactgaggaccctgtgtcctcttcagcctcccctctgctctgaagtggtcagcactggagtgggggcaggttctagtcttgaacgaaggcctaggttagaggttcctctgctgtggtgccaatgagactcccccaagaatgggattcaggtgtggatcccccacagacctgggttcagatcctggctctggccacctggtagctgtgtgggtgacagtggccctggaggtcacagccagactgttcagtgtgtctccctctgtcttccccaggccccgccgaaagtctcttcaaggagtcctattaccagctcatgaagacagccctcaaggaagatggtgtcctctgctgccagggtgagccacaggcctggagcactggggcggggcggggtggggcagggcaggccctgccggatgctgatgcttaggggcccccaggcgagtgccagtggctgcacctggacctcatcaaggagatgcggcagttctgccagtccctgttccccgtggtggcctatgcctactgcaccatccccacctaccccagcggccagatcggcttcatgctgtgcagcaagaacccggtgagatgggggtgtctgggggtgggggttggggggaaggtgggcataaatagagatccctgcccctgccgggcgcggtggctcacacctgtaatcccagcactttgggaggctgaggcgggcagatcacaaggtcaggagatcgagaccatcttggctaacacggtgaaaccccgtctctactaaaaatacaaaaaaattagccaggcatggcagcgcgcgcctgtagtcccagctgctggggaggctgaggcaggagaatggcgtgaacccgggaggcggagcttgcagtgagccgagattgcgccactacattccagcctgggtaacagaggaagattccgactcaaaaaaaaaaaaaaaccctccccaggccaggtgcggtgtctcatgcctgtaattccagcattttgggagaccaaggtgggcggatcacttgaggtcaggagtacaagaccagcctgaccaacatggagaaaccccatcactactcaaaatacaaaaaaaaaaaaaattagccgggcgtggtggc

SEQ ID NO: 5966 - DNA, 1156 bp, Homo sapiens
cagagaacccaggtccccgactgtcactccgcccgcagtaagacctatggcaacgtgctggtgttggacggtgtcatccagtgcacggagagagacgagttctcctaccaggagatgatcgccaacctgcctctctgcagccaccccaacccgcgaaaggtaccccagtgtcccctggaacagtgccggacgaggggcggccccaggtgtgctccgggctcttcccagatgctgcctgcatggttgtcagagaaagtgctagcgaggccaggggcgtcccgcggaggggtgggggccgacactgacgcggcctcggaatcctagggcagccctggaaggaacttccaggaaaggggacaccggcacgaaagcgtttccgagggtagaaaaagatgaggcccgtgggtccgaggggtcagggggtctgcttcaggggcctgggggctcccagtcctgccagggcccctgccttgactgccccctcctcccaggtgctgatcatcgggggcggagatggaggtgtcctgcgggaggtggtgaagcacccctccgtggagtccgtggtccagtgtgagatcgacgaggtgagtgccggcgtagagccaggtttgagtcctggttctcccagcggccagctgtgccctgaaatggctgcacacccccgagcaaggcaggtagggcctgtttctccatctggaaaacacctggtcggggagggttcagtaggaaaaccagatggcagagggcctggcaggtggtgagggcacctgcgtggcgagctcttactaaaactgagctgattttttttttttttttttttttgagacagagtttcgctcttgttgcccaggctggagtgtgatggtgcgatctcggctcactgcaacctccacctcctgggctcaagtagttcttctgcctcagcctccggagtagctgggattacagacatgcgctaccatgcccggctaattttgtatttttagtagagacagggtttctccatgttggtcaggctggtctcggacctggcgaccacaggtgatccgccagcctcgtcctcccaaagtactgggattacaggcgtgagccaccacgcccagccgactaagctgatttttaatctgagccccaggcagggccccaagacagctca

SEQ ID NO: 5967 - DNA, 1175 bp, Homo sapiens
gggtcatttctcaaacttgtagttcactttgtactttactgggggatgatttctatattcctccctttttcttactattctcttgatccagttatacagacctatagaagagacaccatgccatttcatatcctccctggatgaactcgtggaactcaacgaaaagctcttgaattgtcaggaatttgcagttgacttggaggtatcttataaatgaccctgggtaaaatttttacatttttctgtgagttcacctgttggagaagtataaaattaatactaattgtaattttttttggtaaaaaattaatcatataacttagctttgtagctgacttttcaaaatcagtaaaggaaagtctaatataatctttgtttttcctcttctcccctccttctgtggggtttagcaccactcttacaggagcttcctgggactgacctgcctgatgcaaatttctactcggacggaagacttcatcattgacaccctcgagcttcgaagtgacatgtacattctcaatgagagcctcacagacccagccatcgttaaggtcagccagccttttgtaactcatgcatgtgagctcatacaagatttttagtgcttttcagtgtactatttcattatttcaacctagaccagtcaagttgggaggaatcatgtcatttcctaactagggtacagtgctaaatggcttttgtttctaaatccctgttagaacagctaagacttagcttgttaccgcccagaaaaacgttaaatcattttaatgactactgcagtgagccccagccatcaagattgtttggacttgatgactgtactgaagctactagagctgctttcatgtgtctcattggttgataacagtttcagacttcaagcgtatggaatcaggagtgtagaaagctgtgactgaagacaaaagaaacatttaaaactgcatatatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcagttttggatctttcctgctttctattatgggcatttagtgctataaatttccctc

SEQ ID NO: 5968 - DNA, 1223 bp, Homo sapiens
agactgcagtgacccccataattgtgccattgcactccagcctgggcaacagagcaagacctcatctcacctaagacctactgaatcagatcctctagctgtggagcccagcagtctctggtttcatgagctgtccaggtgattctgacgcccactaaaatatgcaaatcactattgtgggccattgtaagtactttggcttttactctgagcaagactggaagtttttggtggactttgaacacaggaaaaataagatctgacttaatatttttaaatgataactcaatgccatgtgggaaaataggctgcgggggcaagggcagaagcaaagatctgttaagaggccaccatcataaaccagatgatggggacttgaactaggattataacgggagatgggaagaaggattcttttgaatatcacagagctagccacaaacccagaagaaatggtcataatgtagttgtataatattttttcctctactttttctccactctccaaaatgatagtttctcatctcttccccctcctgttttagtaccaaattttcattccaatggtgaataaagttctggtgcgacaccgaatcaatcatcagcgctatgatgtgctcatctgcagaattgtcaaggtgaactatacttcttttctgttctgaagtccctgttgtctttactacttgatattcttgtaatcttggctatgggagtttgtgtagctttttggctgtaaattagggattggcaaacttttttccagttttgtagactatgtggtctcttttgcagctcctcagctctgccactacagcctgagagcagccatacacaatgtgtaaatgatgagcctggctgcattccactaaaactttatttatggacacctaaatttgattctctcaattttcatgtgttgcaaaatatcaatcttcttttgattttttttccccccaaccatttaaaagtataaaaacccttcttagctcttgggctatataaaaacaggcagagggctgggtgcggtggctcccgccttgggaggccaaggcaggtggattgcttgagcccaggagtttgagaccagcctgggcaacatggtaaaaccccatctgtacaaaaaatacaaaaaattagctggtcatgatggcgggtacctgtggtcccagttaccgaggaggctgaagtgggaggatcacctgaggctgcagtgagctgtg

SEQ ID NO: 5969 - DNA, 1196 bp, Homo sapiens
ggatcatttcctgaacagtgagcacaaggagatccgcatggaggctgcccgcacctgctcccgcctgctcacaccctccatccacctcatcagtggccatgctcatgtggttagccagaccgcagtgcaagtggtggcagatgtgcttagcaaactgctcgtagttgggataacagatcctggtaaggcttgccagacagaaggaatctaggggagttaaggagcttaggacaattgggagtagccagtttcattacatggcctctctagagttcttcggctcaaaaagctgatattcagctatttctctgccaaggcgtgttaggcatggctactgtagcctttggtgtaagataatctacctttaattcttttgtcttttactcttgtgagtagagaaaagaatgacagaggttagatgagaaaaagcatctggaatcttcccactacgctgatggcagtggaggtagaagctgggaagggctggagtgatgggatcatgaggaaatgttcaaaggctccattgctcttgcagaccctgacattcgctactgtgtcttggcgtccctggacgagcgctttgatgcacacctggcccaggcggagaacttgcaggccttgtttgtggctctgaatgaccaggtgtttgagatccgggagctggccatctgcactgtgggccgactcagtagcatgaaccctgcctttgtcatgcctttcctgcgcaagatgctcatccaggtaaccgaggtgatggccagacccacaggcagggaagacaggactctcgctgtgagaactgcttgaggaagcggagttgaggacaaggatgggggagaaagattgaggtacctggtaaaagccgcatttgtctgcaaaggtccaaatgtttccctggctttataatggcagttccagtgctcatcacctcatgagccctttgtcaatatgactctaaggtggttcagagtcctctcatgcagctctttctttttcctggcaagtcaccagtgatcccatttcttggccctctttgcttgctgggttgatctgctgcagatggtgtcagacttcccagcgcctccctatccttcagctctcctgcttttcttgctggtgccaggtcaagcacggaggccgttgttcttcacaaaaataaccagtgtgagaccgtttccactatttgttctaatagt

SEQ ID NO: 5970 - DNA, 1108 bp, Homo sapiens
ccacgacatgtctccctttcttagaatatattaaagtcagagtctctgaggaaggaatgtgatttggcagtcagggtactaagcatgggtgggaactcctgccttataaaaattgtttttgtgttcttaaagataatatgttgtttttctgttttttgttttttccattttatggggaatttaaaaaccattcttgtatcagaaggtgaattaggcgcatggtctttgttttattaataatttccactagagggtgttctcaggtcactttgcagtgaagtggacttagttcctccttgttctgtacaaaatgtctccagactttgtaaaggagctgcccagtttggcctcctgtcccgaaaagaccctaataactaggcagagtgttgtcctgctttcttcgtctcgtaggatgtgctatgattggtgccaggcctcactaacacaggggctacctgtctcttattctcagcacctgtgtcctgagatacgctgcctgagacagagagagtccctcattaacagcctgtgtggctgtcagctttttgcctaaattgtgattcagatgcttttgttctctctcctttcacttattgccacagttgaggaaaagtgtcagattaccctgcagcaagacaagccaaggactgggagggaaaaaaaaaccactctggaggcaactgagaaaatcactgcttttggataggaatcagtagggtggctgttttccctttgttgaatctactagagtgacaggaaggactcccagccctttcagtaactatcaggagccctgaaacggtagaggcactgccatccttgtgggatactcaaagcccacagggcttttccctccctattgcatcttctgatgctccccacacctaccctccacctctccacctctgtggtgttcccatttgtgtgtttcccatctgtggagccagactgagcaatagcttagcagcgagtcagggacagctgccactttccacagagccacaggatgggcagagcagggacccagggaatgaatagccagtggacaaacagtcttgagctctgttcagccagagtgatgggccctgccagttaaggggctgtgtct

SEQ ID NO: 5971 - DNA, 1194 bp, Homo sapiens
acccccgcgacccgtggtaggagcccggacccaaacaaaggcgggcggcgaataaaaggcggcggcggagcggagtgctcgggttgcgagctgaggactgggattcgcgcgcagcttcccgcggtctgcttgccctggagcggagggggagccccagcctcctgcggctccgagaagcttccccctgcgacttccgcgaggagacgagtctgcgcagcgtggtggccgccgccccccgaccctctgcgcactctctcccgcgccggcggctcagcctagccccgttcggccggccgaggtgagtgcacggccgcggggcgccatccgggcttggtctcggggctgggggatgcattgctaggaggagggggaagtcctccgcgccgtccgcaccccgacctgcttggcgccgcgcgcgaagttctctcgctctccagccagcccgggatgcgggcctcggagccccccgggaaagacggtcaggggtggacagaacccaagcttgccctctacgaccgggccccagctccgcaccatctccccgcgggactgcagcattcttggtcggccaaggggagttggatgttggatgtccaggaacggcaaggcttccgacctctggcccctgcttgtcccctctgagggatatctgggtccataaaagttgagcgtcagtctgaagccgcccttggatcgggctctcgcccatgctagagcggagggaggggacagagtaaggctaatgaccccctccacccactccctacctagcgtactcgtgctctcggagggacatttccccgattaacctggctgcaggtccggccggggagggcgcgtgggggcttggggcgggccgggccagcgatggatccgcgcgcgcgagggtccccaggctctgccgagaacgcgaacgagggtggaggtggagtgggcagccgggcagtggcggcgctgagggtcgggaaagattcccagcgcaaggggcgccaagtcccgggagccaaccccaccgccgggagaacttttcccaactccctggggaggccggcagcagggctgggaaggcgcctccttgggggcttctcttctcggcctctgctccacggccggcgccagcttcccgctgtcccccactcactgcgagactgcgcgcaggtctccgtcagcccactccccgggtcagcaccgcgg

SEQ ID NO: 5972 - DNA, 1529 bp, Homo sapiens
cagctaatttttgtatttttagtagagatggggttcaccatgttggccaggctgctcttggactcctagcctcaagtgatctgcccaccttggcttcccaaagtgctgggattacaggcataagccactgcacctggcttgcattctaaaaggaccatgttggtggcttggatgggggcagtggtgggggtggtgacaagtggtcaactcttggacactctctgaaggcaaagcagcaggacctgtgatgggctggatagaggatgcagagacaagcccgggactgtgaggtgtgggcctgactggaaggctggagctgccgctagccaggagggaggacgtgggagggcaggtccaggatgagggcaggtccaggataagcccaggacttcagccatggacgggctgcactgtgctaacgaggctttccaactggacattctcaccactgtgcaacttttaaaaggcccatgtctgtagggacttggaagtagggcaccctgcaggtttatatagtgtctgacattcttgaggctgtcaaccacaggaagcaaattcctcttgcctctggtctcctgctggagagggcttgtatcagtctgttctcatgctgctgataaagacatacaagacggggtaatttataaaggaaagaggtttaatggactcaaagttccacatggctgggaaggcctcaccattatggtggaaggtgaatgaggggcaaaatcacgtcttacatggaggcaggcaagagatagagcccttgcagaggaactcccatttataaagccatcagatctcatgagacttattcaccatcaccagaacagtatggggaaccatccccatgattcgagtatctctacctggccccggtcttgacacatggggattattacaattcaaggtgagctttgggtggggacacagccaaaccatatcaggactgaagtcacacttgtccagtttgcaaatctatttcttgttttcacaaagctgagccttccacatgaggaagccagagaaattgccccacaggaggtcactgccttctcctgttggccagaactggaccagagctgcagtacctacagggccccacctcaggccggttctcagagtctccggaatggcctggaaatgccaactctcacactgtgtctctaaacgggctctggagtcagtgagccttggtttaaatcccctatgcactctgtaactggctgtgttaagagacactatctcttaacctcactgtgcctcagcttcctcatctgaaaatggggacaataatagtgcctgactcgggtattagtgaggactgaaaatggtgcaacatcagtgtttaataaatgttagatctcattatctgtacgactgtgtaatcatttagagagggaaggagtccaggtggcctgtgactggtaccagccggtcgagggcaggagtgacctggggcctcccaccctggctgacctcattgctgccagacctgtccccaggtgaggggcaccagaatgtttctc

SEQ ID NO: 5973 - DNA, 1489 bp, Homo sapiens
gacttcctggggccccgctgggatttcttcgctgctctagctggcaggacacatcccggcctcttccacccattcccccatgtggctgaagacattccaacaatggggtgggcccataatagttagccctcagtcagttcccggagcacagccctgggagggggctatttctctccccactgaaaacatttcaaagctgagttacttgtctgaggcctcatccctcggaagccgtctgactccagagtctgagcccccggctagtaccctatagagagggggctctccaaaggggctgctggggcatgtgtgcctgtggcagaaaagaggagaccctggaattcagcaccctgggtgccattcccagcgtttagtttctagaggcctcagtttctccatcagcttatgggatccttgtctttactgacaagaatggaatagaaatgtaaaagtactctgaaaagcaattgccctgtaacttatctagaaagaaaagaccctgagactccagaatctgctgttgccatagccccatatgtgtgaattctgcaactagccaaggctagttcctttcaattccatttaaaaaacaaaaaccagcaggtgtggtggctcatggcgtaatgggcctgcccaatgctttgggaggccaaggcaggtagatcgcttgagcccaggagtttgagacaagccctggcaacatagtgagatcccatttctacaaaaaaaaaaaaaaaaaaattagccgggtgtggtggcacacgcctgtagtctcagctactcaggtggctgaggtgggaggatcgtttgagccctggaggttgaggctgcagtgagctgtgatcgcaccactgcactctggcctgggcgacagagtgagacactgtctgagaacaaaaaacgactgaaaaaaaaaatcaccttagctttttctcttagaatcttctctaaaacgtattctttgtggcattctgaaataggattcatgatgatgcctgttgatcttagggacactacctcacctgccagtatctttggggctgtgtccttcaaggacatgtccccagactgctgtgcagtgtcattttttgtgtttggtttggtggtggcttcttcccccttgctaggctatcaacctcttatcaccacttgttggtgtcagaactaactgcttctggtctggagagggactgaccgatgcctttgggtagagagaattatgaaagaaattttggtatttttctactttatattttctgaggtttctgtaataagcatatttcacttttccaataagaaaaaaaaaaacttggcctggcgcggtggctcacacctgtaatcccagcactttgggaagtcgaggtgggaggatcacttgagttcaggagttcgagaccagcttgggcaatatggtgaaaccccgtctctactaaaaatacaaaaattagccaggcgtggtggcgtgcacttgtagtcccagctactcagg

SEQ ID NO: 5974 - DNA, 1097 bp, Homo sapiens
ttctctttgccctagatcgtggggatcatcacacggcacaacctcacctatgaatttctgcaggcccggctgaggcagcactaccagaccatctgacagcccagcccaccctctcctggtgctgcctggggaggcaaatcatgctcactccggcgggcacagctggctggggctgttccggggcatggaagattcccagtcacccactcactcagaaagccgggagtcatcggacaccttgctggtcagaggtcctgggggtggttttgaaccatcagagcttggacttttctgacttccccagcaaggatcttcccacttcctgctccctgtgttcccaccctccagtgttggcacaggcccacccctggctccaccagagccagaagcagaggtagaatcaggcgggccccgggctgcactccgagcagtgttcctggccatctttgctactttcctagagaacccggctgttgccttaaatgtgtgagagggacttggccaaggcaaaagctggggagatgccagtgacaacatacagttcatgactaggtttaggaattgggcactgagaaaattctcaatatttcagagagtccttcccttatttgggactcttaacacggtatcctcgctagttggttttaagggaaacactctgctcctgggtgtgagcagaggctctggtcttgccctgtggtttgactctccttagaaccaccgcccaccagaaacataaaggattaaaatcacactaataacccctggatggtcaatctgataataggatcagatttacgtctaccctaattcttaacattgcagctttctctccatctgcagattattcccagtctcccagtaacacgtttctacccagatcctttttcatttccttaagttttgatctccgtcttcctgatgaagcaggcagagctcagaggatcttggcatcacccaccaaagttagctgaaagcagggcactcctggataaagcagcttcactcaactctggggaatgctaccattttttttccaaagtagaaaggaagcacttctgagccagtgaccactgaaaggtatgtgctatgataaa

SEQ ID NO: 5975 - DNA, 1097 bp, Homo sapiens; identical to SEQ ID NO: 5974

SEQ ID NO: 5976 - DNA, 1129 bp, Homo sapiens
gttcccatcagtttagcccagagatagacagtagaatgcaaatacctccctcccctaaactgactggacggctgccaaggaggccccaaacccaggccccatgcaaaggcacgtggtttccttttctcctctctctgcatctgcgctttccagataagcccaaagacagcaacttctccactcatgacaaatcaactgtgaccctcgctccttccatttctgtccattagaaaccagccttttcagcatctcacccattagcagccccatcacccagtgatcagtcgcctcagtaaagcagatctgtggatggggagcctacgggtggtaagaagtggtgttttgtgtttcatctccagcttggtgttccatggcccctaggcgaggtgatcagggagtggggccaatgggcccccggccctggctttgggaccttgtgctgagggatgatttgctcctgaccttgattaacttaacagttcccagctggaagggacactttcaggacccagtccactgtatggcatttgtgatgcagaattatgcactgacatgaccctgggtgacaggaaagcctttcgagaggcccaaggtggcctcgccagccctgcagtattgatgtgcagtattgcaccacagctctgcggaccttggccattgccgcagtcgcagcttccttttttctgtttgcactgtttgtttgtatgatgttagctaattccactgtgtatataaattgtattttttttaatttgtaaaatgctatttttatttgaacctttggaacttgggagttctcattgtaaccctaacatgtgagaataaaatgtcttctgtctcctctgtctcctttagccttttgtctccatgctgctttctttctttctttctttttttgagacagagtctcgctgtcacccaggctggagtgcagtggtgccatctcagctcactgcaagctccgcctcccaggttcacgccattctcctgcctcagcctcccgagtggctgggactacaggcgcccaccaccatgcctggctaattttttgtatttttggtagagatggggtttcaccatgttagccaggatggtctcaatctcctgacctggtgatcctacccgcctc

SEQ ID NO: 5977 - DNA, 1359 bp, Homo sapiens
gaatcacttgaacccgggaggcggaggctgtagtaacctgagatcgttccactgcactcaagcctgggcaacacagtgagactctgtctcaataaacaaataaatacatacatacataaagctacaagactggagagagaaaggacagagaggagaagtggcctgagactggcctcagcactggtgactgatctggcgcaggatgtctgaccatagggttggtgccaagtcctggctaagtctgtgttcctctgggctctggcaccaggccccgctgctttttaacaggattctagatttcaggcccacaggctcaagttggtcgtgtaaacaagacaggctgactttcttctatactttagggagatgggcaccactgtctttatcattaaggcacaacacctcactcttctgctgcccttggtctttatttcgtatgctctgcctcccagctgtccttcccccttaacatgccgctttcatggtgttgcaggagtggaaatgaagaagatcactgacacccacacgccgtctggcctcaccgtgaacctgacgctctattacatgctctcctgctcgccagccccactgctcagcccctccctgagccacagggagcgagaccagatggagtcgacgctcaactatgaagatcactgcttcagcgggcacgccaccatgcacgccgagaacctgtggccggggcggctgtcctccgtccagcagatcctgcagctctctgacctgtggaggctgaccctccagaagcgtggctgcaaggggctggtgaaggtgggtgccccaggcatcctgcaggggatggtgctcagctttggggggctgcagttcacagagaaccacctccagttccaggccgaccccgacgtgctgcacaacagctatgcattgcatggcatccgctacaagaacgaccatatcaacctggccgtgctggcggatgccgagggcaagccctacctacacgtgtccgtggagtcccgtggccagcctgtcaagatctatgcctgcaaggcaggctgcctggacgagccagtggagctgacctcggcgcccacgggccacaccttctcggtcatggtgacacagcccatcacgccactgctctacatctccaccgacctcacacacctgcaggacctgcggcacacgctgcacctcaaggccatcctggcccatgatgagcacatggcccagcaggaccccgggctgcccttcctcttctggttcagcgtggcctccctaatcaccctcttccacctcttcctcttcaagctcatctacaacgagtactgtgggcctggagccaagcccctcttcaggagtaaggtaggaagccgc

SEQ ID NO: 5978 - DNA, 1182 bp, Homo sapiens
gtggcggcgcgcgcctgcagtcgcaggcactgggcaggttgaggcaggagaatcaggcagggaggttgcagtgagcagagatggcggcagtacagtccagcttcggctcggcatcagagggagaccgtggaaagagagggagagggagaccgtggggagagggagagggagcgggagagggagagggccatctcctttttcaaaatcaagaaactgagatttgaaaaatagtgacgtgtcctctgctactcggctgatgagcagcagagtcaggatctcttgtgcccaaaccagggtgcacagctctgtgctgttgcttctcaggccgtggtgatgctgagtgtgtttggttgttatgattattcagtctcagcagggtgtaggagattctgccaaaccaggcctggctcagggcagagctgctggcagggatatagacaggcccagctgctccctactgtgggtgggctaagccaccagtggcatcttgctccacacaccccaactgggtcccttctctctcctccccagggaactgtctgggacctttgctcatctgtgtcagcaagttgacgtcacccgggagaacctggagcaggaaattgccgccatgaacaagaaaattgaggttcttgactcacttcagagcaaagcaaagctgctcaggtgaggctggcccgtgtggccaaaggttagggctccagggtgcagcccaggcacactggggctcagctgctgggcttgcgtcttgggtgtggacacaaatttttctggtggggatttagctcattcgtgttagatgtgtaccatgggctgggcacggtggctgacgcctataatcccagcactttgggaggctgaggcaggtagatcacctgaggtcaggagtttgagactagcctgaccaacatggtgaaaccccgtctctactaaaaatacaaagattagctggtcgtggtggtgtgtgcttgtaatcccagccactcgacaggctgaggcaggagaatggcttgaacccagaaggcggaggttgcagtgagccgagattatgccattgcactccagcctgggcgacaagagcaaaactctgtctcaaaaagaaaaaaaaaatggatgtgtaccacgtacctcatggatgccagatggtgctggaggctcaacaagacacagcgtcgctgcctt

SEQ ID NO: 5979 - DNA, 1236 bp, Homo sapiens
tggtaccaaggagttaagttgaggctttttccagctttctctggttcatttgattgcttgataaggcctcaggatctcagcattgcacaatgcctcatggaagcctttgagggtatcacacagacacccccaccttcctccagcctgtgcgcacctgccctccttgcagcccagcacacctgcaggtgtaagggacgattggagtttcttcccagagagtctgtcccagaaggactgtggcttgtgtgtgtccatctcgcctgttggctcagtgcttcatcccatttgcagagcctcagacacgtcttggtggtgaggctcagttacccctgggcttaggctgaggcgggccctgtgctgggggtggtagaaaggatgctgctgaggcagctggaggagtgggagtagctcagaggggagggctgttggatgtatggggagctggcagagcaggtggcagtcactgggacaaggagggacttgcctctcttctcattattgtgtcctttgctttagtgtcagtcctggacttgtgcaggcctgttttgtgtagatctgttttggaagatggcatggtctaggtggttgaaggatgtagtagaaggatggatggtggaaggtggggacgttggtggctggctgaggtgcatgggccccacacaggacagctggagaatgggccgtccacttggcctcgttctgcgaggggctcatgggtctgagagcccccacccactaggcttgattgcatccctgttgtgccctttaagagacatgtttccaccccacccccaaccttgtcccaagtgccctggactaaatttcctgtgccagtgactgcagttggccaagggacaatgtggaaaacccagtgtccatctttccaccctccctgatctccagaaccttcgactgacccccttgtctttatgctgatgttgagttttgggattgttactggttgaagtgggggcagatgcctgtcaccaaggtgttgactgtgtgagaaaagcagtttgggtgacaaatcctgtgtggcacaagttggatcgcttcctagaaataagcaacacctctcccaaaaagcagcccacaaggcaggggcccagcagcccagccatcactcatctttgaggaaatgagttggtagcctctgtgcactgtttggtggccacatcacaggtgatgtcctgttcacatacctgcttgtatttaaagccctcagtctgtcctgtt

SEQ ID NO: 5980 - DNA, 1245 bp, Homo sapiens
gaccctgtctcttaaagaaaaaaaaagtcagactgctgggactggccaggtttctgcccacattggacccacatgaggacatgatggagcgcacctgccccctggtggacagtcctgggagaacctcaggcttccttggcatcacagggcagagccgggaagcgatgaatttggagactctgtggggccttggttcccttgtgtgtgtgtgttgatcccaagacaatgaaagtttgcactgtatgctggacggcattcctgcttatcaataaacctgtttgttttacacgtcgacccctggctctgcctggggtctgggcttgggtttgtccatgctcctacttgtctgccacccctgtgtaaggggagatggcgtcacggtccctggagtctggctggcccctgttgtgactggaccacagagggacccctgttacagccgccccctcaagcctgtgaaccataagagaacttcctgctcgggaccacacagctggctgggttccaagtgtgccctggtctcatgccttcatcctccaggtctcctgggcctgctctcaggaccgggatggggtctctgcagatccctagcagcctaggcagccaggctctgccctcctggggaccccactcggggagagtggttgcccctgggatactcagaccagtacagggttttgggggcccagaggacatccctgggcccaggtaggaggttagaacagggttctggagatgacctctgacctcctcctgagggatgagcagcagttttccagaacaaaggattgcagggaactgtcaggcaaaaggagttctgagtttaaaggccttagcctggccagcatggtgaaaccccatctctaccaaaaatacaaaaaattagctgggcatgacggtatgcacctataatcccagctagtcaggaggccgaggcacgagaattgcttgaatcaaggcaacagaggttgcagtgagctgagatcgggccactgcactccagcctgggtgacagagtaagagtctgtctccaaataaaataaataaataaaatcaattaattagaagaaagccttggaggggagagagaccttggcctgtgtattggttccactgaccccctgggtcaccatcgtcactccagctcctgtgactccctcagtgggaccattttcattcttggtgattataggatctgtgattgatggaacgccccgcctcctggcttctcgccctcctctcctc

SEQ ID NO: 5981 - DNA, 1182 bp, Homo sapiens
taaatttggagtagtattctggaaagtgaatgtcattaaagatttttagtagttgctttgcaaagcctagtgtcctccattgtatgcatcccccaattggtatgtgtccagtccttttgagaaccactcaacctggggcagacagtataggtaactgcatttaaaatatttaaatttatttatatttaaattattggccaggcacagtggctcacgcctgtaatcccagcactttgggaggcctaggtgggcagatcacttgaggtcaggagttcgagactagcctgaccaacatggtgaaaccccatctctgctaaaaatacaaaaattagccaggtgtggtggtacacacctgtagtctcagctactcgggagcctgaggcaggagaatcacttgagcctgggaggcggaggttgtgatgagatgagatcacaccactacagaccagcatgggcttatctaattgtatttaatttaaatttatttaaagtaattcaaatagtaaaaatagtgccaagactttaaaactcttctcctgcttttaactccttctagtttgctggaacattatcagatggcttagggaagacgatggacaatcggcatcagtcagagcgggagtacatcaggtaccatgcagccacaagtggtgaacaccttgtagccggcatccatggcctggctcatggtaagtcatgggtgacatcaggctctgctgctgctggtcctcagaggcgcctttgtatcaatctgattgcagctataaaaaaagaaaggtgggctgggcgcggtggctcatgcttgtaatcccagcattttgggaggcctaggagagtggatcatgaggtcaggagtttgagaccagcctggccaacacagtgaaaccccgcctctactaagaatacaaaaattaggccaggcacagtggctcaatcctgtaatcccagcattttgggaggtcgaggcgggtggatcatttgaggtcaggagtttgagaccagtctggccaacatggtggaaccccatctctatcaaaaatacgaaaattagacaggcgtggtggtacatgcctgtagtcccagctactcgggaggctgaggcaggagaattgctcgaaccctggaggcagaggttgcaatgagctgagatcgtgccactgcactccagcctggcaacagagc

SEQ ID NO: 5982 - DNA, 1203 bp, Homo sapiens
catgtgcctggttcacaatgcgtgttcactcctgaagtccctgccacctctgccagaaagggacctgctgaattgtatagccctgcagggccaggtgccatactcgattagcagagcaacccagaaagcttgggatttgggtgctgctgaataccactgcaagctgttttcctttctaagtcacactttacagagcatagttgtcatttgtctctgtgtacgtatttgtaaagcatttggagatcccaagcatgctgactatagctctttaagtttgtgtgtgtgtgtgtgtgtgtgtgtgtgtgtgtgtgtgtgtgtgtaggggtggggggcgcggggcaaacaaacctaaatagaaaaataatgagaattacagtttcgaatttcagttttcaccttgtatttttcttttctctgtcgcttgttttgtttttatgaaatgctttatatagagtacttgcatataatgaaaaagaattatccttaaaagttaaaaatggaggcattttaaagatactcctattttaacaaaagttttttacttttctccattttcaaggtgtattacccaaatttgggatggatgtgcattgatgccactgatccagagaagggaaactggctgcgatatgtgaattgggcttgctcaggagaagagcaaaatttattcccactggaaatcaacagagccatttactataaaactttaaaggtaacagcattagaattaatttactgttagttacgctgcttgtgttttcctttttctttttttgagacggtctcattctgtctctcaggctggagtgcaggggctccatcacggctcactgcagcctaagcctccccagccttgggcgatcctcggacctcaacctcccgagtagccaggactatgggcacatgccaccacacccggctgagttttgaattttttgtagagacagagctttgctatgttacccaggctggtctcaaactgctgggctcaagcgatctacctgcctcagcctcccaaagtgctgggattaccggcacaagccacaatgcctgggcctgcttatatttttctaatgctgtccttagttgtgactgacaatgactttgcagacctgggagggattatattgggaagtgctttatccacactcttaaggttctgtgttttaatatatggttacctgtgtgtgtcatggagctaaa

SEQ ID NO: 5983 - DNA, 1130 bp, Homo sapiens
atcattcagattgttcaccaagtagctggtttcccatgcttcacttccatgcttctgcttccatgtgctttctaggtcctaaagaagacgaagagaagccttcagcctcagcacttgagcagccggccaccctccaggaggtggccagtcaggaggtgcctccagaactagcaacccctgcccctgcctgggagccacagccagaaccagacgagcgattagaagcggcagcttgtgaggtgaatgatttgggggaagaggaggaggaggaagaggaggaggatgaagaagaagaagaagatgatgatgatgatgagttggaagacgagggggaagaagaagccagcatgccaaatgaaaattctgtgaaagagccagaaatacggtgtgatgagaagccagaagatttattagaggaaccaaaaacaacttcagaagaaactcttgaagactgctcagaggtaacacctgccatgcaaatccccagaactaaagaagaggccaatggtgatgtatttgaaacgtttatgtttccgtgtcaacattgtgaaaggaagtttacaaccaaacaggggcttgagcgtcacatgcatatccatatatccaccgtcaatcatgctttcaaatgcaagtactgtgggaaagcctttggcacacagattaaccggcggcgacatgagcggcgccatgaagcagggttaaagcggaaacccagccaaacactacagccgtcagaggatctggctgatggcaaagcatctggagaaaacgttgcttcaaaagatgattcgagtcctcccagtcttgggccagactgtctgatcatgaattcagagaaggcttcccaagacacaataaattcttctgtcgtagaagagaatggggaagttaaagaacttcatccgtgcaaatattgtaaaaaggtttttggaactcatactaatatgagacggcatcagcgtagagttcacgaacgtcatctgattcccaaaggtgtacggcgaaaaggaggccttgaagagccccagcctccagcagaacaggcccaggccacccagaacgtgtatgtaccaagcacagagccggaggaggaaggggaagcagatgatgtgtacatcatggacatttct

SEQ ID NO: 5984 - DNA, 1229 bp, Homo sapiens
aaaacttaaattactatattgatggtaaaattcaaactaataacaacactagtaactgtgatgtgattgagatggagtctgcttcggcagatttgtatggtataaattgtctgctcactccagttacagtggaaattactcaaaatataaagaccacacaggtccctgtaacagaagatcttcctaaagagcctttgggcagcacaaatagtgaggccaagaagcggagaactgcgagcccacctgcactgcccaaaattaaggccgaaacagactctgaccccatggtcccctcttgctctttaagtcttcctcttagcatatcaacaacagaggcagtgtctttccacaaagagaaaagtgtttatttgtcatcaaagctcaaacaacttcttcaaacccaagataaactaactcctgcagggatttcagcaactgaaatagctaaattaggtcctgtttgtgtgtctgctcctgcatcaatgttgcctgtgacctcaagtaggtttaagaggcggaccagctctcctcccagttctccacagcacagtcctgcccttcgagactttggaaagccaagtgatgggaaagcagcatggaccgatgccgggctgacttccaaaaaatccaaattagaaagtcacagcgactcaccagcatggagtttgtctgggagagatgagagagaaactgtgagccctccatgctttgatgaatataaaatgtctaaagagtggacagctagttctgcttttagcagtgtgtgcaaccagcagccactggatttatccagcggtgtcaaacagaaggctgagggtacaggcaagactccagtccagtgggaatctgtcttagatctcagtgtgcataaaaagcattgtagtgactctgaaggcaaggaattcaaagaaagtcattcagtgcagcctacgtgtagtgctgtaaagaaaaggaaaccaaccacctgcatgctgcagaaggttcttctcaatgaatataatggcatcgatttacctgtagaaaaccctgcagatgggaccaggagcccaagtccttgtaaatccctagaagctcagccagatcctgacctcggtccgggctctggtttccctgcccctactgttgagtccacacctgatgtttgtccttcatcacctgccctgcagacaccctccctttcatccggtcagctgcctcctctcttgatccccacagatccctcttcccct

SEQ ID NO: 5985 - DNA, 1130 bp, Homo sapiens
ctttttgcttcatggagttgggaatatctttgtgtgttctgtttgtaaaaaagaatttgcttttttgtgcaatttgcagcagcaccagcgagatctccacccagataaggtgtgcacacatcacgagtttgaaagcgggactctgaggccccagaactttacagatcccagcaaggcccatgtagagcatatgcagagcttgccagaagatcctttagaaacttctaaagaagaagaggagttaaatgattcctctgaagagctttacacgactataaaaataatggcttctggaataaagacaaaagatccagatgttcgattgggcctcaatcagcattacccaagctttaaaccacctccatttcagtaccatcaccgtaaccccatggggattggtgtgacagccacaaatttcactacacacaatattccacagactttcactaccgccattcgctgcacaaagtgtggaaaaggtgtcgacaatatgccggagttgcacaaacatatcctggcttgtgcttctgcaagtgacaagaagaggtacacgcctaagaaaaacccagtaccattaaaacaaactgtgcaacccaaaaatggcgtggtggttttagataactctgggaaaaatgccttccgacgaatgggacagcccaaaaggcttaactttagtgttgagctcagcaaaatgtcgtcgaataagctcaaattaaatgcattgaagaaaaaaaatcagctagtacagaaagcaattcttcagaaaaacaaatctgcaaagcagaaggccgacttgaaaaatgcttgtgagtcatcctctcacatctgcccttactgtaatcgagagttcacttacattggaagcctgaataaacacgccgccttcagctgtcccaaaaaacccctttctcctcccaaaaaaaaagtttctcattcatctaagaaaggtggacactcatcacctgcaagtagtgacaaaaacagtaacagcaaccaccgcagacggacagcggatgcggagattaaaatgcaaagcatgcagactccgttgggcaagaccagagcccgcagctcaggccccacccaagtcccacttccctcctcatccttcaggtccaagcagaacgtca

SEQ ID NO: 5986 - DNA, 2209 bp, Homo sapiens
ctcagcctcccgagtagctgggactacaggtgcccgccaccatgcccggctaattttttgtatttttagtagagatggggtttcaccgtgttagccaggatggtctcgatctcctgaccttatgatccgcccgtctcggcctcctgcagtgctgggattacaggtgtgagccaccgtgcctggtgtttttgggttctttaatgcttcttttagagccacatttttcttttcaaaccgagttcccatcgcagtcaagaaaaaggtagagaagcaaaatgaaattctagaccaagtttttccatttaccaggaattgatttaaaaaaaaaagtgctaatttctcatgcctccatctctgctacatcccttggaaataaatgcgtgtagttccttgcagggtgtgtcttctgggtaggacgctcgttcctaaatgccttcagtcatgtatgtgttgtcgtcttaataacatttgtcttacggtctattcacctttttctttaacatggtcaatcatgtaaggttatgttctgttgtcatttatcttcagttttcttattttctaggaacttcctgtagaaaagcccccaaaacaaaacaaaccttaattgactaaaaagtattgcatgctcaacttaggataagcactacggcaaaggatacgaaatctaccaagcttgcaagaccagttgaagctgactcaaaaatcctaacattcagctgattgccggcaggcttagagtcaggcatctgctgcttcggtgggggcccaacgcgcatgctgggcgcccgggtgattgagatccaaagagaagggcactgtaagacaggccagatgaactggctcctcgtcatgggactggtacctcagatctgagcatggcccttgtttttggcacgtagcagagaaaggattgatttgaacttaaccttgcaaagcaagttgcctgttttagcagtagtttgttgtaggtttcagggatgacagatttggatgcactcatttaaaacgttttggtcacatatcagctcttgatgcctttcttttaaattaattatagacagagagaggcatttagctgatctcttacccctggtatttcttttttttgttgttttcgtttttttaaatcacaagtagattgccagcgtaatggagaggaaaccagattggatatggactcttttttatgcctattctggtgttgcgtttgtatatccaaatggacgttatcctctcagattcttatctggcactaatttataactattatattatcagagactatgtagcaatatatcagtgcacaggcgcatcccaggcctgtacagatgtatgtctacacgtaagtataaatgaatttgcataccaggttttacacttgcatctctaatagagattaaaaacaacaaattggcctcttcctaagtatattaatatcatttatccttacattttatgcctccccctaaattaatgactgagttggtggaaagcggctaggttttattcatactgttttttgttctcaacttcaaaagtaatctacctctgaaaaatttgtagtttaatatttgtttggtgaatttgtgccactttaatccttccactatcattcccattttgttacatttctgttatggggactttatgttgaaatattgtataaagcatttgtagcaatttaaaaataaaatatttaaaattatttaaattgttttggacgcttcaattgtattatatgtgatttacatttcactttttttgttggcgttgttaacccggagagtgctcctgtattgaactttgctgttagttattttattgcttctttttggagagtgctataaaagactattctaatgaaaacattaaaatttacaatttgacatacaaaaaggggttgtccattgattttaaccaatgtagcactgagagagagagaggttaattatagatagacaagagtggtgtttgttgtttttcccctcccagcattgaaatcattggggcttgtcagatgtattaaaaaaagatttgttgtgctattgctgcaaacacttaataactagaggagaatttaaacaatgcattttatattattgtaaccaataaaaaactttctaaacatctgtgaaaggactgcattttgtacataattgggagcagttagggggtaaaacaaggtgtgtgtggaggattgttcagagcc

SEQ ID NO: 5987 - DNA, 1219 bp, Homo sapiens
gcagggaatggggacggtgtatggaggggagggatctcctgcgcccttcattgccacacttggtgggaccatgaacatctttagtgtctgagcttctcaaattagctgcaataggaaaaaaacaaattgggaaatgaaaaaaaaatgggaagattaaaaagcacagggggaagaagaagagatttcggaggccatcctgccaggggcggacggggctgactcctgctctctggaggacggtcagtccatgtctcggagaaacgggtgagctgagcttggcgtttggacccagttcagtgaggttcttgggttttgtgcctttggggcagaccccaggcaaggatgtctgagaccacttgggcgctgttttctcagctccaatttcaagagtgagctatcaaacccagagcggaaggagggagctctgatgagcacggtttgtcacacgataaagggattttttttttcagggctactacggttgatcttgcaactctgtaaatatgtatgtagacacttttaaaagcacgtatttatgtccctgactgtaaatgctccatttttaaagttttataacttgtgttatttaatgagtcagtcaatcggctgcagtatgggatctgataaggatctaggagaagggtctcatgcggaccctcacatgggcagaaaaatggtggtcattggccgacatcacagttttcctgtttcccacccagctaaaaaccgttgtttgctttaaattttcataaactggaatcctttcacccgctcctacagctaaccctcacaagcatgaagtgctgtggctgttccttatcctaatgatgcgcttttgtcccgtaaatgttaacactcatgaagcataccccggcctctcagttcttgagggcctccccaccgcagcagcaaggaaagctcacgaaccccaaacctggcaagtcacctgcagcccatggtgagctctgggaagtgtggttgaggccttggggtcactccttttttgcatgtgcaaatgtgctggtcacccttcaacgctcccagacggtcaggaaaactgttccaatcatgaaaaggggggatgattttgtaaaagtggcatttcctggtcagtggtggtcttcaagacgacagctctgtatctgccatgtgaagagaattaacaataaaagtgtgaagagcgattgtgaggaacaagcctgggagtgatcattctggt

SEQ ID NO: 5988 - DNA, 1256 bp, Homo sapiens
acgtcagcacatttgcatgtagacagattttagtcccagcagataagcacacccaacatgtcattaaacccggccgaagccatcgccctggggatcccgtgtttgctgtgagtcactaagggctgtaaacactccagagagacaggcatggttataaggggtgtgcgggcgtggagttattttaatggatttactctccgtgagtgcgtcttatgttgcgggtgccagatgagtgcctttcaagggagagggaaggtcaggcttgcctcctgttcacaaggacaacctctgtctcccttgtggcggcttctatgaaggtggggactccaggctttctctcgtctgctttttggatgccttcaagagaggccagttagaggatatcaattgtggcaattccccagagccctcatcagatggcattagcccgtcatgtgctgcagtggcacccagtttggaggaaattcggaaccagaagagtgtgacaggtacgtgagtgctggccgctgtcccagccctgaactggctgacactgagtctggcctaagcagcggggagctggtgggctctgggtggggcccgtcctcagtctacgtgctggacactggggactgttttgggaaacaccctccacctggcaccaggtgggtaatctgccggtgcccgtggtctcgtcttttgttgcttcttggattcggaggctggctcaggctcccagctagtttgggctgtaactttatcacaggcattcactgtgttcactaccttttaattgtacagaagtttcagaaaagctctcctggggaattggagagaagtaaaaacaacagctgctatttcccggatgctttattccctcccctcacagcacagcctcagcagcatgttcctgactttgaagttctatgtgcccaggctgggaagaatgtggattttcgctcagtcgggtcccattagtgtggaaggatcattgactgagggccgagcaggaaccaagcaccttgttacatgtgttccttttgatccccctcttcctgtcaggcagctgccattctccccatcttacgggtgagaccactgaagcttgggagaggttacaccggctgtggaaagtagctgttccaggctgccatgctgccctcctgggacccttcctcctgcagtttccttgtcagctgacgattccccgggctaccaggccacagagcggaggctgagctgccgagagtcacaggacttttcttcctggcaccttc

SEQ ID NO: 5989 - DNA, 1681 bp, Homo sapiens
ttgtaaatgtccctcgtccaaaccgctactcctggagcccgtctggcagaggatgtggtctgtttttgatgtcccccctcccgcccccctggtgtgaacgtgtgggaccagaccctgtcctgggggtgcgcccaagtcactttaaccacaaaacgccatcgtcgtcagggtaagctctgctctctacaaagactcgcgagccgggccaaggggccttgtcttggctgggtttgtcagaggtcaaaccggctcttttaaacggcctaccagtttttaaattgcattgccgtttctttctttatgaaaaaaaagaaaaaaagaaaattgtttcatttaatttatttgcacaaatgctgaaaacttattctatctaaattattacataaatattggaatgtctatttttccatggggtgggcgggaggtgggtgtctctgttgacttgtctgttctgttaccatgctgctacccaactgtgcaaagtagtttagggtggccagaacccagggaccattggatttcaaagcttgctttttctgttggttcttctctctccttctctctctgtctctcccattctcctgcccatgcatgaaaggatcctccaccttcttcccacccagagctccctccaggcctttctctatatatttatttatctgacatacagaacacgactttagtgagcagagtgctgacagtcatggtccccttctttgggtctgtcttttgagagaggttgagttcagggcaagacagcctgccacacatccaagggtacgaccagtgggaccctggcctgagtctgttctccgaggggcctccagcagcttctgttcctccctgcagctgtgtctttcttgtcctgggtttaggatgcaggtgggccaggcaggtgttgttaggggaggcacccacttcaaaaggagggccacagtggggacacagagtccagcacctgagccctccaccctccccattctggttggttccatcagccacacttagaatctcccaggatcccttggactccgtcccccaacttgtcacagcagcctgagcctacccaccccaggagacaagagctggcaggaacatctgcctatatggggggtggcgttggccccaaagaggcttcaccagcaaaggaactgtgtgtattttaatgccaggggacggaggatgtgtgagctgttcagcaaggtctgcccaaggcctaaaactcaatttccttattcttttgcttctgctcgtccttaacaactaacagctcaacccacacctctagacaacagtagtcgtgctttctgctaacggtgacattttcagctcttaaaaagaagcaaggagattttcaaatgctagagtatctctatcagaaggcataggacattgtgtccaaagtctcaagaacaaacaacactttccttctgacctggtccaaaagtcagcaaacagcaagcaggcagaggccctcataaggacttttctgtcctcctttgaccaaactgtttaaccgagcctaggggtgacggggagcgacccaagctggcatctttctctacggagacagattttagaaaatacttttcttgcccatgaatttcttttctggttgatttttatcattttccctttacttacaagaaaataagattgcaaccactcctgctaatgattt

SEQ ID NO: 5990 - DNA, 1235 bp, Homo sapiens
cattgttaacccaacaaacctttgttgtgatgtccctgtcacctgaaacataggtgacatagctcaccaatgtcctaaccgagacacaaactccacagagcaaaatcatttggtattggtggggagaaccccagcccttttcttgacctgccactgttatgctgtgtggcttcttcccagtggcctcacctctctgtgcctcgatgtcttcatctacgatacttctggttccctcccagggacatcgtgaggattaacacttgctaatatctgtaacacaatttgtaacctctcaggagacaatgggaagttatggggtagctaatttcccatttacaacacagaaatgatatagagctagttcgctccaactctttaggttgaagcagtgtgcaaaaggaagaaaagaaatgtttaatgttcagacctgccaagagcctccaacagggctcaagaaacatataaatcccatgagcacagccttgaaaaccagtttgactcaagccttcgggcctcagttcattgaccagatgacagccacgtgatgattagggaaggacggatgcattgcgattctgcttacacatcgggttatcaaagcgagtcacttgttggaaccatgatgctcgacctccttcaaggccgtttgcactggggcttgagtttccaagattcacaacaggtgtcagcctctgagaaccctcaaagcgtgtgttcttcaacctggcaaattgtttcctctcatgggggaagccgagctctgatgaacttgagaattacacctctctcatgccgaagaccgtggtgttccccctaatgacataaacgcagcctttcttgctgtctgagaccaaatgtctagttggtagacaggtggatgtttggcctcctaagggcacacttctgatcctgggccccaggtggtgaatctctggcatgtggcttggctttgttgagactccaaattccattatcttcatgacattcggcctcatccatagggtcctgaagctgcagtccacagctcagaaaggagaggtgagacctccctccaacctggtgccacaggtctctcccaagccacatccagcctggatgacctgggaccccagaaactgccgtttgggaggcagcaacagcaacgtgcccaggcaggcagttattcccacagagtgagccagaattgtagcagggcacttgaatgcagagctgatgatttgaaaccaacgttcacc

SEQ ID NO: 5991 - DNA, 1233 bp, Homo sapiens
ggggacccctccccagggccttttcctcctctgcgtcttccatctactgaaatgggagagggggtggggagcttctgttctggtgaagggacccgggcaggcccccagcaccccatgctgacttggagaaccccagatctctggggcccagccaggcagggtgtgggggcagctgtgccaatctacctcacaggcccaccccctgccgggcatgccgtgggatcatgggcagggaaggctctgggggtcggagacaccgctgcttagcacccccagccagaacaccctgagggtctcggggctctggagagagtggggcgggaggaagaattggcaccttcctagggaaggagacgagcgcttcgccttgattctccgagaagcctccgagaagtgctttaagtgtgtttgcatgcgccaggcggtgggcagcgggggcctgtccagccctctcccgccatccttccccaagtgacgtccactgccttgtcaccagcgacctgcctgtcatgcccaccccctgaggaagcatggggaccctaacaccctggtgccctgcaccagacaggccgtggtcaggcccaggccaccggccgggttctgccacagcttcccacgtgcttgctgacatgcgtgtgcctgtgtgtggtgtctgttgctgtgtcgtgaaactgtgaccatcactcagtccaaacaagtgagtggccctcgaggccacagttatgcaactttcagtgtgtgtcataacgacgtcactgctttttaaactcgataactctttattttagtaaaatgcccaggagtcctggaagctacgcggacttgcagaggttttattttttggccttagaatctgcagaaattaggaggcaccgagcccagcgcagcagcctcggacccggattgcgtttgccttagcggatatgtttatacagatgaatataaaatgtttttttctttgggctttttgcttcttttttcccccccttctcaccttcccttctccccgaccccaccccccaaaaaagctacttcttcattccgtggtacgattattttttttaactaaaggaagataaaattctatattcttatgtgtgtatggttcttgatggtgagtgggcagggaaatgacaaggtcacctgggtgtggggacagtggtgtcagagcctgggagggaaggggacctgccctagtggaggaggttggtgttttatgcccagatgctgtca

SEQ ID NO: 5992 - DNA, 1448 bp, Homo sapiens
gtcctactccatagaaacccgactcagagcagttgcttcctctgagggtcctgtggccttgtggctgccttgggaggcagcatgtatgggccccagctgctctgctcaggtattcatgccacgagaaggggctgcgaggctggggccactcctggctccttgcaaatatttcagtctgatttgaactttatgaatttggaaattttgaattttgagttttttaaaggtaaagttgaggtgcgtattctttaagccctcctgctcaaagaggctgcagtttgagctgtttttaaggtgcgggttgagtggacattccccccagcccctcttgaattcttccttcagtccagagaactgaactcacagagctctccatggtcatgtcttacaggtcgctaatgctgtttcggtgaaagggatttataaacagatgcctggttgctttaatttcctccggaaaaaacttttctttaaaacatcataaggccagggcccctcaccctgccttatcttgcaccccaaagctttcctgccccaggcctgaaagaggctgaggcctggactttcctgcaactcaaggactttgcagccggcacagggtctgctctttctctgccagtgacagacaggctcttagcagcttccagattgacgacaagtgctgaacagtggaggaagagggacagatgaatgccgtggattgcacgtggcctcttgagcagtggctggtccagggctagtgacttgtgtcccatgatccctgtgttgtctctagagcagggattaacctctgcactactgacatgtggggccaggtcaccctttgctgtgaggctgtcctgtacattgtgggatgttcagcactgtcccttgcctcaatgccagtaacgcgtcttcctgagtggtgccaaacaaaaaggttctcaggtgttgccaaatatgtcctggggtataaaactttcctcgcctgacaaccactggtctgtagggatttttggctacacacaaaccagtatcgctcatagatcagcaaaccggggcctactagagtctgaacagctgtaatctatgaattctaagtgaaattttaaaaattgttaatttttcctatattgcattaattttaaaaaataaatctgaggcaaatatggactctcttttgcctatttcttccctcattttgctccaactctttcttcttccttacaaaagagacttttgcttttttcgaaacatttccccatgtttttctggggtctcgctatgttgcccaggctggtctcaaactcctgggctcaagtgaccctcccaagtagctcttactacaggcgtgcaccattgcacccagccccatttattcatgtcttatttcacttgatccttatcccatcccaggaaggcaacaagggtgagaaccctgtgctcagggaggttaggtctcttgtcca

SEQ ID NO: 5993 - DNA, 1337 bp, Homo sapiens
tcaccccaccctcctgtcctgtgtcttggagaagcacagggctccaccctgcaagcggcatctggcggaccctcatgagcctgtcgtgcaggccaggtcattggccccttccccaatcccggccctgctgtgctgctgccatggcgcatgctcctaactctgaacaacccacggcagcttctagccccgcatctggaaaaaggcccctttccaagcaatctcacgtttactggttgttctgggagtaagtggctaaatgtatattttgggggtatcccccaacaacagtttgttggccacaggttgaaaaggaaaggaataaacgggagttctgcatgtgagttctcaagaaaaggaaagggaggctgagcagtggctgaagcgatgcagccttgagacacgctgtgagcatcccatccgccgccccagcgctgctggtagccaggggaggggtctgcacagcgagaagtactgtgatgactttgagccgttgacatgtatgtcttcagatgcctttctgcctctgtcgattttagggtatggatattaggagccataacttgtaatcttgttctctgaacgtagagataagctgctataaagccagtagatgttaaactgaagagaaattattcccacctgctatgagtcaggcttaaggaatctcttcaatagtgtctctttagtaaaataccaaacatgtctttgtatcaaggaacttaaaatttctcaacaattgtattttgaacactgttaccctaaaagtgctgtctcttcaagtcatcttttgcaggaagtgagccaagatttgttctagactcccattttgcaaaaggcttactttccacttctgggctgtattttgatgtctcatcttcattgttttcactcttaacttagagctgcttcaccagtattggggtcagactggccatcagcacctgagcgtgctgagctccaggtatagtggaccccagggtgcctcataccagccagttagagagcataccttttatttttcagggcagaatgaccagtggttctgagtttgagtttggacagcttcaaagagtggtccgttcaaatgtcaaagcaaggtgcctttggtggctttgtgaagggtgaaaatcagtgatgggacatttactaagtatttctttttttttttttttttttagttgttgagacagagtttcactcttgttgcccaggctggagtgaaatggtgcgatctcggttcaccgcaacctccacatcccaggttcaagtgattctcctgcctcagcctcctgagtagctaggattacaggcatgtgccaccatgtaattagcccggc

SEQ ID NO: 5994 - DNA, 1165 bp, Homo sapiens
atttgcacttccggtgaaagaaaaagtttaagacttgcactacctcattttggggtctttggaaatgctctttacccaccacatgcgtttctggttaaattcttttgaaaaacagtacctattggttcaactcaagctgtttgtttgtttcggttctaccctggtagtaagccagaaggccctttttctttcaggtcacagttcagagtttgggtcagttcaaagctcaatgctttaaaaggatatttgcttggaaacggcctagtatcagtgctgtttggtggtttcatttccctactcagcttgctggaaagaagttcagcctctcatattttaactaagcaaagtaattctcaaaatgctttggggctgcccctagtctttatcaaacagaatcggtgacactaacgctgtaaactttacactaaaacacttagatcatgacttaataaatttagcctggaggaaatagtctaaacattaagaaaattatagaggtctcccaagtctccatcaagtaaatcttgattttctactgcagttatgaaatagtttacaaaacgattgcccaactgcagcttgttctgctgtcttatggtaaacacgtgtcaatactttgttcagaagtatgattcctttacacaatgtgaactttagaaccttggcataaagctgttcagaaagaatttaaaaagttaatccacaaaagctcaggaaccagttctgtcagtgaatgcctcatgtggagaactaggaaaggactgtttaaatagagaaaataaactcttcaattttttttctttttttgtttttgtttttgagacggagtcttgctctgtcgcccatgctggagtgcagtggtgcgttctcgactcactgcaaccccagtctcccgggttcaagcgattctcctgcctcagcctcctgagtaactgggactacgggcgcgcgccaccacgcctggctaatttttgtaatttttttttagtagagacggggtttcaccatgttgaccaggctgatttcaaactcctgacctctagtgatctgcccgcctcggcctcccaaaatgctgcgattacaggtgtgagccaccgttcccggacaactcttcaatttttgatagtggctttttcttttcttttcttttcttttttttttttcg

SEQ ID NO: 5995 - DNA, 1674 bp, Homo sapiens
ctgaaaagaaagaacatctttctttacaagatctttctgatcatgcttcctcagcagaccatgctccaacagaccagagtccagctatgcctatgcagaattcatccgaagaaataactgttgcaggtaatctggagaaatctgctgaaagaagcacccagggcctcaaatttcatctccatacaagacaggaagctagtttatctgtcacatctactaggatgcatgaaccacagatgtttctaggtgaaaaggattggcatccagaaaatcagaacctgagtcaagtgagtgaccctcagcagcacgaagaaccagggaatgaacagtatgaggttgcacaacaaaaagcttcacatgaccaagaatatctttgtaacataggggaccttgagcttcctgaagaaaggcaacagaatcaacacaaaattgttgatttggaagctacgatgaaaggaaatgggctcccacagaatgtggatcctccaagtgcgaagaaaagtattccatcttcagaatgcagtggctgctcaaattcagaaacatttatggaaatcgatacagctcaacagtccctagttactttgcttaattcaacaggcaggcagaatgccaatgtcaagaacattggtgcattggatctcactttagataatcccttgatggaagtagaaacatcaaaatgtaacccttcatctgaaattttgaatgattccatttccactcaggatttacagcccccagaaactaatgttgaaatacctggaacaaataaagaatatggccattactcctctccaagtctctgtggcagttgtcagccttctgtggagtcagcagaagaatcttgcccgtctataacggcagccttgaaagaacttcatgaacttttggttgttagcagtaaaccagcttcagaaaatacatctgaagaagtaatctgtcaatcagaaaccatagctgagggccaaaccagtattaaagacctttctgaaagatggacccaaaatgagcatcttacccagaatgaacagtgtccacaagtctcctttcatcaggccatatctgtatcagtggagacagaaaaattaacaggtacttcatctgacactggaagagaagctgtagaaaatgtaaacttcaggagtctaggtgatggcctgtcaaccgataaggaaggtgtccccaaatctagggaatccataaataagaaccgttctgtcactgtaacctcagctaaaacatccaatcagttacactgcaccttaggtgtagaaatttcacccaaacttttagcaggtgaggaggatgcactcaatcagacttctgagcaaactaagtctttgtcatccaatttcatattggttaaagacttaggtcagggcatacagaattcagtaacagacaggcctgaaaccagagaaaatgtctgtcctgatgcttcgaggccattacttgaatatgaaccacctaccagccatccatcatcaagtcctgccattcttccaccattgatttttcctgccacagatattgaccgcattctccgtgctggctttactttgcaggaagctcttggagctttgcatcgagttggtgggaatgcagaccttgcacttcttgttttgctcgcaaaaaacatcgtagttcctacatgactgtgggaaagtgggc

SEQ ID NO: 5996 - DNA, 1674 bp, Homo sapiens; identical to SEQ ID NO: 5995

SEQ ID NO: 5997 - DNA, 2262 bp, Homo sapiens
ggccgggcgcggtggctcatgcctgtaatcccagcactttgggaggctaaggcgggcggatcacgaggtcaggagatcgagaccatcctggctaacacggtgaaaccccgtctctactaaaaatacaaaaatacaaaaaattagcctgtcgttgtggcaggtgcctgtagtcccagctactcgggaggctgaggcaggagaatggcgtgaaccccagaggtggagcttgcagtgagctgagattgtgccactgcactccagcctgggcaacagagcgagactccatctcaaaaaaaaaaaaaaaagaaatgagagtaatgtaataatgcgatacagatattttccccagagagaaaaacgttaagtgtaaaagagagccatttaaaaagtcattttgcaggtcgtccctcctacatacataacgcaaattgtccaaaaaaaatctaaaaactcattttggaaaattattgatatgcagcaataacgttgactttattttttccagatatggccgcgtggaaagtgtcaaaattcttcccaagaggggatctgaaggaggagtggctgcctttgtggattttgtggacatcaaaagtgcacagaaagctcacaactcggtcaacaaaatgggtgacagagacctacgcacggattataatgaaccaggcaccatcccgagtgctgctcggggattggatgatacagtttccatagcatctcgtagtagagaggtttctgggttcagaggaggtggtggagggcctgcttatggtcccccaccgtcacttcatgcacgagaaggacgttatgagcggagacttgatgggtaagttccaaggtttctgtaggcaggtattttgtatttgatatggtgagaaacagaaactcatatttaggggccccagatggatttaaagttttgggcattctcaatgtttcctattttgggttggaaacggaagtgatttatatcccaatggctggtatcttatggaatcgtagaggatatttcctgcagctgattggatatctgttcctgagatataatgtgatggaagatttcctatggaagcttcatttttggagttacctgtcttctagaattacttattccttctcttggataatgttaagtccttccttggatatatcccttctacctgatggagctatttggcttttgtgttcatactatatggaatatttctggaatattagagcctacagattcttttagaagttgatatctgcctctccattttcactacataaagtgtacaaacaaattggattgtaacaaaaaatctggcagaccataatgattcaaccacttggattctacaaacaatactttaacatggaaatgtgtacttggatgaagaagagagaaggcaatgcctgatttttccattttggatctacacaatttctgtattgttggaattacactctttgatggaatggggaaaaattaaaatgatggatgtttcctaaatcctggaatatagccattcttttctaattgctgggatatatgggatgtcttgctgtcaagattccactagcccagggaaagaggattactatatcatttcttaagcaagttgctgtccaatcaaaggtactttagctttgaacacatggtgatgatcagttgtggatacagcaatcaaaattgactgggctggatggctacaaaagtgaactattggcgagcaactgtgccttcctcattcgttggaattgtagaggatatttcctcttctgccagctacctgattcatacttagggctggaaatatttatgaatgtggataaatttctaattgtctgctatctcaagaaagaagtctgggggtttgagagttacagtttgtctgggactacttgcttccagtggaattattttgtctggtcactaagattttttttttcttgtggttcatctaaatatcatttgacacccttgcccattaagaaggtggattacccccataagaggggccaaaattggggaagttatgttcacaattctctccctagatttaattgggattataggtcgtgtttccacacttggaaaaggttggtatgtcctgacctgtgtatattagcccctctcctaacccaagtcaaactctctttttttccccactaactctagaagtatttagtactaatagtgaatcagagaatagccattagatttcagctctgctagctcttgtgcctgccttctgtatcttcttaatggataagaac

SEQ ID NO: 5998 - DNA, 1256 bp, Homo sapiens
actatccaagcagtcaaaacttaatgaaaaaaagttaaacttagaaaattttttctggacttcttgaaagtccttcctattgttgagacatgcgctgcagcagggctttcatgtctaagttaaaacatagcatggaaatgtggcctaaaagaaatttgtgagtaaataaaatttggtatatactttaatcagatgaaagtgtaaaaactttcatattattaaaatagtctcttgttccgttaacatgaaaaggagattgtatatttatgtatgcaagtcagaaaatctctaataaagtaagcaagtgagctgcagaacactagtcatgaaagcccaatatacaatgaaaacaatgattgctcagctgtgaaaataatttttggagtcaagtaaaatgttaagcttgttagcgtttgcttattaagtaggttaatgctgtttagaaaatgaccagttgcaaagacaaagacaatgctgaagtgaatgtttgcatgacttgcttttagttttgcttgctcctttctgattaaatatttttccccctcctaaatgcagggcttcagataacagggagcgtgcttatgaacatagtgcctatggacaccatgaacgggggacgggaggatttgatcggacaagacattacgatcaggattactatagagatcctcgagagcggactttacaacatgggctctattacgcttctcggagtcgaagtccaaatcgctttgatgctcatgacccccgatatgaacctagggctcgcgagcagtttacactgcccagtgtggtacacagggatatctacagggatgatattacccgggaggtacgaggcagaaggccagagcggaattaccagcacagcaggagtcggtcaccacattcatcccagtctagaaatcagtctcctcagagactggctagccaagcatctagacccacaaggtcccctagcggcagcggctctagaagtagatcctccagtagtgattcaatcagcagcagcagtagtaccagcagtgacaggtaggttaacagccttttgttataacagatgagctagctttaaacaaattctcaacaatcagtgggaatggtttcagcatagtattattttttaaagtaatcttggatcatatatgtatgtaatcagtaaagaaactggcatgtggccattgaattaactgttctaagtactcgaagttaagtgatgatttgcaaagttctgtttcatcctccagatgcacagt

SEQ ID NO: 5999 - DNA, 1168 bp, Homo sapiens
tttttgtatttttagtagagacaggttttcaccgtgttggccaggctggtgtcgaactcctgacctcaagtgatccgcccgcctccacctcccaaagtgctaggattacaggcgtgagccacggtgcgcagccagatatcatattttaaatggcctggcccctaataacgattttagatattgcagaagggaattatttcttaggatttcattaaatagcctgccttttctttattatcgttaagtttctcttaatgctgttagtatggattttaaattttgaattttgaattgcaatgctgttgctcctctgcagagagcttcacatgagaaggatttcatggtttgtgacaataaatgctatatgttttatagcaaactagtaacttaccattgtattaaggtgtacagtttttttaactaagtaaatgatgattgagaacatgacttttttgagaaataaataccctatatggacttggttcattctaatttattttcttgggcatattgctaagttgtattcattggttttttcaggatattgacattaagaaagtaaatggagttcctcagtatgcgtttctgcaatactgtgatattgctagcgtttgtaaagctattaagaagatggatggggaatatcttggaaataatcgcctcaaggtaaatgaatttgcataaattattgtgctgttatgatttgctttgttttttaagacttgaagggttttttttttgcatatgccttattatttaagatcctactaagacagataaccataaaagtgatatacttctttgcattcctatcctattatatactgtaatctgattaatattcgattagccaggcaggattttttttgtatattcctatttaattttaaccagatgtttcccacttgagatgttgatttgataagattactatagaaaaccagttttctgagaattctgttgtagttgaatagtaattgtgaactttactaatagaaattttgccttttatattcagctgggttttggaaagagcatgcctacaaactgcgtgtggctagatgggctttcttcgaatgtgtcagatcagtatttaacacgacatttctgccgatatgggcctgtggtaaaggtaggcgggaggttttggtatgtggttcagacttct

SEQ ID NO: 6000 - DNA, 1237 bp, Homo sapiens
accactgcccaatagaagcataatgtaagttatataaattctgtatatgtaattttaaattttctagtagccacattaaaaagacaaagtgaaattttctttaatatatctaaaacgttgtttcaacatataatcagtctaaattgttgtttttctataaactaggtctacaaaattggctgtgtattttacacatctcaatttagctagatttcaagtgcctagtagctacttgaagctatagtggatagctactacaaactaatcatttcacaaatgattaaataatgtcaaaagattttttagaagcaggaatttctgatttcatatgtatgattttatgcataagtgatgaggaaacaaaagaactaatatctttgttattttttggcagagaggaacgaagggcatcctacgactataaccaagatcgtacatattatgagagtgttcgaactccaggcacttatcctgaggattccaggcgggactatccagctcgagggagagagttttattcagaatgggaaacttaccaaggagactactatgaatcacgatactacgatgatcctcgggaatacagggattacaggaatgatccttatgaacaagatattagggaatatagttacaggcaaagggaacgagaaagagaacgtgaaagatttgagtctgaccgggacagagaccatgagaggaggccgattgaacgaagtcaaagtcctgttcacttgcgacgtccacagagtcctggagcgtctccctctcaggcagagaggttgccgagtgattctgagaggaggctttacagccgatcctcagaccggagtggaagctgtagctcactctcccctccaagatatgagaaactggacaagtctcgtttggagcgctatacaaaaaatgaaaagacagataaagaacgaacttttgatccggagagagtggagagagagagacgcttaatacggaaggaaaaagtggaaaaggacaaaactgacaagcagaaacgcaaaggaaaggttcactcccctagttctcagtcttcagaaacggaccaagaaaatgagcgagagcaaagccctgaaaagcccaggagttgtaataaactgagcagagagaaagctgacaaagagggaatagcgaaaaaccgcctggaactcatgccttgcgtggttttgactcgagtgaaagagaaagagggaaaggtcattgaccacactcctgtggaaaa

SEQ ID NO: 6001 - DNA, 2781 bp, Homo sapiens
tgaagaaaaaattggcattgacatcgatcacacgcagagttaccgaaaacaaatggaacagagtcgtaggaaacagcagatggaaatggaaatagccaagtctgagaagtttggcagtcctaaaaaagatgtagatgaatatgaaagacgtagcctcgttcacgaggtaggcaaaccccctcaagatgtcactgatgactctcctcctagcaaaaagaaaaggatggatcatgtcgattttgatatctgcaccaagcgagaacggaattacagaagttcacgccaaatcagcgaagattctgaaaggactggtggttctcccagtgtccgacatggttccttccatgaagatgaggatcccataggctcccctaggctactgtcagtaaaagggtctcctaaagtagatgaaaaagtcctcccctattctaacataacagtcagggaagagtctttaaaatttaatccttatgattctagcaggagagaacagatggcagatatggccaaaataaaactatctgtcttgaattctgaagatgaactaaatcgttgggactctcagatgaaacaggatgctggcagatttgatgtgagtttcccaaacagcataattaagagagatagccttcgaaaaaggtctgtacgagatctggaacctggtgaggtgccttctgattctgacgaagatggtgaacacaaatcccactcacccagagcctctgcattatatgaaagttctcgattgtcttttttattgagggacagagaagacaagctacgtgagcgagatgaaagactctctagttctttagaaaggaacaaattttactcttttgcattggataagacaatcacaccagacactaaagctttgcttgaaagagctaaatccctctcttcatctcgtgaagaaaattggtcttttcttgattgggactcccgatttgcaaattttcgaaacaacaaagataaagaaaaggttgactctgctccaagacctattccatcctggtacatgaaaaagaagaaaattaggactgattcagaagggaaaatggatgataagaaagaggaccataaagaagaagagcaagagaggcaggaattgtttgcttctcgttttttacacagctcaatctttgaacaagattccaagcgattgcagcatctagagagaaaagaggaagattctgacttcatttctggtaggatctatgggaagcagacatctgagggagcaaacagcacaactgattccattcaagaaccagtagttctgttccatagcagatttatggagctcacacggatgcaacagaaagaaaaagaaaaagaccagaaacccaaagaggttgagaaacaggaagatacagagaatcatcccaagaccccagaatctgctcctgagaataaagattcagaactgaaaactccaccttccgttgggcctccaagtgtcacagtcgtaactctagaatcagccccatcagcactagagaagaccactggtgacaaaacggtagaggcgcctttggtaacagaagagaagactgtggagccagctaccgtctcagaagaagcaaagcctgcatctgaacctgctcctgcccctgtggaacagctggaacaagtagacctgcccccaggagcagaccccgataaagaagctgccatgatgcctgcgggtgttgaggaaggttcatcaggtgaccagccgccttatctggatgccaagcctccaactcccggggcctcgttttcccaggcagagagcaacgtagatccagagcctgacagtacccagccactttcaaaaccagctcagaagtctgaggaagccaatgagccaaaggccgaaaagccagacgccactgcagatgctgagcctgatgcaaaccagaaagccgaagctgctcctgagtctcagcccccagcttctgaagatttagaggttgatcctccagttgctgcaaaggataaaaagccaaacaaaagcaagcgttcaaagacccctgttcaggcagctgcagtgagtatcgtggagaagcccgtcacaaggaagagtgagaggatagaccgggaaaaactcaagcggtccaattctcctcggggagaagcacagaagcttttggaattgaagatggaggcagagaagattacaaggactgcttctaaaaactctgctgcagaccttgaacatcccgaaccaagtttgcctctcagccgaacaaggcgccggaatgtaaggagcgtctatgcaaccatgggtgaccatgaaaaccgctctcctgtcaaagagcccgttgagcaaccaagagtgaccagaaagagattggagcgagagcttcaggaggctgcagcggttcccaccacccctcggaggggaaggcctccaaagacacgccggcgagccgatgaagaggaggagaacgaggccaaggaacctgcagaaacactcaagccacctgagggatggcggtcgccaaggtcccagaaaactgcagctggtggtggaccccaagggaaaaagggaaaaaatgaaccgaaggtggatgctacacgtcctgaggccaccactgaggtgggcccccaaataggcgtgaaagagagctccatggaacccaaggctgctgaggaggaggcagggagtgaacagaaacgtgacagaaaagatgctggcacagacaaaaacccccctgaaaccgcccctgttgaagttgtagagaaaaaaccggcccctgaaaaaaactccaaatcaaagagaggaagatctcgaaa

SEQ ID NO: 6002 - DNA, 1024 bp, Homo sapiens
cactggcctggtgaacgtctccctggtcccggtgaatgccctgaaaggccccgtgaagggctcagtgaccacactgaaaagtttggtgagcacccctgctgggcccgtgaacgtcctgaaagggcctgtgaatgttcttacggggccagtgaatgttctcaccactccagtgaacgccacggtgggcacagtgaatgccgccccaggcacagtcaatgccgctgcgagtgcagtgaatgccacagcaagtgcagtgaccgtcacagcgggtgcggttactgctgcatctggtggtgtaacggccacaacaggcacggtgacaatggcaggggcagtgattgcgccgtcaacaaagtgcaaacagagagcgagtgctaatgaaaacagtcggttccacccagggtccatgcctgtgatcgacgatcgtccggcagacgcgggctcaggggcggggctgcgtgtgaacacttctgaaggggttgtgctcctgagttactcagggcagaagaccgaaggcccacagcggatcagcgccaagatcagccagatccccccggccagtgcaatggacattgaatttcagcagtcagtgtccaagtcccaggtcaaacctgattctgtcacagcatcgcagcctccatccaaaggccctcaagctcctgcaggctatgcgaacgtggccacccattccacgttggtactgaccgcccagacatataatgcctctcctgtgatttcgtctgtgaaggccgataggccatccttggagaagcccgagcccattcacctctcggtgtccacgcctgtcacccagggaggcacagtgaaggttctcacccaggggatcaacacaccccctgtgctggttcacaaccagctggtcctcaccccaagcattgtcaccacaaacaagaagcttgctgaccccgtcacccttaaaatcgagaccaaggtccttcagccggccaacctggggtccacgctcacgccccaccaccctcctgctctgcccagcaaactgcct

SEQ ID NO: 6003 - DNA, 1234 bp, Homo sapiens
gtgtcccaggaggcaaaggggacccagacgggagtagagcagcctcgcctcccagctggacctgcaaacaggccacctgagcctcacacccaggttcagagggcacaagcagaaacaggcccgacttccttcccctcccctgtgtctgtctccatgaagcctgaccttccagtctctcttcccactcagactgccccaaaacagccgttgtttgtcccaacaacctctggccccagcaccccaccaggactggttctgccacacactgaattccagccagcccccaaacaagattcctctccacacctgacttcccagagacccgtggatatggttcaacttctgaaggtaagcatgagcaggggctgcccttcctggcccccaagttttatgccatgtcaaatgtcctaagattccctagttaacagacccacaagctacagcctctggctgtgtccagcatggctcagcgaggggccatgagctcacttcctgtttgtttccctgtgagcagaagtaccccatcgtgtggcagggcctgctggccctcaagaatgacacagctgctgtgcagctccacttcgtctctggcaacaacgtcctggcccatcggtccctgcccctttctgaaggagggcccccactaaggatcgcccagaggatgcggctggaggcaacgcagctggaaggggttgcccgaaggatgacggtaagactctcaggcccaggtgagcaactgccccacctacagggaggaagacgtaggtagtccctgccagcccatctccctggcctgtcatggaagcattaactgtattcttgttgttgttgaaacagtctctgtcgcctgggctggagtgcagcggtgcgatctctgttcattatagcctctgcctcccgggttcaagccattctcttgcctcagcctcctgagtagctgggattataggcacgcaccaccatggcaccaccatgcccagctaattttttgtatttttagtagagatggggtttcaccatgttggccaggccagccttgaactcctgacctcaagtgatctggctgccttggcctcccaaagtgctgggattacaggcctgagccactgtgcctggccagtaacggtattcttgaagtgagcaatgaagggtccactatgcttctacttggtggggggatgtaaagtacctctagacccagaaacaaggctttacagtttttaaaaattattat

SEQ ID NO: 6004 - DNA, 1124 bp, Homo sapiens
gaaacaagaaaacagaactgcctttgcactaaattagtgacttggacttttgcccagtgaagacaggctgtgacactctggatgtcttggtgtgtgtagacacacattgcagactcttaacgcaggaaggacttcaaacttctgctgagaccttggggtcaaggaacatttcattggttttttttgtccacccccatctcccttgctcatttggatgcgtcaccttaattctcctgctgccaccgtctttgattcaccgggatgtacagtttacagttgaagagcaaacagaaaggttttctcttggtgggatatgcagaacttgggatgtgtgtatatataaatatataatatatataaatatatataatactgacttaaaaaatcaaatcccccgacatacgttttttttaatctgtgccaaaaatgtgttttcagaggaaatcttattttcatattcagactttgtattgcccactcatttgtataagtgcgcttcggtacagcacgggtcctgctcccgcgatgtggaagtgtcacacggcacctgtacaaaaagactggctaacccctcttcctattaccttgatctcttcccccaacttcctaacacttattaatttatgaaactgtttttctcagcgcagttttgttttgtgtgtccattggattacaaactttattaaaaaatataaaacacaccaagtgtgagtgtgattgtcacttgggtgggaggacgaaccatgggtccttggcttatgggaacagtcagccctcatcccgcttttgatccccatgccaagtctgtacatgggaactgtttcccttctgcctcctagtcagtcagtcctcctccccaaggataattttatcttgtacaaaggagatttttgtcacggacactgaacttaaccatttctcactcttgtggtgtcttcagagtcctaactggttcttaggtaatgtggaaggaaggcacttccaattttgatacagaatataaccacaccccatgccatctcagaaacattttagcaagctttggtttcttgtctctctcttgccccctcttcccttctcccagtgtgaagcaggctgactcctgcagaggcagtggcctcctg

SEQ ID NO: 6005 - DNA, 1733 bp, Homo sapiens
ttcaggcaagtcactttacctctctgacctcagttctctaatctgcaaaatggggatgaaaaagagcacctgcctcacagataattcagaagatttgatttatttttatttttttaaagcatcgtacagagttgaggcttctgtcgttttcctaactttgttgatggtgggccaccttggcaagcttctaggctgtggctccttctcccaggcctacctaaccagagctctcttgccctacaggtccccaaggcaccctctccaccctcctcctctgcctccctccactcccctccccagccgcccaccgagtcctgtccccacccagcccggccccctcccctgctccagcccctaactctccctctctccctcccggcccacagcgacatcaagaggattggggtgcggctgcccggccaccagaagcgcatcgcctacagcctgctgggactcaaggaccaggtgaacactgtggggatccccatctgagcctcgacagggcctggagccccatcggccaagaatacttgaagaaacagagtggcctccctgctgtgccatgctgggccactggggactttatttatttctagttctttcctccccctgcaacttccgctgaggggtctcggatgacaccctggcctgaactgaggagatgaccagggatgctgggctgggccctctttccctgcgagacgcacacagctgagcacttagcaggcaccgccacgtcccagcatccctggagcaggagccccgccacagccttcggacagacatatgggatattcccaagccgaccttccctccgccttctcccacatgaggccatctcaggagatggagggcttggcccagcgccaagtaaacagggtacctcaagccccatttcctcacactaagagggcagactgtgaacttgactgggtgagacccaaagcggtccctgtccctctagtgccttctttagaccctcgggccccatcctcatccctgactggccaaacccttgctttcctgggcctttgcaagatgcttggttgtgttgaggtttttaaatatatattttgtactttgtggagagaatgtgtgtgtgtggcagggggccccgccagggctggggacagagggtgtcaaacattcgtgagctggggactcagggaccggtgctgcaggagtgtcctgcccatgccccagtcggccccatctctcatccttttggataagtttctattctgtcagtgttaaagattttgttttgttggacatttttttcgaatcttaatttattattttttttatatttattgttagaaaatgacttatttctgctctggaataaagttgcagatgattcaaaccgatcttggctttcagtcttgggaaaagcagtggggtcccagagcttcctgggtgggagttgaggggctgagggttccccccaaacccctagtgtttaaacagagattcgtgcacaaggcagacacgtcacttaaccctgggagcaggggtgggtgggaggtgggcagggggccgggaagcaggttctgccgagcccggcctccatgccagcaggccccaatcacctttgatctccaggctgctcagagtcttcgggagggctgggaggtaggagaacagcaagagccgccgtcagcttccctcccacggctccccggagctgtcgaaatagatccttcaaccatccatgtacagctctgaggttt

SEQ ID NO: 6006 - DNA, 1229 bp, Homo sapiens
attattattattattattattattattatttatgcactcgtaaatatggggcacctctgatgtgccagcccctgtgatggggccagggtggaggcctggggctctggccctgtgctctggagctgaaagtttaggatcctaggttgggatctaaagagcctgggagctgggcgtggtgaccacgcccataatcccagcattttgggaggttgaggcaggaggattgcttgagctcaggcatttgagaccagcatgggcaacatagggagaccccatctctacaaaaaatacaaaaattagccaggtacagtagcatgtgtctgtagccccagctattcaggaagctgaggcaggaggatcacttgagcacaggagttcaaagctgtagtgggccgagatcatgccactgcactcgagcctgggtgagagagcgagatcctgtctcaaaaaaatgaaagaatctgggctgtggaggatgtggctccacgtccacttgtccccccaaaccctgcctgctcgtaggcagcttcttacccacttcccccactgcctgtcctgcccagagccccccaaggtgaggctggagggccgcagcaccacctcgcttagcgtctcctggagcatccccccgccgcagcagagccgagtgtggaagtacgaggtcacttaccgcaagaaggtaactcccagaggggcggggctggctctagctgggccgacagcaggggacaggctggtcacatagatgatcaccaaaccacccagccatctgaagaagcacccttctgcagatggggaaactgaggcctggggtctgccagggggttacatctcccaaggcagcacagcagagatttgtacgagagaagacatggcgtccttggaagaggcagtcagggtgaggacaggggcagaattttgggaccccacacactcagtttgagtcctggctcatgcatttagtggttctgaccttgagtgagtcacttaattccgagcctcagtttcctcctctgtaagaagagcctcaagtttgctaacaaaggcaagccaccttgctagcttggggtggtctccagcgggctgagccgaggcccctgccctgccctcactgcctgctcctccgccggccacccacccacagggagactccaacagctacaatgtgcgccgcaccgagggtttctccgtgaccctggacgacctggccccagacaccacctacctgg

SEQ ID NO: 6007 - DNA, 1203 bp, Homo sapiens
tcttgcaggagccagtggggagtgaagcaaaggtttgcagcatgtgtgtgaagcacttcctgggtgcccggtacatgctaggcccttgccatgcatttttccatcacaagacattttgccgatgagaaaacaggtccatagagatttactgacctgcttgcagggcaggggtccctggtgagggaatgagacagtcacgtggggtggaagcagattgaactgatgtccttgtgctctgtctgtcctgtgtccaccagcctgctcgcctggattttttaagtttgaggcatctgagagcccctgcttggagtgccctgagcacacgctgccatcccctgagggtgccacctcctgcgagtgtgaggaaggcttcttccgggcacctcaggacccagcgtcgatgccttgcacacgtgagtcttgcagtgggtcagggtggcgtgactgagggtgacgtgtccgcctgggtccagcacagcactgactcctcctgtctgtgcaggacccccctccgccccacactacctcacagccgtgggcatgggtgccaaggtggagctgcgctggacgccccctcaggacagcgggggccgcgaggacattgtctacagcgtcacctgcgaacagtgctggcccgagtctggggaatgcgggccgtgtgaggccagtgtgcgctactcggagcctcctcacggactgacccgcaccagtgtgacagtgagcgacctggagccccacatgaactacaccttcaccgtggaggcccgcaatggcgtctcaggcctggtaaccagccgcagcttccgtactgccagtgtcagcatcaaccagacaggtgaggtccaggggtggcagctgtgccctatggggcctgcccaggtggggcttaaggaggacggccatctggggctcgggtgtgtttagagagaggcagcagagcaagtggttaaaggcacagtgtctagagcaagcttgtccaacccgtgggccacatgtggccccagccgacattgaatgcggcccaacacaaattcgtaaattatcttaaaacattatgatattatttttgcaatatttttcccttttttttgagacagagtctcgctctgttgcccaggctggagtgcagtggcttgatctcggctcactgcaacctctgccttccgggttcaagcaattctcctgcctcagcctctggagtag

SEQ ID NO: 6008 - DNA, 2356 bp, Homo sapiens
ttcatgtgtcacccaaatagggcttgggtttttactttcacttcatttctgagattaaggtgtaaccaagtagagcatttctttgcttgatacagaaagttactagtctcaaccatggcctgggcataggagatgtcaaaataagtttatttcaaatggcaccatttaaatagggatttttggtgatttctcatcagtggaaagaggatttttgttttgcctttgttttgttttgaaatttaaatcctaatttcaaaacatcaccttgccaccctgacactcctctttttattattagcgtttctcaggcacaaagcctgctgcagctggccctgggtcctggctttcagccagcatctggcagcctaagtgtactgataagtgtgttttctcctgttacatcatgctgaatcctttcccttagccattagcttttatgatgtggtcttcgtaggaaagccaccctggtgccaagcctagcttgtggggaggggtatgtgttccagaaactgctctttgtgttcccttcaatgaggaaacaacatgtgtctacttatgtggcatccaactgcttggagctccacacttccctttcgcgactcaggctctggtgctgttgccaatccttgcttggcaaagactgttcgatcatgtggggtccttatttacaagggaaagctgggccagaaggctagcaattcaggtgttaccgctattgctgtaccttgtgttaggacattgtgtttgtgcatggactgtgcctccaaactcagtagttcctatctaaatataaagtatattagaaacctgaaagtacagaatctcaaccttacagtctttcccttagtcctgtggccttcctaagccagctgttaacgtgttgattccttccacttcccccaagtaggcaggcaacagatatgttgattgtcttagaaagtaatctggttcctctgaactccattgaattccagtttgacgcatactgcctggaaccagactgtttgcttacagctttttaagaaaaatctgccttgtctgcccccattatggttggtcttggtagctcctgggcactgtgggcgtgtaccatgggaaagtgattcaacacagtgaaggtgattgtctcctcaggcctcctgaagccacctgtgcggtgggacttcacgtgtctcggccaaggcgagcatttccacaatgccgtggatgctgcagtcaggccagattgaaccatgaccccatttttcacatgataccaattttgtcttaaaattcactgagaaaaatgagactaaattttttttaaccctcaggagcacctgaagcaaatatttatccgtatttattgaaaattcattttgtttctacttgaagctttaaccccttccattcctgcaagtgtgccttttgagagctcccatggcctagtgacttcactggtcaccttgtccatcttacttaagaattttagtctctccctaccctcttggacagagcttcctgttctcttatttcacaggttatacagcagagcgggttttgtgttttcattcctatttccacccttcatttggttggtggactccacaacctcaccctaccctacactttgggagcacaaatttggtgttgaaacaagcttaaatttcattttagggcatactgggcttactctcctcccagctgtctgtggattgatttgattttaatgttcgagttttacagcaacagctgaaaaccatgaactattctaggaactgtgttggaactctttaaaataaagaaaagaggaggaggaggaggaagaaagaaaaccaacttaagaagccttgactttggaggacagaaagccaccagccaatggagaacaaagagatgtttccctttcctttctttcaccttgtcattctgggtttccttctgcttcactctttccttcccccttaaaagtggtattcctggttggtctgtctgtctgtccttgtccttgtggtgatcctggcatggtgatatgctccactttgcattatccatggtctcttaccagcgcacaagtcagtggggaggatctaaccacgcctggtggtgaggaagctgaatttccaggcctgcgtcccatgtagcctctccatgaactgcagaaggcatgttctgcatggttaccagtaagtggctccctctcaccgtgttcattgtcaaatgagagcaaactttaggtgttggctccattgtacactctacttgctctgctcccctccctccaaccagggttcatgtcagtgcacaccccatgtgccctggcgaagctggtgctgtgagtgatgtttcccatacaactcagggatgccaggtggct

SEQ ID NO: 6009 - DNA, 1165 bp, Homo sapiens
caccatgcctggtcgaaaaacggttatttcttaacccatattctcagaatgttattactttttgcaagacccagagttagtttttccttcaaaatttgaggtcttagatcattgttactggccaaggaggctagttgctcttccctttgctgtcggtcagtcagatccttgagttagaagaattgttggagaacaagttttctggtttacgattataccagaacttggctgccactctggttttcagtgaagagaaaaaatgtaatcaaaagcctttggggatgggcttggtatttgagctgtacctgtcgaattaaggtggctcacaagtggtattggaaagtgctgaagagcagatttcacactgagagtggaaacgaaattacaaagagcttggatgtacatgcctgaattgtttttgagctgctttcagtggaatactgatatttatgttttacctattacagctgttgagtggaatgtcatggccagctcctcggacagtgaagatgacagtttcatggctgtggaccaggaagaaactgtgctggaagggacaatggatcaagatgaggagccccacccagtattggaggctgaggagactagacataataggtccatgtcggagctgccagaagaggttttggagtatatcctgtcctttctctcaccgtatcaggaacacaaaactgcggcccttgtctgcaaacagtggtatcgacttatcaaaggtactgtggataggagaaaggtttatttattgatttcaaatttcactgatttatttttagactccaaatttagtttttttcctcccttaaatgtattatggttataaaatctagcattagacgatactacccggttttctttcttaccctggttagtttaatgaacagcttgaatactgaagtatctaatcccatttgcattttaaaatgaggattgtttttaaaagcttcatattcttagagttgatctggttaattgtattgttcttttctttttttttttttcagacggagtctcactctgtcgcccaggctggagtgcagtggcgcaatctcggctcactgcaagctctgcctcccggggtcatgttattcacctgcctcagcctccagagtagctgggactacaggcgcctgccaccacgcccggc

SEQ ID NO: 6010 - DNA, 1164 bp, Homo sapiens
catttctgtagatgtgtagcctcataggacaagtgatgtcaaggtttggcaacagtagatcttttgcttaggatttggacccggaacacagaatgtcaccttctgtgggctgcttggtgctacttggctgaagagcctttccaggagcaggagccataggagatcactttcctggccaccgccctgtgtggtatgcttgtgccctagcacttgccttgtgcccactcacagcagtcacagcgatggttttctttgactagcgatggaggtcaggcctctaacacaggagcctagaccttgggcaggactctgcatccttgtctaaagagagggttcccttaggtagtacgattccttatttcaggcctgcatctagatgcttccccacacaagttctgaggcctgtttaattccattgggctattgcatctctgggggagatgcacattttccttgtaatacaccctgtaggaaagttttgacttggtccagcttttcagagcatgagtctgagagcagattgattgcaaggccttgtctgagaagagaatagactgactcatgatacctggacagactccagagggagatgcgatgccctctccagctgctggcagagcattccttctcctgcttgggcgcctctgagcatgctggcgtccagctggccatctaaagatgaccaggatccactttccaccaaagctgcttgggtttccatcccattctgtaatcttatggaagaatccctctccagctctgataaagctcttctgcctttcacagtggagttggatgagagttgtagttcttggcatgccagggagcagtgtggaattgggggagatgaccaatatctaatggtttatactggcatttccaggggatttgagcaattgtcgggggagggtggtatgtcagcataggggcctcaaaaggcgaattctagggctgtctctgtggtttactaccttgtgaccttgggtaagttccctaaccctcatctgacagaaggataaaagctactttgtctgccaaacagggctggtgtgagcagaaaatgaatgtctggggaagaatgttgacagccataatacattatatcgatataaggtattattttaaaagctattagtattatattacatgccaagtatgttaatc

SEQ ID NO: 6011 - DNA, 2976 bp, Homo sapiens
gaggatcacttgaactcaggaggtgggggttgcagtgagcggagatcgtgccactgcactccaatctaggtgacagaatgagactccgtctcaaaaataaataaaaaataaagaaatgatgggggacatctattatatccttcttcaggccttcctctgcttttcttcctttcaggccaaccaggatctcccaacccgaagacagcaggcagcccaataatgtgatcagacagcctttgggtcctgatgggtctcaaggcttcaaacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatggaaagggaaagggtgggggttaggggaaggttggggggacccagcaaggactcagagagtcagacagtgccacttggccacttggggtaaagccagtgccagcaataacagtttatcatgctcattaatttgggatttcaaaacacaaatgaaaactcacacccacccacccccaagtgcatgtctccatcacttaaaaagtaagttccatttgaaaatatcctttcttttttttttcttcctatttttgtttgtttatacaaatatctgatttgcaagaaaaagtgcatgggaggggttttagtggtttaatgaatttttaattaagaaagggtagtttggtagtctacttaaaaatgtttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagagcctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacggagagaagacttgtttagtattttgccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaagaacagctttgctttgcaaagattgatgacagactggttcctcagaggcctaggctacccgtcacccctttttccagagcgagggcctggaatgaaggcagtttatcctctgtccctggagcctggggtttgctttggctccttgaggtggaagagactaagagggcagctgcccagagcagctgtgtgtacctggctcctctcaggcttcctgatcccttccgttgcactgcgccttatccctcagccagccagacagcctccctgctcctgaccagcagatacgtttcggagtggttggtgtggtttttgtgatgagggcagcacgtggtggccaaggtggcaagctgagtctcacaggctcactccctcgttggttccctgtgggaatggtaggccaggcccagtaagccatgccccaacacgtcctctcctccggaggaagggccagctgccagctgagtcagcagctagtccatagcacagccttataactgtaaagccaggcattgcccatgagcagagctggaaccagagcttcagtcagtaagagggaggattaccttcaggagaaggcaaggaagaaaactggctgctatctttatagttccactgccctaaccaagtgtccacattctaaatgtgtagtgtccatcccttatgtaatagtggtttcccgcccaaagtgagactttccttttaattggagaagggtatagaggtagtccaggtgggaacgccagaagtgctgattgcccagccattgggaccacctgttcttgccccactaccctctagtgggaggccaaagtaaaggctggctggtgggtgtctgtggattgaggatgtggcagggactggtcctcccacctccctctggccaaagatgggctttgcccgctgtgtgcctgtcaccacccaccagcagtcatgccctgggcttcccaaatggagaggtagcaggcaacgtttttaaaaagaaagaaaacaggaaactgtattgtgtcgggggaggcgggagggagatgaggaaacggtttggattttgtgtgtgggagggtattttttgggggtagttgtctgtaactttcctaagtgctttttttccttttcttttttaaagtaagttgcaggctttggcttggaaaaccccagggggatggggggcagaaacctgaggctgctgcccctttatctgccttcacggtactgtccccttcccccagctcctccctgaccccatgggccaggcctcagaccttccagctaaccgcttcccatgagccactactctgatgtcagcctataaccaaaggagctggggggtccaggcctggtgaccaacctttctcagcccactcaatcagggtgctccccacctgcaggcaggaggcaacaccctatctgctaccatcagccccttccagagcccatctgccccgcccagccctgccctgcccagccataccctgc

SEQ ID NO: 6012 - DNA, 1246 bp, Homo sapiens
tgtcacatcagaggaaaattgagaaaaaaggtttggataaatacctcggacattattttggttggtctccgagactaccaggataacaaagctgatgtaattttaaaatacaatgcagacgaagctagaagtctgcaggcatacggcgagcttccagagcatgctaaaatcaatgaaactgatacatttggtcctggagatgatgatgaaattcagtttgatgacattggagatgatgatgaagatattgatgacatctaaattgaactcaacattttacattccatcttttctgaagattgtcctacaatttggattttgatcatgacaaagaagattaaaatttcattagcatgaatgcaatttgttaaagcagactgatttgtttctaagatatttttggtttttttaaaactgataataatgctgaattatcttaagtgagatgttaagcccactttgttcttttaatgtaatggagcttatgggtagaagaccatgtctactaattacaaaaaaaaaaaaaaaaaaaaccatgcattgctgcttttcctaccacttccagtaagaaaatgggtgttttgaagaaatcatttgccttgtcctcacggaatctgattaagccctggcctcttgattgtatagagtcattgtgtatattccagttacctagatattcccttgagattttgatacaatttgagggaggcagaagtctgcatttgaagaaaaaaaataagtctgtttgtcatatttaagtagcctgtggctatttttatactgattttgatatcatgttcttttcatagtcgtattttgccaccgtaaacataaaaaaaaaaaaaaaagatttccaaaatgccgttttcagaacctgggttttaatagcagtattgaatttgtaagcttagtagttgcagaaattgaacactaggtggcactcagttatcttaacaggggaagtactgatataattgttgacttttcttttactatgtgtaagaaataccccaaacatgaaaagattgttttgatcatatgcatgtatgtagaatatttttgcagagcagaaagattatgttagaagtgtgatttttattttcagaagtcatatacatgtaagctacaattttgagtgctttataaacacttaagatatatatataaattttaatttcatagcaacttgtaaaaaataaaatacttgttgaaaagcctttttcaacatatccctaagctaagggaa

SEQ ID NO: 6013 - DNA, 1197 bp, Homo sapiens
ggcgcgggcgggagatgctggcggagggagggaggagccctggggtgctggggaggcagatgggagagaggtgccggccgagtggaagactggcgtgcacacgtgtgtctgtgggtgccgggggggcgtggctcctgcctgagagactctcctgctcccagtgcccttcctggtggccctggcgctcctgagctccgtcctggtgggccttgtcctggtccccggcctcctgcaggggccgctggcgctgaggaacatcactgacaccggcttcaagctgctgctgctgggtctggtcaccctcaacttcgtgggggccttcatgctggaggtggggcccgccctgggtctcagcagcgggagagaagggaggtgggggtgcattgaccccagctcagccccggctgcccctgacaccctccctgccctttgcagagcgtgctagaccagtgcctccccgcctgcctgcgccgcctccggcccaagcgggcctccaagaagcgcttcaagcagctggaacgagagctggccgagcagccctggccgccgctgcccgccggccccctgaggtagtgcaggcccacgggcaccccagacactggaactccctgcctctgagccaccaactggacccctctccagcaacaccaccgccaccacctcccacatccctgaggttggcgactgtctacactcctcccccgagaccacccccaccctggggaagcgttgactactgtcccctaccttggaccatcccgcgtaggggtggcagcccccagctcccctcagtgctgctgtcagtgtagcaaataaagtcatgatattttcctggctctgctgtgcctgtcttgtacctggcaccatagaccctcccacctgcccaggaggaaatgcacatacccccgggtgcccagctggcagcccctgcacgtgtctgcccctggaaccccctggggggctggtttttcaggctggtttttcagcctgacaaccccctggaaccccctggtttttcagactccattggccaactcccctctctgggcctgtgttccctcatctcacagtaataatgtttcctctgtgtccagcatgtgcctggatattccgtttagcttttttttttttttttttttttcttgagatggagtcttgctctgtcacccaggctggagtacagtggggtgatctctg

SEQ ID NO: 6014 - DNA, 1104 bp, Homo sapiens
ccacactccttccccttaattctggtttgtcaagcctccacttagatgacatgtgaggaagccttctctgactcttcactcattgaagtctctgctgtattcatccagagctccctgtactttcccaacagtatcgctctttatattcatcgtgaatgtttaatttaactcttgttcactacaaagtaagttctgtgaagatgaaggtttttgtgtattaagtgctgtgtcactagcccctaataccatgtctgatatattagcatatgataggtgcttaatacttgttggatattgaatgcctgccttttctaagaagattatgtgtcagtaatgtgtgagtttatatccagcgttacatctgttgtgccagcaaaatggaattatcttgtatttctaatttttttttcctttttgtgaactttaaaaaatttcaggcctcccgaggagcccagacagctgcagccacagctccccgtatcaagaaatttgccatctatcgatgggacccagacaaggctggagacaaacctcatatgcagacttatgaagttgaccttaataagtgagtatctctgtgaaagccagctattgaaggagagttcttgatttgatttagggacatgcttttcacatccttggaaggcttaaaaatctgagatcatccgatggctctgtttttaaaacaagaatgagcttgggccgggcacggtggctcacgcctataatcccagcactttgggaggctcaggcgggcagatcatctgaggttgggagttcaagaccaatgtggccaacatggtgaaactcccctctctactaaaaatacagaaattagctgggtatagtggctcatgcctgtaatcccagccactcaggaggctggggcacaaaaattgcttgaacccaggaggcagaggttgcagtgagctgagatcatgccattgcactccagcctgggcaacagagtgagactctgtctccaaaaaaaaaaaaaaaatgaggttgttacctgattcagaagaataataccaaaataattcccaaatgaaagtatgacaaatttctagaaatactggtataattaactttatgcacagtatt

SEQ ID NO: 6015 - DNA, 1283 bp, Homo sapiens
tttataaccaatgaaaaggttataatgtaatttatattcttggaggaacaagattttcatttgggattatttccttcaaccattcaacaaacatttgttgtatgccactaagcgccaggcacggcgttgggctctgcaaacacagtggttagtagcagtctggacctggtccctactggcatggaacccatcactccccaacatgcaaagcccacatttaaaggccagcctctgccccttcagtgatgcgctctttagaaatgccagtccactatattcagaaatccgcagggcacaaaacttccagcaagtcactgttgtggtgaaatgggcagtgggggtggggggtcttctttaaacaggcccccttcccatctacctagccagtacccatccaatgagtccccagagcctccagaagctgttgtctcctctctggggacagcagctcctgcctttggaggccaaagccccagatctctccagccccagagctgaaaacaccaagtgcctatttgagggtgtctgtctggagacttagagtttgtcatgtgtgtgtgtgtgtttggttaatgtgggtttatgggttttctttcttttttttctttttttttttagtctacattagggggaagtgagcgcctcccatgtgcagacagtgtgtctttatagatttttctaaggctttccccaatgatgtcggtaatttctgatgtttctgaagttcccaggactcacacacccgttcccatctcacttgcccacccagtgtgacaaccctcggtgtggatatacccccgtggactcatggctcttccccacccccactttctataaatgtaggcctagaatacgcttctctgttgcaaaactcagctaagttcctgcttccaccttgatgttgaaatatcttatgtaagagggcaggggatgtcgtgaagatggcaagaagaacacagtttcaaatttctggaaaagagcctgtggtggagatctaaagatgtttagggaagagctcgactaaagaacaatgaaataaatggtccaaggggaagtcatatggctgttggtgtgatgttctttgctgcttcatagacacggcctggagtgaggcaagccacacactgggccctcctggtcctgcagcccttgctgttctgggcacagggtctgggctctcagcataggtatcttgagggttcggaatccccaacacactcagcaactgcatattacatggccaccaccgaaggtcaagaccagtacccgcaataaagtctgac

SEQ ID NO: 6016 - DNA, 2634 bp, Homo sapiens
ttccgttttacacatgatccaacgttaactacctttttttctgtatgctttccaaagtccttttttttcccttaatgttgaattaaaatacttgctcatagttgatttaccattcctacaaaagaggcagaaactttgagcaatctaggttttttttttttttaagttttttctttcttcctctcctgaatacactccccaaaacacccctttccagttacaattagcatcgtgatccaagcagatgccacatggaagaggaatcgccatttactcagaaaaaatgtcccttacaggaaccggcagcagctaggcagtcaccggcccgcctccatccaaaatcacgctcgcgtgcttcggaagcatccgggtcactccttctccgctttttcttgcagatgggcctaggccggtgtcggttctgtttctccccttggctgcctgtacgcccacagccttctggctgcgacattatagaatcggccgtgtcccccctggtgggggattggggatctgtgtttagccatttatatctactttagctgttaaagaggtccaaatgaaaatcaggtgattgtggaaccatggggacttgggggtggggcagaggtgggaacatttgtatcagttgagtcagcttggtggctccctgtggagccagggctgagccttgtcacgcgcactcgccaattaagagatggaccagccagcagtcaagtgcattctccagtccttgcaagaaggatcagccctttctgtgccagcctcgatcgccttgtgctttggtctctttttctcccccccgcctggatcctgcctcgcgcgggccgtcctgttgctgagactcggggtaccgttctgctgacccagctccctttagtcacgtttgcttggctctggtaccaaatagttgggattaccgaagagtccccttccttgcgtgtcagcacggatgctgtgactgccacctgcgtcctcgtcaagtgcccgagctcgccgccgtgtgtgctgcgctgagtgagttatgaggtgcctttcccggaaccctcctctcgcctggacccaagagaggcgacagctgtggctggggctcttggtttccagagggtctggactggtttgggtgctttaaaatagatatttagttcagtggtgcttatgggggagatgggactagaacttaagtgtgagacttgggtggatgggaaagttaaatattggtctcttcaagttttttttttcttttgctttgttaccacttgtcactgtctccatgttaaaatgccaaaaatgatgtagttgttgttgcttttttccctattttccaccccagtcgctccttaccgtgactcctgcccttggagggcatgtagcagtgtctgtcctgccagtcccaaggccctgtgggaggagactggcctgcatctctctaagacttagtctgacgccacgcgcatctcttgttctgtgttcaatcagtagtccaggggagaagcttctgctacttcagagctttgctaaactaacctaatttgtccaaatcaccccaaaaccaccatctctgacgtaagcttccatgcgacagcctgatccgtttccctggacaggtctctttcctggaatgcagcccaggcacctgtgctcctggcacccttgaggtctctcctttgagccgtggtcaccgagagggttgaggacgcagcacccgaggtcccagcctttgcaggagcctccctgggcttagctggacttagatcttcggtggcctcatgtaaacgtggcagccagcctcttctagaaccctagcccagggactggagcaggaaagggaccttcaaagtgaagactgccttgtcccgcagctccttctggcttagattgaaaaatgggcttcctaatgggttaaatcctttaaaacaaggagttgtgggggaagggtgtcgtgcactcctagagaaaggtacacagttgcccggttgggaatgtgcttggcgctgaccctgcgggcatctgactggtcttccagctcaggaaaaagaatttgaaagaggcttagcgtgaaggggaatcaaagaggaggttgtgatttggtcgaaggtgcctggtttagtgctgtaattgtcttattattttttttatatatatatttcttggagtaaacattttaaataaacaacaacattgtctactgtcttggattttgcatttctttttcggttggaacggagctctgtttttcttaactccttatatgtgtacctcctaagccctggcacccacagaaggtggtgccaggagacatgtggccccaggggagcttccaggtttaaactgcactggttgaagtgagtggatcccccaactctgccccatgaaatgctaggggagtgggacagagtcagtacctcagttgtccaattcagaagtggagttctttgcattttcactggggctttgagaggaaaaaaataagtcatgggaggcatccagcgcggtgactgcatgtgcacccactccccagacttcagcagggggctctggtcaggccccggctgtggcttcaggccagtgctgctctgtgcaggcattgtggccaactgcccaccagagggcaccaggaggctggtcgtaggt

SEQ ID NO: 6017 - DNA, 1103 bp, Homo sapiens
gaaggatgagatggtcccccgcctggtgaagctgtttgacttccctgggcgtggggcttcccagatctatgctggttacacctgctcctttgctgtcagtgaagtgggttagtgatttctgccccctggcttatcagtgctctggtgcggaaccgtgtagccattgtcctgtccctagaccacgaaccccaattctctttacctcccagtgttctttatttttttgagacaggaactcgttgtgttgtccaggccggtgtcgaactcctgggctcaagcagtcctaccaccacagcgtcctgagtagctaggactgcacaggcacgccaccacgcctggctccagttatcttttagacagaacacttgtttgccatcccgtcctcttttcaccctgataatactgaagatgagactcagctctcgatgtctggtcacgctgggaacatgttttgtcttcccttaggtggtctgtttttctggggggccaccaacacctcccgtgaatctaccatgtacccaaaagcagtgcaggacctctgcggctggagaatccggagcctggcttgtgggtaggtggcagcatctcctgtgggtatgaggtctcttcctttcatgggggtgtcagacacacccatggggtgcccctccctgatggggctctgtttctgctgcctgttgggctgtcctcagcaggccatctgacacactgaatcccagagtccgggggtacaggaggggagagggcccatttgctgctagaacagatggctgttccctgtcttgtgggaagaaagtcattttgaaggtttctgttcaaagaaataaacaagcagagcttgatgtattcctacgctgcaggttgaaaattatacgtagttggaaacgtagcaggacttgagttgctgtgacactgggaagacgacattgtcttggcagcagtggtttgtagttcatttcaggacacctgttgagttagctagcacttcttgctgaggagttggatttatcagctggcaggtgtgggtggaacagtatgaggggcctctgtcggcgtggctttaatctgttgaaggctctagccctgcccaaatcattatgcat

SEQ ID NO: 6018 - DNA, 1150 bp, Homo sapiens
gatggggtttcaccatgttggccaggatggtctccatctcttgacttcctgatctgcctgcctcggcctcccaaagtgctgggtgtgagccaccgcgcccaggagataggcagtctttttttttctaagaaacttgagttggaggggtgagatttataccttaaaaacaaactactactaaaggcagaagaatgctaagtgcctaattagtggtctaggtgatgaaggaagggagggacttggttttattgatcttaaagagacagtggctaggctttgaactgctctgtgctgggagggtgggggtctgagggtgcttctttacatatcttctaagctttgtgttctagaaatgccttcagcttttgccttcagaattactgagtttattaaacttccgtttgtaacctagtaattgtttcccaccaacatgcagagaggtagaggctttttatcagtctttaaaaaaaatgaaagtctcctttcttgtcttttcagataatgtacaacggccagccaattaccaaaatggcctgtggggctgaattcagtatgataatggactgcaaaggaaacctctattcctttgggtgccctgaatatggtcagctgggtatggaagtacattttttaaaagctctgtaatctaactgtatatattcagaactagagatcagtgtggggctgcacacacgtgttagaaatgtgggtaattgatctcagataatagcctttgtccgttaagtggatctcacgttcagcagaacagcgcgtcctcattcacaggattatggagtattgcaacactgcctcaatggaaaagttgggactggagtcctacaaaagatttctttttttctgatttgggaattcatttatataaagggatttcaaagttaaaaaaaaatcagaccaccttcattcaatttcacatttaaagattatgcctttattgaaaatgagaaaattacggaaaatgaacgttgttctggaaaccctggcctgggcgattatttcgggttgccacgtgaggagccctggtggaccccctccccgtgcgtcatccctagccagaatctagttgtccagaaacttgtttcttcgatctcattggtggaaaaggagaattcaggcatcagttctcagttag

SEQ ID NO: 6019 - DNA, 1235 bp, Homo sapiens
cctctcagtgacctgccccacacatgggccaagtgctctcacagcagacttcttttaggtaaagaagtgcaagatgccagcttggcatctgctccctcgccaccaccattaactgagcacttactatgagccaggatgcccgctaaggcccttccctgaattagctaaatgtcttgtcaatggacattattgtcctctttttacagatgaggaaactgaggcccagagagagccacaaagagagtctgggagagttgggattcagacctgtcattttgtcttcaagcacttagtaagcacctgctgagtgccagccagtgtgcttggtcgtggctttgccgttaaaacccacatccttacccactgaattcaatgctgctggtgcaggagcgctcttccctcttgggtgcagagtccatattttctggattctctaggatggtcccaatggcaacactttttattcttttcaataaagataatttgtggtatatataaccaaatgcactctaatgtttaaatcttggtaacactttttgcatgaataaattcactcttcccttcccactgggagtgctgtgtctaatgagaaattctcatttgggctgggaaaatgcggtcgctgaaccagagggatgggagccggggcatctgactcaaagctcagggttccgggagctgtctacgtcacacgatgatggggccagttgggttcctgagcacctccccctgctggaagatcgtgcaggctccctgggcgatccatctcacccaccctcttcccagtgtcttcggcctcccagagcttcttgctcccattccagagcccagggccttcccctctgtcttcatttttcaccaccctctgcagtgctgtcgtcaggtcaggaatggaccactgtcaggcagtgtggctcagtggttatggtcaaaggctctgggacaggtctctgggtttgaaggccagccccacaacgtgttgggtgtgtgacctaggcctcattatctggatgccctaggcttcaatttcctcatctgtgagatggggttaatattgtagcagatgctgtcagtgcctggctgtactctctgtatttctctccacccgccaaagtctgcttactgtgaatgaaactcattgcctgaggcagcatccctggccagtgcacagggcaggccagaagtgcagagagctagggctcctggaagcagctctcaaccaaggacagacaggg

SEQ ID NO: 6020 - DNA, 1519 bp, Homo sapiens
gggtcttcctccaggatgcctgcatgggaccccacccggagctggtgtggccattccccaagtgccactggcccatggatgggggtgggtgctggtgccagctgggctgggtgtgggttctgtgtccttccaggatatgtgtcatttcccatgaggggccggggcaggtggctgggtgggggcacaggctggagtattcttagttctactggttctacactgtgaggtggcaatgggatttgctcagatgccacccaataaaatgcctgttacttaatcacagtggtggatggtctttctggaggggatggtgggggcagccaacatcttttaagtctggtgtcattgccaatgtgtcacctggtcatgggcacagtgctctcagtgtgacagaaggaacagtaggtgctgatgtttgaaattgtctgttggaggcggtggggctgggttcacatcctggctcactgcccccccgccagccagatgattgccacaaagttatgcaacctctctgaccttccatctcttcatccataagatggggtaaccgccccctctccccgccatgggtcatcatgagaattgaatgagttaacacttccacatgcttagaatagtgccagacacatgatgattcaaaaatattacccataaggccgggtgcggtggctcacgcccgtaaccccagcactttgggaggccgagataggcggatcacttgaagcctggagtttgagacctggctggccaacatggtgaaaccccatctctactaaaaataaaaaaattaaccaggcatggcagcatgcacctgtaatcccagctacttggggaggctgagacaggagaatctcttgaacctggaaagcagaggttgcagtgagctgagatcacgccactgtactccagcctgggtgacaaagtgagactctgcctcaaaaaaaaaaaaaaaaaatacccgttacccattttcgttgtaagaaccactatcctgtgtggtgatggttaattttatgtgtcactttggctgggcatggtgcccaggtatttggtcaaacattctgggtgtttctgtgaaggtgtatttggatgagattaacatttaaatcagtggagttttaaaagtaaaaagcaaggcaggtgaccgttcatcctgtgggtgggcgtggtctaatcagctgaaggtcttcataaagtgaagaatgagctctccacgcgggaaggaattctgccagcagattccccttgcactgaatcgctgcagctcttccttgggcctccagcctgctgggctgccatgcagattttggacttagtaagcctccataatcacatgagcaaattcttaaaacctctctcttgctcctgttctgtgtctctggaggatcctgatgaatatgtgtgctgaaggcccagtatgtttccttacaacagcctttggaaggaattctgccaccctcccattttggagagaaggaaatttaggtacagaggtcaggggccttcctgggggtatggt

SEQ ID NO: 6021 - DNA, 1452 bp, Homo sapiens
tgtgtcactgtgactgtggaagttggagctagtgagaggaggaggaggtgggcagaggaaggagggtcccttgggctcgagctccacatcagccctgagctgctggcaagcacccctggcctgcagccagggagagccagagcctttgccaggcagcgagcctccgtgccttccactcctaggtcaggttttgacagcaccactttattactttgtttaagctgttagaaaatttcagaacatcagacacaccctattcaaatgtgagaacaaaaacaccttccagcagtgcctgcttctggaacaggactcctcctgcggaacagggttttgctcaatgactacctccccggtcatgctgctgtccagtgagcagccgggccagagcttgtcggaccgcagtgtgttctctgctagatgcggcagctgtgactcagggggaatgggggctgtatgcctgctcctgacacacctctgcccgttgtgctttgcaggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaaggaaggtgttgcctgctgcttcaactcgtcctcagtggcgcaggccaaatggtttcccttgaatgcacagccatttccggcgtcagcccgggaagactcatgtcagacccgctgtctccaggcctgttgtcagcgctaagtgcaacctgtctattcttggccagcaagttggggcaccacattggatggctctgatttttcccaaaacaaagcccatgccttgctcttaattttttggccttaagagctggaacccaaagacacgtggagcccagagctttcctagccctcggctgaaggaaggctcgcggagtagggcacagtcttgttggaccacagaggcctggggagcatttgacattctcatgctgctgtgaatcgggaatcccttggtgacttctctccagggttgtcatgttaagagagggcctggggcagacttaggatcaggataaagagagtggctgctattgacattgccaagcacccagtgtatcttatttctaatctctttgcccatgagccagagccgcttgcccaagggctcccagccaggggctgtggagttgtc

SEQ ID NO: 6022 - DNA, 1212 bp, Homo sapiens
cacctctagtatccctagcctgagaaaactgtgctcctaggtttggtggacccaggggctcccgtggagaactcagggcaggtccttaggagaacgtccagtgcctgctctggctgctggttcaccactcagtacacatcaggtgttgctgcttgtcttaccagaatacggggatcttctcctggcccctttccacatcctctgtgatggatgctttgcatatgttatctagtttttagtcatcacagcagcccttgcactatccccattttatagatggaaatactgagcttagagcataggaattggtcagaggcagtggcagagccaaaccctcttccatttgtctgtgtctgtcaaagtgtggaatcaaaggacctgattgcagctgagcaggtgacatgagatggtgcatgctggttgagtttctaaacctttaagctcccgggaagaaggtttgtctacataattggaggcatgtgtctctctggtctcttactggcaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaagcgcatggccatggcaatgaggcagaaggccctgggcaccctgggcatgacggtaaagctaccacctagagtccccatatttctgcccacactgttgatgaggaggtggccatgggacagccctggggttggccatggggaaagagaaggctggacagagtaggaggaaggaactaggtgtgttcggccctctcagaggtggaactactatcgttctatcatacagatgagactcggagtaagtgacttacgaagtttaccaaaacagtaaaccagtgataatagccattaagtttattgaggacttatttaagccctcaagtagttctaggaggttgatattgttatacccattttccagatgaagtaactgaaactgagaggtgaagtaaataggccaaggcacataactaataagtggttgacacaaagggttctgtgctcttctaactgtcccaccttggaggaagcagagtcctacaagctccttttccaaagcacagacttgagtgtcagcagttgaaaagctcacctgggaac

SEQ ID NO: 6023 - DNA, 1101 bp, Homo sapiens
ttggcatttcctcagctgtggtacatagttggttactggtggaatcaggcctagaacccagatctccaactcccagaatttctctccacctgctatgcctgtaatttcctccattcttattggtgctaatgatttggctagagctatgaccaagtgaatgtccagcagcctgcattcttttacagggagggaagattgtattggtatattttgaccacctgagacaattaacagcactgtcacagaaatttagaaacgaatttctcaagtgaaactccgactgtttgttattccccaagaagtgccgagacatagttcttctaggggtattcctgatgactctgatggaagtggtgacttttggggctcagatgttggctgcagccacagtcctgactgcattaatggcatgttcaccctcttttctgttgcagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataagtatgttactttgatttcatatagtgaaatgagagtctccactaaaacgccgaactaggtctgtgagatgaggaagaatcctctgaatacctattagatttttgtgtcctcgttctggcttttaaggagctcagtctagttgggaagtgaatagttaaaatatactgtattagagtagcaattggctagtcagagaaggcaaagtggttggtgagatgggaggaatatgacgagatggagccacgtgtgcgcaaatgtgagtgcaagagaaggctgtgagcgtgggagacatagcaggtaaacagggagagtggcaggagccggggcagataggtctttgtgtcacgttagggaatttagccttgatcttctataggctgttgacagttgttaaccaagagggtgacatgactgggttttgtcccgcctttcacaccctcaaactctgctctttcctcctagatatgatgaagatc

SEQ ID NO: 6024 - DNA, 1171 bp, Homo sapiens
tcttgactagagtgccctgtccctcttggtggcagttacctggatgagctgagcatagctggggagtgtgcagctgagtacctggctctctaccagaagctcatcacttctgcgcactggaaagtctacttggcagctcggggagtcctaccctatgtgggcaacctcatcaccaaggtatcctaccctattgcccaagagagccccttccctaattcccccttgtaccttgatgtaaactctactatggtgttttgtttgtttgtttttgctgagaagaaatatttgttgaaggtgtttggaaatatttttatgacttcattgtatttattatgtagctgtagcaaactcttgggagcatttggactgtttacagtttttaagcaatcccttaccagcgctgtgactgttggcttcctggaaaggagttctgcaagggttcgattaagaagatgtaactacagagtgtctggtgctgcaagctcctgggacagtggtggaggtaactggtatccttggcagtgatatcacactgactgcacttgtcatcctgtttaggaaatagctcgtctgctggccctggaggaggctaccctgagtaccgatctgcagcagggttatgcccttaaaagtctcacaggtaaagagccacctggaccttcctttagggcatcctgaatctgtttagggacaacccttagttccttgggtgctggggttgactctcttctctctggtactgaccttagtgcagatttaagctctgcattttttttctgtattgatacgtttatgattttgagaccctgtttgctattgactgtttccgcttgttgaacacctgctctgtgccatgcacaaagatagattttccctgctttttgagttgctcataatcttttgagacacagactgtccttatgttttcatccagagctctcacagcaacattttcctgtctccacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtagcactgcccagtggcctggagcctaag

SEQ ID NO: 6025 - DNA, 1142 bp, Homo sapiens
acatgccttgtgtttctcagcttcccctcccaggtcctgcggtgactgaggagggaaggagcagaacattaccccagaatggttttcccagggaagagcctggagcacaagggtctccgtctgtcctttgtctctgttggagccacctaggaccagaaattgtattaatagttaagagtcgctggaccggagctgaccctcttgactcatgtctcttcccattgccttctaggcaagtagcctgcagtatgaaatgctgctgctgacggattctatctccaaggaggacagctgctgggagctccggttacgctgtggtgagttaggggattttcagagaaaggaaaggaggctcaaaggagcagtcctggccggactgggaggggaggagggaaactgatgcttgggcggcctctgcagagcagatgtgtagtgttcctgattgtgactctgcctttcctgaccatccctagctctcagccttttcctcatggctgtgaacattaagactcctgtggtggttgaaaacattaccctcatgtgcctgaggatcttgcagaagctgataaaaccacctgctcccactagcaagaagaacaaggtactgggccaagcaggggtctaacaaggaagggcagggcggccaccctcctcattccctggcagtgtgccctgcctcctcatggtctccgctttgccttgagcccacctcccctgagaggctccagtgcagcctttgccttagttcagcagatatgggttgggatttttgagaaggatggttcaagtaaaataaacatgaaactgcaaagcagagagcaaagtggctagctgtgaaggatgaactctttccagtcatgttagataacttgcagcccccagaaagcattgtgtccttcctacccctgtgcctttgcacatgcagtgctgtgcggtgatagaaatcccaggctctgaagcagacttcctgagttcaaattccagcgcttccatttattagcatcatgatgttgggcaagttgttccttagtttccccatctataaaatgggaatatagtctccaccttgaagtgttgtgaaaaataaatgacataatgcagactaagtgatcaaaacggtgtctgcctaagttaatccttaa

SEQ ID NO: 6026 - DNA, 1059 bp, Homo sapiens
atctccatgagatgggaggctggccatagacagaggtacctcatataaggagagcatccagtttaccttccccctcaaccccaaattgctggagtgccatctttgctacacgtgtattagcttctgacctttgtctttgttacatgggagttaagagcataagcctgccatctgagtctgagttctgactctgccacttatcttggtcaagccactttctccaagcttcagtttccttctctgtaaaatggagataaagcatctaaccagttgggttattgagaagattaagttatataatgcatgtaaagttttttctaaagcaaaactaattttctaattaacatcctcttcttattttaattgctaattcccattattgttgcctttttgttcttagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcggtcagtacctacaccatggttatgggcctagtggttcctactgacactggcagccatgccaggagcgttagagagtgcacagaatagtgcttctgaccacccagcaagttaggtagcttataacaaaggaaagatggaaagagacacagggtgtaggtgagcgagcttggggagcattgaaacccaggtttccttgtaaatggcatgattggcttgtgcttttttggttccagtacagtgtcttgaggaaactctccctgaggccttgtgagggaagggaagggagacacttgaactcgagaaagactcacatga

SEQ ID NO: 6027 - DNA, 1681 bp, Homo sapiens
gggaacttggcatgcatcatcattgcacctcttacaggcttcagtgtggcatgcttttggagtcatggtttcccttgttatatacttctgttgttttcctggaatttcaaaaggtatcatgtataacagcttaaagcacttgtatgttctttcctttttttatagagaaaaggtagtagaaaacttttttaaaactggcttcctattatatgccagatttcttttccttagagtaaccacttaattgccttagaaaaatacatgggacagtcttcctctttgtctcatcagactgttatcactgagggttagatgagaaaatctcaaggctgtctgtctttcctaggccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcaggtaagtcattggtcatcccctaggccagggctgtgcacattccttgttatttttctgtagtagtgtcagtgtgagcaattacagtgtctgattccctcagaacatttagagaattatgggtttgtagagtgggttcaagggtagaaagggaggaggaagaagagagagtgagtgagtgtgtgtgtgtgtgtgtgtgtgcatgtgcacacgagtgtgtctgtcctgtggcaggggtggagggtaagggcggagggaggtccagaagtttagctctgggtcttgctttcttgttacctggctgcttaagtcattcatttgttattgtcccttcagtagcccctgcagtagttaccagagtatataaatgtggcacaatccatttcctcagagtgacccccaccccacccagccttgtcaccttactgacccaaacgctttggttactcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggtgaggccagatctggcctagactcagggctgtggccttgatctggactttgggcagacctggtgcagtgcagtgcactttactttctagcctaagccttcttcgactcaacaccagtttcagggcccagcttttgggtgggagcaaagaatggcatgaggtatattgtattgaaagacatggtttgcataggattttagaaaagtgttgattggtaatgaaactagagtatctccaggtacagataactttggatttggatgctttgccctgcatttcttccacagactgcttcatattgaggctgctggccctccctcagtattagattgtccagtgctagttcccagcctgcataatatgggcaggggcggggggaggttctagatattaaagaacagtgaaaaaggggcacctatagggttaacagaagaacatttagctttggagtcagaaggacagaaattctaattccagccatacttttaatacttgtgtaacctagtat

SEQ ID NO: 6028 - DNA, 1111 bp, Homo sapiens
actcacccccaactcctttggaagctggttctatggaagactctacagggggtggggtggggtcgttcagaagtgcctataatggaaagttttctctctccttcttgaattgggcttcttttctagttgctcaagataaaagaggaaacgcgtcccctccagggggaaaggttatttaatccttgcctccctggcttctggcatatgtgcgtgtagcaaggttagagttgagaacagatgtgtttctttgtttgtcttaccatgtggttgttcaaaaaagttctgaaaaacctcacaaacttccttggggaagtttcagtgcaagagcctgattcactcactgccataaaagctaagactgttgtgagtgtgtttcccatccccaacacccacctggatttcacattgtttttacaagccattcttcccatctctgtattttctctgtctcccagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaaggtgagatctttccctcatcaaagaaacactcgtcctttgttcagagcactcttctctttcctcgcggtgcagagagctcaaggggctgagggtgaagagccataggaaggagccggcattccttggtgggggttaatctcggcgtgattgaataaatgaccacttctcccaaccttctgtgggattctcattcctgcctctttgtaaattggaggaattgaatgagatcatggttatctcgtttcacattaagtttagaaaaagatgagaaggtacaagctaatgtcatgagttgtgggtcatgacatgtgtgtcagatattccctgtgctgtcaccactgagaggccctttaacgtacttattaagaagatgggccttctgatcagattgatctgggataagtcccatcttgtgttcttacttaccagtcttgaagcatggagaa

SEQ ID NO: 6029 - DNA, 1663 bp, Homo sapiens
ggtcagagaattttttaaatgcacaagttcatccaggtagttattgacagagccagtgcaaaagcccacttctgagattctgagtctctagtctttatgttgatattagagtgtgggccaatagctgttcttccactcactagctgtcttcctcagaggcaaaactgttctttaattcttagtttggtgtaccaccctttctcaagctacttgcttggatataatataggttagtccattaattttacaaactttttacaaaacatttttttgtaatgtcaagtgtggcatatatcagaatttgacttttctgactctgaacactgaagctttggatacctggaatttagaacgctataatggattacagttatgattgatagggatgtcaggaagattaggatttcttctgaaacaccccgtatttcaagtcgttcttctttaggaaattgggttttgtgttttctgtctttgacttctaggtcattctaatgctcactacagatctggatggagaagatgagaaagacaagggggccctagacaacctgctctcccagcttattgctgagttgggtatggataaaaaggtaaaatctgagaggcagactgtgtgagaaacaggattggctgagatcctttctcaggttcccattcgtttcatagaggaacttcacctcgtttcaaggggtaaccatccactgagggctgcattctgttgagtcaacaaaagcgtattcagggcctgctttggcccgagcatagttttggaccctgagcatagttgagggcaaagatgaagttcttaccctcatggcccttttgtgctcagtgaggtgagaacattaaattagttgttcgtatcttaatatggcctcttaagtgtatcgggctctaggtaccccaagtatagtccatggatatactgggggttgttttgtgtctgattcaatctgaggaacattttagggctgatgggcttgacttgaagggatcttgttcagaggatgcctcaagcatcgagtaagtagaggtttctggacttacgctttggcctgcaggatgtctccaagaagaatgagcgcagcgccctgaatgaagtccatctggtagtaatgagactcctgagtgtcttcatgtcccgcaccaaatctggatccaagtcttccatatgtgaggtatttttgctttgggttcatgggtttggggaaaggtaagcggattgtctgggtagtgctagggccagcacagaggtggtagtcctctgtaagaataaagccattgttccctgaggggagtaagattctaagctgtcaccttttcaagagcagaacctccaccttttcccgaatcccttccaagctctggtctttggtaacaatccctccaatggaggggtaaaagggtttggaagttccattattgaagagcagggctctcttctgcaaggcacagagtggctaagaggattcccctagtgtatgttgctataaggtatggtaataaagcagagagaaagcaatgtgtgtgtggtgaaaggagattagcataaagcagagaaggtagaaattgaggctgaactgcatccaatcttaatgagcttagggagctgtggggtttgctgggatttgcaaggctcttctaatggtcttatttacagtag

SEQ ID NO: 6030 - DNA, 1201 bp, Homo sapiens
ttccttattagaaggccttctcaccttcacacaaaagtgggcacaggcaggacctgcagtggtgtccttggtttccagtcaatggttttacacttcaattctggttcttctcatagtaattacgtagtgtgaaaatctcactgacctagttgttttagaaaaaaatagtgaaataaattctaatctgccatgacagacaaaaggtaaagatcccaatcatatgatttttcctgtcttatccaaggtctcctgagagttagcgtgagtttgggaggcctactggttttagatctctcacctttatggaaatccctttggaatccaagtttgtttccttcaccagctggaacattttatttttgtggggggcaagctgtcgcagccaactccatcttcccagatgctgtaggtccaagaagtaagagaacaaggccaggcatagcaccccggagttctcccgctaaagcccagggtgctagctggtagcttgtcttgggtttttgttgccacctgacttatggcaccatgtgccaagggaggaaagcaagcaccttcaggtgactggggtttctttgactcaggagacaaggatgatgatgacgatgatgatgcagatgagaaaatgcagtcatcagggatcccgaatggtggtcacatccgtcaggaaagccaggaacagagtgaggtggaccatggagattttgagatggtggtgagtctctggcagcaggagaaggggaggaggagcttcacaactctcctctagctcttattcagtggacttccaaaagttaccacttaccatgggacactgacagagctttctctctgcagtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaaggtagaaggccatgccaagaacaaagcggcccattggccttgcacaggaaaagagggtttggcagttactgatatccagctgacttagtttgtccccagatatggggagaggttgatctgggtgagagctgttcagagatacaggtggagagtgagagggatgtggtgggaatttcagtctgagtgccaa

SEQ ID NO: 6031 - DNA, 1201 bp, Homo sapiens
attattctatttctaagctatttggtctctaacttcttacactattgaaaattcagatggaagagtaaagggtctgaatagcaatatagaaaagtaggatgatcctggtgctcattcatgtttggaggacatttgggtggtaaacctaaaaggcaagtcaaggtcatgttttgtcatcacctgaggttgggggatattagggaacatttagtatctgccttcctcttcatatttccttgccttgtcttttgatatccagagagagtggacagctacttatttctgtgactcaagatatctggaaagacttttgaggacaatttgggagtttaggaaactgttaatgaaacaaatcataaataatacaggctactgtgtgtgaatgagtgtgtatgtgagtgtttgtcattttgtttgcatgaccttttacatggagataaaaggttacacttttgtctcagactctcaagtagttagagttttttcctccagattttcaaataatgtttgtctctcctttaggactaactcatattgaagctactgtcaatgctctggtggacatcatccatggctactgtacctgtgagctggattgtattaacacagcatccaagatctacatgcagatgctcttgtgtcctgtacgtagcattacaatcccagagagctcgcagcagccagggaatatctggaaaattgtttttagcttgctaagctaatgaaataaaatatatttagaggaagctgaagggaatgaagtttcaaatatcaataaaagctttaagatcttactccatggaagagaaagatttggaaaggggatgggctcagtctttcttattcagtgctgaatcaccagggacagcctactgcttgctacatagtaagtgctaggtaactcggtgaattgtgacttaaatgagcacatgaatgaaagtagtacatcaagatttctatttccagtgaccctttcacagaagctaagtgttaaaactactgattttagcacagagctaagacgtgcgctgggggcttgatcatctgataaaaagccagaaccatttgtaaggggccaaaatggcctcaggagcaaatgacctgccagtccatccccaggaactgagagacaggaggttagcgaatggctcttaatgtgtgccagaacaggaagcggggattaacttaacctgctgaactt

SEQ ID NO: 6032 - DNA, 1158 bp, Homo sapiens
ggtctctgagctggtggtctagcacttgactgactcaggactcttcaggaaagtgaaagcttgagtttagcagtgagcaaatccagctaagcaaagaccattacagggatcatcacattaccttaaatttgctctacagtctattttgaaagaatggtttattcatttacattcattaaagaagtagctcctattgtttattttaaataacccagttacaggagagcctattgttattagctgtacacccaataccaatgccagatttcttggtattgctaggacatgtcatagttagggataacaaccattggagagctaaccacatgtaggcatcatgccgatgcaaatgttataatccagagtttgcttagattagagtgtgagtgtgggctctgtctgggaggagtctttaccagtggtgttggggcagaggtgggagagactcttgacgatctggtaccgttctctgcagcaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaaggtaagaatggcactgggctgggatcaatccctgggtagaaggactcaaacaatatggtttgagaacacatctccttttagaaagcaagtatagagtatatactcacagtcacaaccctcggttctagttaaatggttccttagaaaaatggatattcttactcacttggcaaaggacttgtacaggttgggtttccaccaataccagcaggattactgtgtagaggacatcaaagaggtggttaatactggggagaaggaagcctgacattgaagagaatctgctctcttttcctattttcccatttttagaaacaaggaagtcattaccagggagttaaaaggataagttttaatgagcttcacatgttgagacaatgtcagagaagaaggagtcctagttaaaacttaagaacttctgtagtttcttgatgtgtgccttgtctccctacagcccggaggcttcaccattgagattagtaacaacaatagcactatggtgatgacaggcatgcggatc

SEQ ID NO: 6033 - DNA, 2342 bp, Homo sapiens
ctccaacctgggtgacagagagaaaccttgtctcaaaaaaaaaaatgagtcacggttttatttgatactcttggaattaaaagaagtcgtaaaatcagtcacacttttagagcattggtttttagatattaaagatgaagtgaaaaaatacttgggttgggggcccataaagttgctgatttttatgttgccaggttagatcaatgaaaacaaatgtcatctgtcaccacaatttgtaagagattggacattttaacatttttttaaaagaccagtactttgtatttaagtttagctttatgaaaacatttactatgttattcttaatggattgataataactttaacacatttacacagccatccacggtttggaggccgaaatcactgcttttgaatgactgaattgtgcagtgtctcaggcacatgaatagtgcgtgaatccacttgattttatttgcctcattactgcccactttctctgcttccttctttgccaggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaaggtgggtcctccaattcttgtgcgcttactttaggtcatattgtcttaaatgctaagcaaaacaaattgatgaccacattcggattagccctctgtgggaaaaagtccactgcgttctaagaatgcttcagggacagatcttgttgagcttttcaaatacttgaaccctgaattgatttgattagacctagagctggtatgactaggactgttcctaattagtaaatttccactcaaaacgtattcttcaaagccctcaggaaaaagtaatgattagcagttaccgaggacggcttggctcccagtcttgccctgtttggtcactctggcgggcataagctgagagacaaaagttttcataggaacactcagtgttgcttatgtagtgctgccgtgccatcccagctctgttaagcacataagtaagtttgtattgtgttatagagctagtagaagttggaagagtgctaggtatcttaactcacacttttctgtattctggcctctccatcaccactaatgttgttttaacttttattttaagtgaaaatatggatagtccttcaaacaactctaaaatcattttaaaaacagtttcctagaaaactagaaaaggacagtggtacgtaggtattcttaaactattttgtgaactatataaagagaaattgttttcattacttacctgttctgtcctccatggaaatacattccatagcttttagccaggagtaatagagactaatactgatctaggattttctactagacttatctgtaaagaaaaaagtgtgcaacctgttatccctattgaaagagtttttgttacttgctttgacttctctgagaggaccaggagtaggaataaattagtcattgttcctttgcagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggtaaaaatccggatctaggtttgattgccttgagctgtggattctagtcattttctctcccctgttctcagaactactttttcttattcgttgtggagattaaaatttaaaacctactgaaatgcaaaaggaatttttctttgaatttctcccagatctttcagatttctccaatattggaagtaatctttgtgttcatgaaacctgaatgttactagacagtctaaatactgtctgaaggcaggggatattagaggaaaaaagggaacgtcattactctgaaatgaattagcccacttttcagatcatcttttcaccattttgtttcttaaacattgtccaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaaggtacagttacagttctttgatgatatggtcctagaatttttctacttttaaatccagaatcactatgtgctagcttctcccaggagttaaaaaaatcagctgggtgccatgactt

SEQ ID NO: 6034 - DNA, 1118 bp, Homo sapiens
tggttaaaaaatgctaatgttaggggggaaatgctaatgggagtctcttcatactctaatctggtcttttcttgaatgattttaatcagtttttactctattcttctaatttcaatcctacttcatcttacaagactttgtaaagagctgtctttgtgcctaagaatgaatgaatacatgttacttcagtacaatttactgaccagctacgtggggacggagtggtaaaacctggttaataaataaaaacacactgtttttcttctctgctctcataccatttctctgatcttgagctttatttgaaaaagcttgagaaaacatggtttacataatgaaacatggagaatctgaagttgctgtggggcttctcttacagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagtaagtactaagtaacctcgaagttaacctctcaaggtaatgactaactggcatggtaccaagcttttggctctgttttccagcctcctgtgagcttcaaaacttcctagtccttgttgctgccaggccccaattttctaggccttcagagcaaggcatggggatctaatctcttgtggaaaggactttttcataagctttttccagagtcacttgtcctgctttgtcagtctttaattccaaatggaattttagggataagttcttcatggggggtagtggaagctcccctatagagaaagcataagatgttttttcttaaccacaaacccctaagatctcactcacctgaagtaacaacagattttcagccagctagctatttccagttgtggtagatttccacgggtcatttgcgagtcaactattcaccccgccatagggcgttgaggcacatgtgtttttgtgggtgtttatatgcagggatatatttcgaattaaaaagacttattatttttgaaggatgaagattctctttgcaataaac

SEQ ID NO: 6035 - DNA, 1102 bp, Homo sapiens
tctgctaggtgcactctctagaaagatctggagaatggacttgggggccaaatctcaatttaaaatcaggactctatacagttctggtttaaaagttgtatttggagtagttcgtactgtgagggagatcttgaggccataccaagtgctacctctatgctgcttttcctttctccaggaggcctgtgcccttcaatattacttcttgatactgtggaggatcctaggaattttaccaccatcaaagacttacattaaccagctatccatgaactcacctgagatgagcgaatgtgacatcttgcacactctgcgatggtcttctcggctccggatcagctcctatgtcaactggataaaggtaacacagagcttgctgctaagactattcaaagccaaagtgctttgtgcttactggagcttttaaatttgaagataatgaaagctttgcctatagtcatctcctaaacactttttcttgctgtccaaataggatcaccttatcaaacagggaatgaaggctgagcatgctagctcgcttctagaactggcatccaccactaagtgtagctcagtgaaatatgatgttgaaatagtagaggaatacttcgctcgacaggtatgtaatattggaacctaaatgatagaacttggtttctaccatagcccattgccacagctaattatattttgcatatttttaaagatctcatccttctgtagtatcgactgtaccaccatcttgcagctgcatgaaattcccagtctgcagtccatctacacccttgatgccgcgatctcaaaggtccaggtctctttggatgagcatttttctaagatggctgctgagactgatcctcataagtcgtctgagattaccaagaacctacttccagccacgctgcaactcattgacacctatgcatcgttcaccaggtgtggcgaactgcctgcccagagatgcacatgcactcttcactccgtgcagatcccgcattgactcagaatttgacatttttctctttcttcagcttaggggtttttttccccacgtataatgctttcttctctagtatgaaggggtgcttgatgaggaaatttt

SEQ ID NO: 6036 - DNA, 1211 bp, Homo sapiens
ttttattgctttatagtctatcgagttatttttgactattatcatgcagtgatttttaacctgtagtataaactctcaaaactagaattaaatgatagaatcaaaatatggggaaaagtaattgaactggttcacctgtccaagtttgttaatcagaaaggaacaatagcaacatttttgtgggggagcttgtagtacttttcatggccacaaatgacagggtgggcattaacacgcctgtgttaaggcttgcctcaagcaatcctcccctcgacctcccaaagtgttaggattatagactgagccactgtgcctggctggccaagtctgactttttttagccaaaatttagtttctgtcttgtctttaccatgtagcctttttttcttccttaatttgttatcttactgcctgggtttaggaaatttaactcttctagtgcttgacattataactcctggggaatgctctttttcccaccagatatagtcatcttttctctctggtaggtttttgtctacaatgaagcagaatgccctgcaaggtgtggtgcccagtgagacagaggatctgaatgtagaacacctgcagatgctcctcctcattttccacaatttcaccgagacaggccggcgggccatattgtcgctttttgtccagatcatccaggagttgagcgtcaacatggatgctcagatgcgcttcgtgccgcttatcttggctcgcctccttctcatctttgattatctgcttcatcagtactccaaagcccctgtgtatctatttgagcaggtacagaccaacacgttcttttttgcttcaccattactgagaactttattcttctcaatggttaccatgatccgcagcccaaatgacctacccactttaggttttaggttttggtaggttgatgggtaggattaggaggaccactgagactttgtacttgatgtttagccagaagtgatacatgtagattacttgatttgatgcattttttgaaagtggaatgtaggctgtgttcaaaggcattctcccacgaattgccctgctctacctgtgtctgatgcagtgccctgagcatcggcccttgatgagtatttgttagtggttgaatgacagtcaagtagtaaattttatggattggtaaattcctttgttgtaaggatccaaaataaggataggaggatccgttcagacttaactgt

SEQ ID NO: 6037 - DNA, 1472 bp, Homo sapiens
caggctgtatgttatctgttgcagctagttaactatgcctttttagtgtgaaagcagccatagattaatatataaatgatgaacatggctgtgttccagtaaactttatttacaaaaacaggcagtgtttgaattggagctgtagtttgccaacctctggtacatggggctacagagtcttctcaaggattgcaaacttacatacctgcaggggccaggtaggtaacagaaaatgagtaaagtgtgctagttgagaagattgcaggtcccaactaaaggggctaaccactatttggctctgggttattactgccatgcaggaatggaggtgcaaggttgctatactgtgaattatttgagcgtgagaatttcagatttgcatgtgaatcttttcattcccttcaaattttaaaaaaatattgtgagaacaataagacaaatctataagctacatacggtctaaggacatcagcttgcagtctttgctttagtgtttatatgaacctaaatttggccctgtgccagttagaatttccaaaagagtagaattttctgaaagatctatttgtttttgttttcttttgtttgcatttgttttcttttcagaaacacttgattctcctaatcaagggcctgtgcactggctgtagccgactagatagaactgaaattatcacatttacagcaatgatgaaatccgccaagctgccccaaacagtgaagacactttcagacggtgggtgttcctttgacagatctgatcacatgaccacccccatggcaccttttccatggcacctttgccttctagtggcactttcctcagcccttttttttgcctttgtattttacagtggaagatcagaaagagctggcctcaccagtaagccctgagttgaggcaaaaggaggtacagatgaattttttgaaccagctgacctcagtttttaaccctagaactgtagcatcacaacctatcagtacacagactctggtgagtttctttagtcaaatgtcttcttctctgtgggttttgttaagatgataacactaggggagaaaaagtgatgtattttatgtttgtgatataaaatgatatacatgtctgtgggacaaaagaaattgaggaatacaaaataaaacaagtaaaattcaccccaactccttcttctgtccacggttattactgttttgacgaccattctaggcttctctcaatgcaaattaacaaatgtaaggtgtatgtacagttttctatataaaggcatcactccattttggttatagaacatatatatattttaaagctgtatattttttccctcctcctgaaaatgtaacctgtattttctccaacatgagtaaggaattttcccttcactaactggggagtctggagagtatccgtgcagctactgctcacttttgacagttggtttggtgaagagataatagtatcttgacaggcctta

SEQ ID NO: 6038 - DNA, 1164 bp, Homo sapiens
agtggagagccaggggagtgtgggtcagataagcagctacagctgcagtttggtggattggtggagtatgtgtgtgtgtcagtgctcagctaagaactgtagggaagatggatgaccttcacgcagaactccttttgggatatacatgatgcagaaaggatcctacatggagagagacagaactctctcagctgacactctcagagattcctgatgggctttctcttgaagtccaaaggcgtctgcattgtttcctttctttgcccatccatgaatgttctgttttgttttttttaataagaattccggctgatttttgtgaggcctgtttaaattgactttactttgccttttgtgtttctcaattttatctagaaatctttctgactttttccatctcttgcttcaaagtaagaggggaactctccttgccgactccaccttataggtacatttggtgttttgcactgggaagaaataggatccatccttagctgaggcttgaggactgatccagcctctcatggcttccctccaaagtaacttagggttgagggatctatatgtgatgtcaaaacttactttaaacctctagtttcgtgctgtcatttattaggctgggccaccaaatctttgtttcaatttatcagaagccaagtgcatactagcgtcttgtttgttgcccattgcctatacttttcacctgagatgtgtgagttggggccttttaaaaactactgaattgtctgagccttgaagacatttccagggagaagagataatctctcatttcacccacaggctggtctaatcataacctagttaaagatgtccttgtttaagaaccccattatttatttttagtttttaatataaattaacatgtgggtcattatatttctccttaaatgaggaaattttaaattttattgatctaacctttgaagctttaaaaaaggagaaagagggtaggggtgggaaactggcatactgtgtgtatagcactgccgattggctaggccactgtgtctctgctacaaattaaagaaatcctaaaagttttccttggtcatagagttggggaatgacagaatttttctttgttgtgaaatgtatgtacagagtagaccatctctagccctgtggtgaaagaggtacactcga

SEQ ID NO: 6039 - DNA, 1437 bp, Homo sapiens
gttctagggactatggccgggtcaccggtggccaggggcagagatgagcacctgtccatgtaagccatatgccacccccacagggcctggcaaggtgcagagggtgcaggtctcggccatgtacccctttgcccctttctgagaggggcagatgcccagcccagtgacccagagcctcaccccaggaagcgggtccatgcagcaaatcagccaggcactggcatggtggcccccaggcctccaccgcctcaccagtccctgttcaatctgctgataacgcctttcctcccttgcaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgcagttagcgctggccttctgtgttccttctcgccggcctcgctttccgagcgcgtgtggccgtggccgtgcgctggctccaagctgggacgcgtgtgggccccgctcacggcagcaaggaagtgtcccgtccccagccccgccgccctgaaaacaccaggtatgtgatgaggtgcagagtccctgtccctttccgccctctgccgttggagggcagaagcaccagcaaacactgttctggcgccgcagcacgcacctcccgccgccttcccactgtgcctagtacaaatgtgaggcagccgagg

SEQ ID NO: 6040 - DNA, 1152 bp, Homo sapiens
tccgggcagcccggctgcctctggctggcctgctctccgagacagcagagcgcaacgtgcaggcagggccctcagtccgggccttctcaggcccccagcctccctgacgccacatgcaggcagggccctcagcctgggcgttctcagggggccccagcctctctgacgtcctctgccagggctctgctgccagtggccagtgtcctgcaccatccttcccacctcgtgccctcagctctgcagtgtcagcccaaacaaaagccgggcgctctctggaccctccaggtccacggcggacagagcaggaggcaggcctctgacatgaggccagagcccagctgggggcagtaaacggctgtggagggagcactggccttggagtcaggagagtcaggaggccgggatctcccctaagctctgtcatcccgagctgcatggcctctggcactcctcgcagaggcccttgtccagtcgaggaggcacggtcggctgagatgatgaatctagaacacgctctgcagtccagcagcaccgtgtgagtcgggctgtgctatgcctttagcggccagccctctcacccactgccgtggtgtagctctcacagcccagcccagaggagaggcaggctgcagtcccggggctgccccagctcgtggactggggtgggcgacagatttcagtcacctgctttacagttttaaaacagaggaggagtcctctttggacccttgtcttctgatcccctgcccacctgggggaggcttggtcttcgtgacctgtgacagggttagagcccagtggtccctggcgttaggcctgccactggcagccactgcccgatacaccaaacacactttcccgcccagccaacctgcacagtccccaggcagtggctgggaagtgggggagagaagccgaagagcctgcgggtggtggtggcgagcccctgaataccacgaccaccgccagcgtggacctctgcagcggcgataccactccacaccccagagccgccacggcatccccccttccgcctcgtgggtctccctgaatttcctcctcagctgtggccccctgcgttcctggcttctcgtcgttctcttccctcccactccactcatcttgaacactctctgtagatctattgatgct

SEQ ID NO: 6041 - DNA, 1233 bp, Homo sapiens
tgtatcattaatagaatcagtagtaatagcacatatttattcattgctgtgtgccagagacagtattcaagacattaagtcaatgcatcatctcacttaaatgtaatgacttaatcttcattcaccccagtgagctaggtgttattatcctagttttagagacaagaaaactgaggctcagtgagggtaggtaattcgcctgttatgatgtttctggtgatccatagcattcggattcctactcaggcttgccccattccaaactcttcttcagttaagtatttatgcagtggcttctaaaagatagatttcgtttccataaacacttaaaactcttattttaagtaaaagttccatcaggtttttacaaaaatagattttaccctagtgctcaagtcaagggggcaatggccctgcgggtttaggatttaggatgaggtgagcaggaagcatgcgtggaagccagctcatgcccctcatgcatattcacgaagggcctgcttctgtgaaacagaccccgactggagtgcctctggatgcccatgctcagctcaggctgggtgaagctccgcctcagccaggagctccaaggagtggcaggtgggtcgggggagagagaaggaggcagagcctggtcctacaacgttcagttgtccctctgtgtgacctatgctgagggttgccagtttgcaaagcaacagtgacctatgctgaggcttgccagtttggacctgaaagtgggctccaccccctgcttactagctgggtgaccttgtgcaagtcccttcacctctctaagcccatatgaagatccattctcccatccactaacaatacttctggaggctcagcccatgagccacgtgctgtgctggaacccgcccctcccccccccgcccccgcccaggggtgaataagagacagctgctctgcctacttgaagcttgcatctgagtgaagatgaactttcctttcccagccttgagagagggaggctgagctcagtagctcagctcctgggttggttttgaacagtaaatgatctaggtacctggccagcacagctcctggtgcccctttcctgaaggctaacaatgcagttcaaattatatgcttatgcatgttcagaacacagtagacatcatgtgtcggtgggtgttgagctggggtccctggctgcctgttgctcttaaggagtgatacagccatcctcccctatccgtggggaatgtg

SEQ ID NO: 6042 - DNA, 1477 bp, Homo sapiens
gaagtttatattatctctgtttttccagcaagaaaagtagctctcaaagaaatttatagaaattgagaagttgatttttaaactctgaaaatgtaaacaatccaaaatagtcaaaccaatttttaaaaagaacaaagttgagattcttgtattagctgattttaaggcttgcagtaaagctacaagacagtgtggtgttggagaagagctggacatataaatcagtagagtaggataaagtccagaaatagacccatacatacatggtcaattcgtttttgacaaggcaatttaatggagaaaggaaaatcttttcaacaaaccatgctaaaacgactaggtttccatatagagaaaaaaatgagcctcgcttaaaagggtcgtagacctaaatataaaagctaaaactataaaacctataagagctttcccgtgtggagtctggagacgacgtgcagaaatggcacctggaaaggggaaggaaaagaaggaagaacaggtcatcaacctcggacctcaggtggctgaaggggagaatgtatttggtgtctgccatatctttgcatccttcaatgacacttttgtccatgtcacggatctttctggcaaacaaaccatctgccgtgtgactggtgggatgaaggtgaaggcagaccgagatgaatcctcgccatatgctgctatgttgaccacccaggatgtggcccagaggtgcaaggagctgggtatcattgccctacacatccaactccgggccacaggaggaaataggaccaagacccttggacctggggcccagtcggccctcagagcccttgcctgctcgggtatgaagatcgggaggattgaggacgtcacccccatcccctctgacagcactctcaggaagggggtcaccgtggtcgccgtctgtgaacaagattcctcaaaatattttctgttaataaattgccttcatgtaaaaaataaataaaaaaagtgaaacctgtaagagaaaatcctttgtgaccttggagtcagaaaagattttggggaatacaaaaagcaagtttcaaagaaaactgatatactggatttgataaaaattaaaaacttttgctctttgaatggcaccattaagaaaacaaaaaggcaagccgcagaatgggaggaaatatttgtaatacacatatctgataaagggcttagaatacataaagatctcttaattttaaggttcccccccacccatagactcagggtctcacatgttgctcaggctactacttctggcctcaagcaatcctcctgccccagtgtccgaaaattctgcaatttaagatgtgagccacttttcccagctttttttttttttttttttttttttttttgagatgggatctcactctgtcgctctggctggagtgcagtggcacagtcacgggagcctcagcctcctggactcatgatcctcccacatcagcctcctaagtagcta

SEQ ID NO: 6043 - DNA, 1477 bp, Homo sapiens; identical to SEQ ID NO: 6042

SEQ ID NO: 6044 - DNA, 1109 bp, Homo sapiens
atcctgggtgctttatctttaataatctttccctctagacctgccagttgatttgtgagagatgttactatcctcattcagctgatgagaaagcagactcttaccggggttgagaaacttggcaaggccatgtagttcgtaggctgatgagaaccatgctctccccactcccctgggacgccttcgacaggttttaggaattgttatccaggtcatgatggtttggccctgttccactcgtttcccactcttctccctggaagattggggctggatggcactcttaggaacctaggtagggtgtacatagtcctgttgtgagacagttttaacgtaaacagtgtgataaggttttggcttctggccctttgggtctgacctgatacagcaattagagagggttgtcagaatgccgtctgcacagttttaagctgaatgtccttgctttacaggagcaggagcagtgacttcacctgagaacatcccagcgggaggacaagagaaatcatgtttattcctcaggaatactgaagtgccctggagtaagctgccattcttctgtaacaatgttatcagtaatgctttaaactccagcacctggttatgcatttgaaaccaagtctgtttcttgttttgtattttctctctggaagttgtaaggaggtggtcttaaataaattaaacaaaaagaggaagtccattgcatggcctttgtttcttcacctttggtctctgagcatgaggaggactgtgtgtgaactgccagcagctgtagccacctgctcacagcctctctgagaaccccctgaaaccagttgttgggtatccttcccatttgccccctcaggcgtagttttcagaactgcttccacctcgtaatcagaagttgaagattgctgctgcgtggcctgatggagatgactgatgtcttaaggcgcctttccttctgtggcacctcttcgtgtgttctcacctggggacctggcagggcacatctccgctgtgcctactgcaaggcggtcccactgctgctgtattagcaggggaagaatcctggctgtgtggatggcccactccattgaagtcaagtcctgcagcttcatagagct

SEQ ID NO: 6045 - DNA, 1161 bp, Homo sapiens
aaagcattttccttccccaatttttctgtcattttcccatcctcattcaggcagagagaagaataacatgcccccttccaaaaaagacaaaacacaaggtagccacaaattccctagacacattagaaaaatagggagtggagaggggcattggaatgaaagttctctatctcattagctgttaggctttaggcatttatttggatggatccctttggcaccttggaagcaccactgaagtgctctgagaaaggggtcagctgtctgagggaatagttctggatagaggccacaggaagcactggccagttgctttagttctagatagctttgtattcccgccttgttgcccttagcggaggctggcccaaagcacacttgatcttgtccccactccctgcccccatctcagatcaaccttcagaaagtcccggcttgttggcaaaggcacacattctgtgttactcttaagtttcattagaaattcaagtcctctggggccctgttcccttgtgggcttgtgcaactgactttgtttcttgtctgcctttctggaaccaaatccaaggaaattcatgggtttggggagacagcgatgggaacccagcagggcacaggatgctaggataaagctgtggcgccccaaaagtggcctgctctgccaacatacataaatacatacagtctgagcttgacactgtataatttggcccagaacaatatgtattttgagctcatttaggtgaatgactttggcattccatgtacccactaggggaagctttatcaggctgcatttgccttatgcagaagtatgcctttgttctgagaaatggcctcagaacacactgttgagctgtctcctttagtgagtgtcatcctctcatccatttcaaaagattgcagatgccgtcttgaagtcctgcttgtaagaaatgcaggggttgggaatggaggagatgacgatgtagttttgcttttagttttcccaaacctgtttacattttttaaaaatgtaaccaacccataattgcattttacttgtcgtggttcgatctgattgtattgtcgaaggactatttttgaacctgtccaaataaactctgcaaagtatttccacaaggatgtgactccatggcgcttggacagcctttatcctga

SEQ ID NO: 6046 - DNA, 1205 bp, Homo sapiens
agcctcctgagtagctgggattacaggtgtgtgccaccatgcttggctaatttttgtatttttagtagagacggggtttcaccatgttagccaggctggtctcaaactcctgaccttgtgatctgcccgcctcagcctcccaaagtgctaggattacgggtgtgagcaaccctgcccggccagtaaattgtatttttttaatgacatcattgatttgaagatctagatggcataaattacgacgtctgccatcgcatattagaaaggggacagtcatatttgtaacgtggagagaacacggagcaccagtcaccacgtgcacttaggatgcagagcttaccgcacaccgctgatggggacctccggaaagagcggtgccttgtggttggcctggaagttctctcccaaggtgaaattcctttaaaacctcaggctctgacctatgtctttgaagcagctgctttgtagagtccctctctttactgtcctcgttaggactgttttgtggttccatgaaaatgtttagcatccttgcagaattacttgagaaggggctggtaccagtgtaaagaatctatttctgtaaaactacgaacttttgcatagggaatttattctaagcaggtcatagccgtgatccagagctgctgctgctcactgccagtccttgcggctggcggcgattgccggacagactctctgtggcctggctctcatccttggcgtgtcagcctgcggcaggctgccagccatccatgacaatcatgtgagctcagccacagacctcagctggcggtttgatccctggcaggtccctcgagcagtactggtaagaggcttcacacattttcccactcttacagttcatttttcatagtaggaagggcccttggcctccccagtgcctcttccagagcctccaccagcactaagctcagaggaaagaagaaaagggccaggagtcagacgtcacacccgggggctcccctttcccatgtagaagtgttggcatgcgtcagtctcctttacagaggggtggatgtatccgtggaggaggggccttctctctttctaattgcactatacttgttctagcttcagtctggagatacttaagacctccatggggtcgtgatccatagacttagcaagtcttgccttatctatggagctcgatggtgagaattgtgaccattgtctgatgt

SEQ ID NO: 6047 - DNA, 1167 bp, Homo sapiens
ctccctcccctccccctccgcccctcgcagccccgccgctcgcagctcccagtctgcctccccgaaccggcgccgccgcccgcactcgccgcaggaccggcccgcccggctcccggggtgcgccctcctcggtcccgcgccctccgggctcgcagggacgtctcctccctcccggctcgcggccccgcccggcccggcccccgcccagagccccagcgcgccgaggatgtgagtcctgctcgcctctggcggagcagcagccactcgcgcgcggagccggagcgcagcgcagcgcagccgcgggcgctctccgggccgctcgcgcgagtgccgcgctcttgccctagcggcgtcccccggcctctcgccggcgccaccgccgcagcagcccgcgggccgtccccggccggccgcccccggccccagcgccgctgaccctgtccgccgcgggcggggacgcgggcggaggaggcgccgcggcggagcccccggacgcgaccatgtcggaggtgctgccctacggcgacgagaagctgagcccctacggcgacggcggcgacgtgggccagatcttctcctgccgcctgcaggacaccaacaacttcttcggcgccgggcagaacaagcggccgcccaagctgggccagatcggccggagcaagcggggtgagttcgcggcccccttgtctgacaccccctttttcccgcgccgcggcctgaacaagggttgcggaggtctcccacccgctggagcccgttcagacctgacggaatcccttcttgcagaattgggggatcccgcactgcgggtccggctgaagcgggtcgcaggaacgcgtccccctaagccggatccccggctgggtcaccctgggggcgtggcggcttctagcagcagctgggggtctccacccgcgcggcaaagtttgctttttgatttgcgccccccacccccgccttttgcgcagtgtagtcacagctgcactcgctccataaccctgtggggagggggtcccagggacccccaggggacggcgtggggacctgcgtggggaggatcccattcctgcggggaaggctagggtgttcgggtcgcacgggcttttcattgttacttggcttgggagggggtttgccaggcctgggcgatccgcgcgagagctggaa

SEQ ID NO: 6048 - DNA, 1116 bp, Homo sapiens
ttcctgcacgaggatgctgccagaaacggccccaggcctcacttgctctcgaggcccaaccaggaaaagctctgggaaacccctcccggttattcttgttggttcttccgcaggtggcaaatacagtgttcagttcaagttgcccgacgtgtatggtgtattccagtttaaagtggattacaaccggctaggctacacacacctgtactcttccactcaggtaagcacaggtgacagcttctgttttcagctagcatgtgccctgcctgggctctgcagtggccaggtcctgccacctctgtcctcctgcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcaaggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgctaaaagtggcatttttcctatgtgcagtcactcctctcatttctaaaatagggacgtggccaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaaaataaagcgagatgttgccctcaaacttcacctggccccggtcctggtttgctaatggctgtgggtgggggttgctg

SEQ ID NO: 6049 - DNA, 1199 bp, Homo sapiens
ctggggttacagatgtgagctaccactcacggcccaaatcttcttgatcatatgtttaaatatattttttaatatttggagcatgagttgtcacttcttgtttgccttttttataaggaaatgttggagagttacatcattgctaatgtagaaatgttaagtggaaaaatatacagtttggtaaaataaactagattctacatttatttgtgggtttttttcccctcctttctttccacagcacttttgatatcaagcaagtggcttcctttttgagatattaaaaaaaaaaagaaaaggaaaaaagtaaatgaagcccaactacctaaccctttcttatttgtatttgttttagtattgtgaagttgtgttaaatagtactagctagaaatacaaatttctggttatcatttctcttccctgtggcacttgacattttaattgtcttaaagtttttgaagtacatcttctggccccttgagtactgccagaggcaaaagatgtttgtttcttattcattccacttttgtctcctgggatcccttctgtagcctaaagtatggctgggaaatggacttgagaagattggcttgaattagatcataatcatgtgtgatcccatcatgaattcattggaatttgtgttgcatgtaaggcaatctttcctgttgtaaatcttccttttttaatgtacatatattttgaaaaatatgaataaacatgaaattttaaaagctgctgaaccgtagcttatatttaaaggttttgagtatagtatatcctcagaagtagctaagtgtcgccctcactttaagtcttttctactccttgaaatgaacaccatcattttcctttttaaatacaagctccagttcatgtgttttggaattcttatagagggtaaacgatgtttccagatacattgaatgctaattacttaatgaatcaaaggtttaaaaaatcattttgtattttattaaagactgcttccaagatcatagagtacaatcatgttcaataaatgttcaatattcagataagtccttggactagaaaaaattacagtactgcaaaagataacagataaatcctagacatcaaattctagaagtaattgtagtaattactcctgtgctctctagcaagtaatgattcttaatagtatggatgttaggtacctgtgctcagaattctgtact

SEQ ID NO: 6050 - DNA, 1224 bp, Homo sapiens
ggactgatcatattcctctctgcccagcattgctgttcaggggaaaagagacatgggtgtgtcgtgcctggcacattgtagggattccagcgtgcccccttccctacctcccaaaggcttcagtgcctccttcaagcagctagagacagtgctgggaggggcggtgggaggagtacagcttcccggcctggtgaatttgattacacatctggactttgcagcccccatgcatgtgcctttggcaccggggctgtccctctctggcctccgtcaggttgaatggctgcgtaaaatgcctaggctgtggtgctagctcagagtggtgcccggcgaaggttcctgtccttccctagctaacaaaggttaatccagcagcagtgttgtggggctggggagcagatcttcctcccctcctccctcaccgaggcctttgccttggtgtcccaaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtaggtgggccttctttggggtggacactcctggggtctcctgtctacccacctgggagcaggagtgggtgggagagccagcaagcccagagcatggtggggactcaatgacaactgggtggggaggaagagttactggggatggggagaaaatgcagggtgaggcaggggagtgagttgagtggtggtcgggtagacaggcaggtgggtggatggatggccacgttgaccatggctgggcgagaacgtggatagatgaatgagagaggatggctggctggatgatggatggatgatggatggatggatggatggatggatggatggatgatggatggatggatgggtggatggatggatgggtggatggatggatggatgggtggatggatgaatgggagggacatgggtacaatgaaaactggggaatggttagttggaaataataaggtttagaaggtggcttcttggaggcattgcagggcccttcaaagaagatcccaggggttaccaagccaccaaggagcctaatctgggggctggggactgtactcctggggccccagcatgacccctgaacaccc

SEQ ID NO: 6051 - DNA, 1431 bp, Homo sapiens
tggcccacagctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaagaaaccaaagtctgccgcccacctcgctcccctctggaatcttccccaagggccaaacccacttctggcctccagcctttgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatatttccgaggacagagctgagtctttgtggtcagtgagaaaaagactgaaagaagcttatttctctgggaagaactggcctcagggcccggggtacaggtgggttggacagggtggaaaggccttctgctgtcctgggggcttcacactccctacctgtgccactttggacacataggtttgtgtctcagttttcttgtctgtgaaatgggagacaacccccttctgggttattgtgaggattaaagaggaggctgggtgcaatggctcacacctgtaatcccagcactttgggaggctggggcaggtggatcatttgaggtcagcagttcaagaccatcctggccaacatggtgaaaccctgtctctacaaaaaatacagaaattagccaggcatggtggcgc

SEQ ID NO: 6052 - DNA, 1300 bp, Homo sapiens
gctttttgctttggtgcatttcagaaaggatggagaacatttattatgtgtgaaagcatcctcttccggttttgctgttattcaaaagtgggaaatgtacctggcacgtttgaaaataaaaaatctgactacctatcagaagagtaaatcagactgaagtacatttggataacacaaggtttctataaaatttgttcttcctgtcctccatgtcactgtttcttggacctcagttctctttttgaaagcattattccaaaatgccctgagagggtctcttagatcattgtttaaaaaaggaaaaaagtatatggatgtgctgtccatccaactcaggattatcattcttagcaacacgtaaccgaagcaatattcttaagaatattgaaggggtttttttaattgaacttaagactggagtttttcctttgaaaaaaaaaaaaaagttttctctgttgagtccgtctgtgtaagtttgtggctgagatgctagcttaggcatctctcttgttaacacttttcttggccttgggtttgtgcaaggctttttccccctttcatgaaaatgtgaactcagatcatggatggggaaggcagattttgatttgagacccgataaccttggcagcatcccttttgaatagctccttttgtcagagtaattacggccatttggtaaaattctaacttcgtgtttgtgtttcccctctgtgtttctaatgtcttcagtctgtgtcccctgaggaggcagggggtctctaatgagcctatctatgggggaaggtgagagctgcacacagccccctgagaaaccatcctaggagtggaaccaagggaccaactgttctggccttgaggttggcacaggggaaggacttgaagttgagctgatggatcctgatttttagatctcattgttttattagctccaaagaaatgaatgcaggagcctaaaactaataacacaaacttcttctttcccaaggtaaagacttttataaaagttcgcacaatgcttgattgaagccacttccttttccttacaaagaagcttgttggccagagaaggttctttttggggattgacataaacatgttagcagcccccagaaatctgatatattttccccaatttgctgttgataacagttttgaaatttgttacttgggtattttttcctcctgcaatgctacgaaataacagccttttgtaaatctttcaggctggtggtacctgctctgagtactggcttctttattatctctgtccaggggtggggtgggcaccgagtgagcaggt

SEQ ID NO: 6053 - DNA, 1145 bp, Homo sapiens
ctccctgtaaaattttcttaaatcttttgttctctggtataaaatattatccaatttagatgtagtttcattattcagtttaataagagtatttcatagtgtttgcaagagagcgcttcttccatctttcgttttctcaattcttaaagagcatgtaactcctgccacttgaatagtttgagaacttgaaaaggcttggcaatcagtgtgctcgggaaggtgtcaagcaccttcgaacttctgcaaaataacatcattgtacaagactgataataataactgctctgcagagacctcttaaatgtatggtgagcacattaaatactacaagaataagtcatagggtaaaaaactaacatgttaaaagagcatagaaaaccgtgaaggcttgattcttgatccactctccagtctataatcccaccatgataaaggtgttcctcgtcttgataaaggttgccggtcccagcccccacatcctccatagcctgccttcctagggtctgacctacttctctttgttgtcctggcacattcaggtgatgaaggattcggctccggaactgaatgtgagtagttctgaaacagaggaggacaaggaagaagctaaaccagatggagaaaaagatccagattttaatcaagtatgtgttgaagctgcttttcattgttatactttctgctgttcttatagagcagccactcgaagcccctggccatgtctctgtaccctgtatgggatattggttctttttttttcttttttttttttttttgagatggagtctcgcactgttgcctgtgctggagtgcaatggcactatctcagctcaccacaatgtccgcctcctgggtttaaatgattctcctgccccagcctcctaagtagctgggattataggcgcccaccaccacacccggctaattttttatatttttagtagagacggggtttcactgtgttggccaggctggtctcgaactcctgacctcgtgatccgcccaccgcagcctcccaaagtgctgagattacaggcaggagccaccgcacccggccttttttttttttttttttttgagatggatcctagccttgtcaaccaggctggagtacagtggcacaatctcggctcgctgcaacctcc

SEQ ID NO: 6054 - DNA, 1140 bp, Homo sapiens
aacctctgcctcctgggtttaagcagttctgtgcctcagcctcccgagtagctgggattacaggtgcgtgccaccacgcccagctaatttttgtatttttagtagagatggggtttcaccatcttggccaggctggtcttgaattcttgacctcacgatccacccgcctcagccttccaaagtgctgggattacaggtatgagccactgcgcccgcctggcgtcatctattctaaagtggtgattttgagccattcgattgttctgggaggctgatgatgtcatggagagctaggtggggggaatcaatttaggattattccagtggctgtcttcacttttacttctgccttcagtttggaggtttctagcagacagggagaccatagttggaatttctgccaatgttttaatcagtatttgatatgatttagagattagcatggttcactatatgtgaaaacaagaataaagttgttttttgtctttctgttttgaatagcctttcttcaagagctggtagatcgggataattccaaatttgaggagtggtgtattgaaatggctgagatgcgtaagcaaagtgtggataaaggaaaagcaaaacacgaagaggttaaggagctgtaccaaaggttacctgctggagctggtctgtaagatattctgggacagcactgttgccattaagtgccttgtttttttatgttcacaaatgtatatgaagaaactttctcaaacttactctttctaataacccactaaagccagcttaaacactctaaaagtactttgtaaaccaacaataacttgatgtgtagcattccatattatttcattacgttgtactcctaaaaatgggaagctgttaataaattataacatttaggtcagcactctgcatccatgagtattgtagatatttatattttgtgagatattaacttgtttaagaaaaatccgattggattactatggaaaaagcaacttgcctgttctgtttctttgcatactttgtgacctaacagttttaacagacattctattatatgaatacagtttttttgatactattagattaacttgaagtttaataccaaatattatgctaagagtagaaaagctttctgctgacccctga

SEQ ID NO: 6055 - DNA, 1078 bp, Homo sapiens
ataagttttaagtttcgtaacacacagagagtatgaacagccgattcttgggaagcgtgtggcctcgctagtgtgtgctgaagagcacggtgtgtagtagagtagcttatattccctgagtgcccaggaggccgtagtttttcatccgtgtattttgcagaggcttggagaattaatacagtgtgctgttcagagtgtgtctaagagagtgttaagggagtgtaattatacattattttgtaaaactaatttgtaaaaattttaggtgacatgtttttagttataccacatgtgtaaagattcgtaatcattacaattcaggctcaggatataagaaataactgttatccaacgtttcttttactttctccctttctctccaggtgggtcctacgtgtatgaactcagcgcagtcctcatacacagaggagtgagtgcttattctggccactacatcgcccacgtgaaagatccacagtctggtgaatggtataagtttaatgatgaagacatagaaaagatggaggggaagaaattacaactagggattgaggaagatctaggtaaaacctttaagttgtgagtgcccttttaaaatataaatttattttactagaaatatttgtgataaattattatggctcaagattgttatgttacagactatcaaggatatttgcatttcttaaacacatgtaaaatcactgaacatcttgtattagcaatgcttgtttttcgagtccggttcttactctcttgcccaggctggaatgcagtggtacagtcatggctgactgcagcctaaacctgctaggctcaagtgatcttcctgcctcagccttcccttcctagtagctgggcctacagataagtgccaccacacctgacaaaattttttttgtcaggtaaaaattttgtcaaaatttttttcagtaagagagagtcttactctgtcactaaggctggagtgcagtaacaccatcttggctcactgcaacctctgcctcctgggttcaagcagttctcgtgcctcagcctcctgagtagctgggattacaggcatgtgccacaatgctca

SEQ ID NO: 6056 - DNA, 1179 bp, Homo sapiens
aggctgaggcaggagaatcacttgaacccaggaggcggaggttgcagtgagccgagattgcaccattgtactccggcctgggcaacaagagtgaaactctgtcttggaaaaaaaaaaagaaagaaaaactgcaagtaattgaattaccctgaccttctgtattgtcctttattttaaatagaataaattttgtactcattacacccccgccatgggaatgtatttttcattttataattaaaatcaaggcaatgtttgcacatgtgcatgtcttctgtaaagcaggataatctgttttgtgattaagttgaaacttctggaaaataagctgtgtttggaatcagcacttcgcattcacattttttaacctcatatttgtccagctataaaacaatattctgtttacttctaattgtacatgttttggaggaagattgtgaagtgaaagctagctactgttgagtttattaaaatagctaatagagcttatatattgtattatgattgttttaaatgtaaatataatcagctttcctcttggttaggcaaactggacataagaaaaagctgaatacctacattggcttctcagaaattttggatatggagccttatgtggaacataaaggtaatatttttactgaggagtaaacattataatgctcagagactctaacttgtgatcggcttgtgattaatatagaatagcagtcaattgccaatttttgtttgctaatctctctctgggaacctctgtctgggaacaaagacttttttaggagagccaagatgttaattccattttgtgtgagtaagcatatagcaaagatgaggtggttcatcgatatgtacagaattaagggtataaaaataatttgtaaaaaatgaaaaaggtattttactgtttctgaacccgcacttgccaccttagtttcaatactattatttatcatttctcaaaactaacagtctccaagcgcctctattcacttttttaaaaacgttgtcccagaaacattaggtggcataattccagtatttatgctttcatttttcatatctgcaactactgatacgccctaggatgctatcattgttttaacaagaaataagtactgcttttttcttttggtagtcttcatcctaccaaacaggttgagtcttactagagaaaggact

SEQ ID NO: 6057 - DNA, 1242 bp, Homo sapiens
taccattttttggaaagaaaagtagcaccttaaaaaaccccaaatctatatttttgttttaatagattatgagcctcaaacaatttgtgagcatctccagtacttgtttgccttgttgcaaaacagtaataggcgatacattgatccatcaggatttgttaaagccttgggcctggacactggacaacagcaggtaagaactgaatttttttttttttttaaatattcagaggtacccaaacatcctaagcatgtttataaagggagatgaagtagaatgctttttaaaaattaaattttttctattttgaatgaaaacctttatttactgtccaatagtttacacattatacttgattccatttatggaaattcatatgggggcacaaactgattgaacatagctgtagcccctgtttgaaaatgctaagttgaaagtataggtagtttctggaatgttgaatgtattactatttgtagtagaagttgaaaagcaagatatgatttttcttttcattaacctaaacttgtaggatgctcaagaattttcaaagctctttatgtctctattggaagatactttgtctaaacaaaagaatccagatgtgcgcaatattgttcaacagcagttctgtggagaatatgcctatgtaactgtgtaagtctgtttcaactttttcatggtacattttattctaagacagttgctcatatgttaactatttttcagtgcagttccaggttgtagctttagtggtttatcatgggacctgaaatatttatagtaatacatttccatgggaacatataaacaagtgagttggtaattgcagttgcacccatccaggtgttaggaacggtgtctgggtgagctcttgcagtctgctcttgctttatggctgtgtggtgtgagctaaagagtaagattggaactggctagaatactaaaagtaaatgtaaaatgcctgttaaaaaaatgtgcatgagtacaatatacaacatttgggtgatggttacattaaaacctagacttcaccacagtgcgatatattcatgtaacaaaactgcacttgtacctcttaacatttattttaagaaagtttcccaacgaatgtttagcttcaccaggcactttgtttttatttcttttctttttttttttttttttgagatggactcttgctctgttgcccaggatgagtgcagtggcgtgatcttggctcactgcaacctctgcctccc

SEQ ID NO: 6058 - DNA, 1897 bp, Homo sapiens
acgccaagggcagcgtctacatcggtaagtctggggctccttctcagggcaggggcaggaacggcactcccttagggctagagctcgcccagccttcctcgcctcctgggctgctggagcccacaggccctgtcctctcacctcccggcaggcggagcccctgacgtggccacgctgaccgggggcagattctcctcaggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctaccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaactgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcacccctgggcaggcggtccccatccccaccagctcgtttttcagcacccccacccacctccacccagcccctggcacctcctctggcagactccccctcctaccacgtcctcctggcctgcattcccaccccctcctgccagcacacagcctggggtccctccctcaggggctgtaagggaaggcccaccccaactcttaccaggagctgctacaggcagagcccagcactgatagggccccgcccaccgggccccgcccaccccaggccacatccccacccatctggaagtgaaggcccagggactcctccaacagacaacggacggacggatgccgctggtgctcaggaagagctagtgccttaggtgggggaaggcaggactcacgactgagagagagaggagggggatatgaccaccctgccccatctgcaggagcctgaagatccagctcaagtgccatcctgccagtggcccccagactgtggggttgggacgcctggcctctgtgtcctagaagggaccctcctgtggtctttgtcttgatttttcttaataaacggtgctatccccgccaggggcctcctgagtctttgatgagggcttcactcagtggagcctgtggatggggcagagcagggcaggtgagatctgggggtgaagcaagctggcttgggatcagcgaggcccccaggcccccaaccctgtgaggcaggaattgtcctattttctagaggggcagctgagtctcagagggttagggggcctgtccaacatcagacagagagccagggggttagaacccaaagagtctgaccccagagcctagtatcattcccatgtgcccgaagcccctctagggatggcctccctgatcctataaggctgggccactcaactgcagccccctggggagacctggctgggacatgggtagcacgtggtacaggctgtgctgcagtggaggcagaggccacgggcaccaggttgccaggccagccagctgggagagcaacagcaccagaggaggcccaggaggaggccagcagaggccaggagcatcgaggaggccagcgcc

SEQ ID NO: 6059 - DNA, 1203 bp, Homo sapiens
gctgcccctcagtcctgccccaatccctcagccctccctctccagaagcccccagacctctgggcctccaccctggtgtgccttctcttgtgcctcccggcttctccatccctgcctctgtgatatctccagcctcctcgtggctcctctgccaccggggcatcacccccagtcctcctgtcccagcttcctttccccatctctgctccttcctccctcctctgcctccatctcaccctttcctcctctctttctctcgtctcttacgggtctctgactttcactgtccaggcctccttctctactcgggtgagtctctgcctccctctcccccttgagggagactccagtgtgtgtgaagcaaattcagtttctttctaggggcgctcagtaaggcccttgcgtttggggcaccagccctgagatagtgagaaggccctggctgtgtgaggagtgccagagggagggacaggttccgagagtggacaggctcaagagcttgggtggtttctagggtgggggaggacagggagcctgtggctggaagggggccccttacacagtggtgcccacccagggatgctgctgtacaatgggcagaagcgagtcccagggagccccaccaacctggccaaccggcagcccgacttcatctccttcggcctcgtggggggaaggcccgagttccggtgagacccccagcctccccacctacagggggactggacacagggctttggtctggcaagtgctaccctgggctccattatacaaaggagatctggaggaaggagaaaatgtggccgttacccttggtgaccacccaatctgctagagtaggaatagtatgccagtcaggtggaggagggtgcaacctcagacttgggactgctgcaggccaggattcattcattcattcattcattcatgcatgcatgcatcagttatttgctgaccaccccatgtgtgccaggcactgatacaggtaaaacaaaacagaccaaattctggctcttgtgggaagaggtgtattctcactggggaagaataaacaagccataaacagagaaacaaggtgatcacagggagagaggagtcctcagaggaacaaggaggccaggtgctaggctgcagggcgctgagcctggggtccctgtgggctgctctgggaaagctcccagcaaaaggatgtggggagagaag

SEQ ID NO: 6060 - DNA, 1170 bp, Homo sapiens
atccccctaaatgtgtcagaataaagagaattattccattttgccttgcttgtgtctagcatagagtaaaaggggcttgatacatatttcaagggagggaagaaggatatggatggagtgtgtgagtgctcagatgaaccgatgaagattgaatcagtgtgaaccgggcatggtggaacgcacctgtagtcccacctactcaggaggctaagctgggagcattgcttgagcgcatgaattctaggctgtggtgagccgtgatcacacctgtgaatacaaccaagaccctttgtctaaaaaaaaaaaagaagtggacacgtgagtgagtaaatgcataagacctgacaagtgagtgtgtttgtgagtgaatgcatgaaaaagtgaatgaggagtgaatgaatgctggagcttcagtgctcacctttccttgggcagtctatggcctccctcgggccaggcctgcagtgactgatctcactggacctctgcctccctcctccccagccctgccctcggtgctcatcaacatccggacctctgtgcagaccgtggtggttggccacgccgtggagttcgaatgcctggcactgggtgaccccaagcctcaggtgacatggagcaaagttggagggcacctgcggccaggcattgtgcagagcggaggtgtcgtcaggatcgcccacgtagagctggctgatgcgggacagtatcgctgcactgccaccaacgcagctggcaccacacaatcccacgtcctgctgcttgtgcaaggtgaaggccagtggggacttttgttgggggacagtgagtggggcaggggcttctcctgctgccatcttctgcctgcccgctctgctcttcctttctgttcacttgggacattttccattgtgtgtgtttaaggggcaggtttcataacaggtggcagcagcaggggataaaagtgagattcccccagggcagcctggaatgtacagggagagagctaggccatagagcatcaagaagaaaaaagaaaccttgtcctcatctgcagggagtgcctgctctgctgggagagacctgcagcatagtctgagggcagagacataacccagtcaacaaacagacctaatagagagtaaaacaaggacaacagatgcagggcagacacaaacactgtgtgttctt

SEQ ID NO: 6061 - DNA, 1262 bp, Homo sapiens
caggggcacaggctggcagcaccaagacacgagaaggaccaggtcaatcctctctcaccctcccccatgcaacctcacagacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacggtgaggggacgttgaccctgtggggctctgccctgtttccagccctgattctcagctcagagcctccaagtttaaatcctccttccaccattgactctgtcttgggcattctccctctctgagcctcagtttccacctcagtgcagtggggagacaggtgcccacccagcagttactaagctggaggccatggcagtgtgggtgagcagcagagccctgcctgtgtgtcagtggttgtcattcctccgcacagggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcaggtgaagccggggctgcctctctgggtctgaggcccagtccatggcccagccttgagcgggtgcttggaggagatagtagtggatgggcaggtggtgatgagtggatggagagaggaagggaggaatgggatgggatgggtggatgacgaatagactggaagatgagagggaagagagaaggaaggtaggagaaggaagaaagaatgagtgggagggtgggtcgaaggccaagtggatggatggactaatggggtgtcatgagggtgagccctcaagcaaccagatgggacagctaaaaaccaaggaaagggccaggcatggtggcacgtgcctgtaatcccagcacttggagaggctgaggcaggaagatcacttgagcccaagagtttgagaccagcctgggaggccaaagtgggtggatcacctgaggtcaggagttcgagaccaccctggccaatatggtgaaaccccgtctctactaaaaatacaaaattaggctgggtgcagtggctcacacctgtaatcctagcaatttgggaggctgaggcgggcggatcacaaggtcaggagattgagaccatcctggctaacatggtgaaaccccgtctc

SEQ ID NO: 6062 - DNA, 1196 bp, Homo sapiens
tcagcccctgccttgatccccggagcctggcctctctcacccaccccctgtgcccacagctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccaggtacaggggccaggatggggaggattccaggtcaggcaaggttagacctgcagttgctttctgtacccaaacctcatgcaaacaccagcctgcttggggaccccaggggataaaatacgtttgcgggacgagttcaccagcctgcaaatcaggagacctgggtttttctcttggctctgcagctgaatcctttcctgggcctcagtttcctccactgtaaagtgagtgggttggacctctaggattctgtgaatgaagcttccaccagccctaccagctgagaccctgagcttccgagagaactcttgggtaccggcacagttgggcttggggacattccttgtcctggggactttgccctgataactgtcccctcgctgctctgacagacccatggctcccagctgcggctccacctcgtctcccctgccgactcaggcgagtatgtgtgtcgtgcagccagcggcccaggccctgagcaagaagcctccttcacagtcaccgtcccgcccagtgaggggtcttcctaccgtgagtatggcagatgccatgggcaaggggggaagggagggccctgaagctaagcccacccctgctgagcccagccctctgcccctttggccccaggccttaggagcccggtcatctccatcgacccgcccagcagcaccgtgcagcagggccaggatgccagcttcaagtgcctcatccatgacggggcagcccccatcagcctcgagtggaagacccggaaccaggagctggagggtgagccaggctggtgggcaggtgggcaagctgggggcaggcatgggggtgccgtcatccccactgtgcaagggtggggcagaagtctggacgccccacattcatggtgtggccctgagtaaggcccttcccgtctctgtatggcaagagcgctggacccaggagtttccaaggcctttgttactttctgctatctgcgactccatgagctagacac

SEQ ID NO: 6063 - DNA, 1410 bp, Homo sapiens
taatgtgcttagagcgtgcctggcatgccagaagtgctttataagtgttaactattattatcatttttttttttttgagagggagtctcgctctgtcacccaggctggagtgcagtggcgcgatctcaactcactgcaacttccgccttccaggttcaagcgattctcctgtctcagcttcccgagtagctgagactacaggcacatgccaccgtgcccggctaatttttgtatttttagtagagacaggatttcaccatattggtcaggctagtctcaaactcctgacctcaggtcatccacccacctcagcctcccaaagtgctgggattacaggcatgagccaccatgcccggccaagtgttaactattagtgttactctggggggtgagattttctatggcagagggtcccaccaaccctgttcccaaatctgacaacggctgtgccgactcactgatctctgttcccccagcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcaggtatgcagctggcaggaaatggtgggagagccgctggatgtgggggccctggctagctttgccaagagggagacctaggagcccccgtggggtgcagtacccccctgtgtcagaggttagaccctggccccaggccttcaacagttccagactggcacctgactctgttcctctgtcctgtcccctattcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccggtgagggtccctgcagtgggacgggaaggccgggggagggaggaagggacagagaccagggggcagaactggcagaaggaaacactttctggcactcggcgagaactgccgctctgattccagacttcacctcccgccacccacacggtcccaggaccaaggagccggctcaggtggagtggttcctgtccctctccacggcttgcgagcataggctttggactatgctcatctgtgcatgagtcccagttcctctggccacacttggagatgttgcacaagggacctcagctttccacctgtcactgtcccttatctgtaaagaaggggtagtagtactcttgtactctactatctaattatagagttcccaaaagcctgggactgcacctctgcgagtattggagggtgatttacacatctttattagagccggtgtggt

SEQ ID NO: 6064 - DNA, 1100 bp, Homo sapiens
atcaagaagtcatgggtgggtcaatgggcctccagcttgtggttagaggctggggagggaagaagccatattcggctggccatgtggaggcagaagggtgtggccctagtcccagaaaggccacctgtcggccgtccccactagggcctggtcacagcccagagccttctgccccagggctacaggttacagcccaagagttcaggcctctgagcagccgctctgtgtccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccaggtatggcagccccccgggaccaccttgctggaggggctggatgggactgttccagccccctcccaacccaccccatttgcacacagacccacggctcgctgctgcggctgcaccaggtgaccccggccgactcaggcgagtatgtgtgccatgtggtgggcacctccggccccctagaggcctcagtcctggtcaccatcgaagcctctgtcatccctggtgagtgactcccagtgacatggaaagctggaggaggcagagaggcctccggggtggtgagatccaagggacccctcttgctgacagggcagaaggcccacaccggagctggctgcagggccctgcccaggccgactccacctgtcagagtaaccaccgccttcccgtcacactttgctttggccacatgactcctcaggcgtcccctcccacctcctcttcctctctccaactcatctctgccctcatctctctcacttcctcactcccctctgcaaggcgtggcccatgccctggtcctcccatcagggttgctgagctgagggcatcaagtccaggcccccagatgcctgaaaagctggatctggccttgaaaccctgggctgagctagctgcagggtgggcaacccctgccctctcatctcaggagcatctacaactctcactcccatccccactgctgcaggacccatcccacctgtcaggatcgagtcttc

SEQ ID NO: 6065 - DNA, 1161 bp, Homo sapiens
aagtgatgcctagaggttatggagaaagacaaagtggccacaggaccggggcctagccagcaccggctcacaggggggcttcccgtccctgcagaggctccaagcaagcccatcacagtgactgtggaggagcagcggagccagagcgtgcgccccggagctgacgtcaccttcatctgcacagccaaaagcaaggtgtgcaggtcagggagtggggatggaggaagtctgtcttctggggtctctgagccccacccatgaccccctttcgccttgccctgcagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcagggtacacctcccatctatacctgattctcccctcctgtctctcccccattcccaccagaattagcacagcatttcttcattctgctgatcatttctgagcacctgctgcatgcctggtcctggtctaggctctgcagaagcaggggagagaagcatgtacagtatctcggtcctcctgaagtacacgtcctaggcagggagaccataagcatgggaataaatgaacaagcaagataactacacatggcgatgagtgccaggctaggaatgatgagaaagcaagaaacaaggtgggagaaggccaggagcggtggctcacacctgtaagcccagcactttgggaggctgaggcaggtggatcacttgaggtcaggagttccagaccagcctggccaacaggtgaaaccctgtctctactaaaaatacaaaaactagctgggtgtggtggcaggtgcctataatcccagctactcaggaggctgaggcaggagaatcgcttgaacccgggaggcttaggttgcagtgagccgagatcgcgccactgcactccagcctgggtgacagagcaagaatccatctcagaaaaataaataaaataaaacaaggtgggagaggcaagggctactctagatagggcagtcagggagggcctctctgaggaggtgacacctaagctgagacctgaaggaaaggtagg

SEQ ID NO: 6066 - DNA, 1124 bp, Homo sapiens
tttttgagatggagtctcgctctgttgcccaggctggagtgcagtggtgcaatctcggctcactccaacctccacctcctggattcaagcaactctcctgcctcagcctcctgagtagctgggactacagacgcacaccaccatacccagctaatttttgtatttgttagtagagatggggtttcaccgtgtcagccagttggccttgaactcctgacctcaggtgatccacccgcctcggcctcccagagtgctgggattacaggcatgagtcactgtgcccagcccattttgctttttataaacaccacggagatgagtgtccttgtaatgaaatctttgtgcccttccatgattctttctttaagatgagttcacaaacttggaatttctagatcaagggattgcaaccctgaaaggcttctggtaaatttggcctaatggctggtgcctgccctccttgtgccctgcagcaatgccagcacaacgccgcaggggagttctgcgagctttgtgcccctggctactacggagatgccacagccgggacgcctgaggactgccagccctgtgcctgcccactgaccaacccagagaacatgtgggtaccctagctcaaggcccaaggacacacttccactggggaatgagtggaaggcgttgcactggcttttggggcagaagtgaagggagcaagatggagattgggcttcccatgacctgacctttgcctccccgatcccaggttttcccgcacctgtgagagcctgggagccggcgggtaccgctgcacggcctgcgaacccggctacactggccagtactgtgagcagtaagtttgtaaacagaagtagggggagggtggaggacaaatggtggactcccaagtgagagccttaaagggtgttgctcagaaaagtctcttctaggattatgctccttccctgcctcaaacacttctaagacacctcattgctcttgggacaagcccaccctccttaggcagctttactgtagcagtctcatcccacttctgacacccaactctgtactttagctgggcttaactttttaaatgctttttctttctttttttttttttaaactgagacagggtctcactg

SEQ ID NO: 6067 - DNA, 1112 bp, Homo sapiens
gacactacccaagcagaggatcctgctgctgggagaagggggcagtgggcatgtgcctgactcctttgggcgcatgagcttgggagagcagagaggtgggaggctgggggttacagagaatctaggactggtggaggacaccctggcaccccagggacccctcggctccccttccaatcctgctggtgtctttccagggcaacaacatcatgctagtggcctcccagccagcgctgcagggccctgagaggaggagctacgagatcatgttccgagaggtaaggggcacctggccatgctgtgtctaaccccaccccaccctccaccctgactcagagcctggctttgatacccaccctgtctctcgctccccaaccttcacctggcagccctcagtcagtgcctgtaaggcaggatttggggggtggtaactgtaggagcagcccacaaagcccactgcccccgcccacgttgccacccccaacccaggaattctggcgccggcccgatgggcagccggccacacgcgagcacctcctgatggcactggccgacctggatgagctcctgatccgggccacgttctcctccgtgccgctggcggccagcatcagcgcagtcagcctggaggtcgcccagccggggccctcaaacagaccccgcgccctcgaggtggaggagtgccgctgcccgccaggctacatcggtctgtcctgccaggtgagtgtgtggccagctccaccacctctgcacaggcacagaggcatcagcaagcaaatcagccggcgtcgccgcagccttgattaccatcataactataatgacccctgcatctgggccctgcatgtattcctcccgacagccctgagttacatatcattatcccctttaacaggtaaaaaaatagaggtgctgaggggtgagtgtgtcccaagggcacacggctaatgtgtggcagaaactaatttgaacctgggtctgattgactccaaagcctagcatgtcctaaccactgggcagtgcagcctcacgtttgggccacactctccgggggttaaaacccagttcatgcccttgagggggcccaccagagacagggagccaattcagaa

SEQ ID NO: 6068 - DNA, 1190 bp, Homo sapiens
ttgccatgttggccaggctggtcttgaactcctgacctgaggtgatccacccgccttggcctcccaaagtgctgggattacaggcgtgagccaccgcgcccagccacatgtgctctttcagtggctcccctgggtcttgggttcttatctggactgagggtggattcggccagagctccaggcagcctctcccatgggctgtccttcagctccaactctgtgcctgcagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccaggtacctctgcaaggtgggcgggcaggaccgccaagccctgggccggatggaccaagcgccagtcccaggccacggcccccatcccagccctttctcctcctcccagttgcatggggcctctgaggagcctggtcacttcagcctgaccaacgccgcaagcacccacaccaccaacgagggcatcttctcccccacgcccggggaactgggattctcctccttccacagactcttatctggaccctacttctggagcctcccttcacgcttcctgggggacaaggtgggtagtgggtggaaaggcaaaggaaactccaggcagcaggaacagcgcaggcaaaggcttggaggcgggagggtcgtggtgccttgggagaatagtgagatacactgcatggaaaaggtggctggagcagtgacagggcccgaattcaggcctccgcaagctcctgtctaaccctggtcccaggtgacctcctatggaggagagctgcgcttcacagtgacccagaggtcccagccgggctccacacccctgcacgggcagccgttggtggtgctgcaaggtaacaacatcatcctagagcaccatgtggcccaggagcccagccccggccagcccagcaccttcattgtgcctttccgggaggtgagcaatactgtcccctgggggtaggggtgcgggcaggcccttgctcctgcctctccggcattcaatactccaggacgtcaggggctgagcacatgtgtcctctccttggcagcaagcatggcagcggcccgatgggcagccagccacacgggagcacctgctgatggc

SEQ ID NO: 6069 - DNA, 1135 bp, Homo sapiens
tggaggatgcaggctccagagagttccgagaggtgtccgaggctgtggtagacacggtgaggtgaagggggtttgggaagctcgcgggtgtggcggggcaggaccgaggatggggtgaaggcctctggggctgatggcactgtgtccctccccagctggagtcggagtacttgaaaattcccggagaccaggttgtcagtgtggtgttcatcaagtgagaaggggctccctgggggctgctgggggacttgagcgggtaacctggagggggctgatgaggatgggaaggaagcctggcaccgcggaaaggcctatgggatgagtcgctgtgggtggaaattcaggaattggtcgggggatcattgggacctttagttgcccttctttgggtacaggctgtcccggaacagggcctgagcgtcggggcgggagcctcatggaggagctgagaacacaggtgtctcgctgaccctcctctcctgcctgtctccatccccagggagctggatggctgggtttttgtggagctggatgtgggctcggaagggaatgcggatggggctcagattcaggagatgctgctcagggtcatctccagcggctctgtggcctcctacgtcacctctccccagggattccagttccgacgcctgggcacaggtgagcctatcctggtgtctgggatcgcctcctccagactcgtggggtcccctttcagtgtctctgccataggctcccaacttgggcttgcacaccactagaaacagggagctcactactcctgagtctgccccatcgatctttacacaatcttggcttggtagagcacagactgtttcctctagcacatacccgttagacccgagttctgctccttccttctagacctctgcacattgacaataggtaatcaggcctttatttatcctgtacttccaagtccaaaacacattagtacttaataataatgagcaactgtttactgagcactgactgcctttatttccagcctccgggtcagtcttcacagcaattcctatgaaggagatgttattcctcctgtttcagagacgagggaactgaggcccagaaaggaaaatctaaatttgtccagaatcagatgggcagatagtga

SEQ ID NO: 6070 - DNA, 1201 bp, Homo sapiens
tagtaaattcattgctgttctgagtgcttgaagtttgtagaattagctgattgagaatattgcccacatattatattacaaagccatacattttattagataagtaagttgctttttgagtaatgaccagcatgcttttaacactttgaggacaccaagattcagttgctgaattctctccaatatttttcttttttctagggcaagaggattatgacagattacgaccgctgagttatccacaaacagatgtatttctagtctgtttttcagtggtctctccatcttcatttgaaaacgtgaaagaaaaggtaagctgatcagatactcttgccctaagaagatcatctcagaatttctactgacctgttataaatagcattagaggcttgttgattaacaaaggtgtattttaaaatacctttttttagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacaggtaagaatggcatgaaaccccatgtgtatttatggtcgagtcatttattagagcattaggatacaggagttatttctaacagtgatcagcagtgctcaaagatgcccagcaagaatatgaacagcttcatattgtatgttcttttgttagaggcctctgtgttttttggagaatattattagttcctaaaccccttgtgttggtaagctctcgtattgtactgaatgattcgtagtggtcagggttgtgttaaaacaaaaaccttacaggaaaggttcagataagcataaacttgcaagagacgatgtgaatgattttttttttttctaaacacttaaattttcatctgaatatgtctgatcttttcttgccaattctgacaattgatactatactgtttcttgggcaattcaaccaggatagggaattagtcataataattgagactttaatgtcaaagaaggcagccatggctatttctgccacagttctcaagcgtgctttatatagtgtccctattcctatatttttggaagtattccttcctcatgcattccggccgtttttgagtg

SEQ ID NO: 6071 - DNA, 2149 bp, Homo sapiens
ttggtgaagtgagattattgtgttgagattcagggttgtttttaatgtttctttctttgccaactcttgggggtttgaatgttttaaatttgaactccaactttattatactgaaaatcagaccgcccattttttctttctaccccttttcagaaaggcctaaagaatgtatttgacgaagcaatattggctgccctggagcctccagaaccgaagaagagccgcaggtgtgtgctgctatgaacatctctccagagccctttctgcacagctggtgtcggcatcatactaaaagcaatgtttaaatcaaactaaagattaaaaattaaaattcgtttttgcaataatgacaaatgccctgcacctacccacatgcactcgtgtgagacaaggcccataggtatggccccccccttccccctcccagtactagttaattttgagtaattgtattgtcagaaaagtgattagtactatttttttttgttgtttcaaaaaaaaaatttttgtgtgtgtgtgttttttttttttttttttttgttgtttaaaagcaaggcatgcttgtggatgactctgtaacagactaattggaattgttgaagctgctccctggttccactctggagagtaatctgggacatcttagtgttttgttttgtttttttccctcctcttttttttgggggggagtgtgtgtggggtttgttttttagtcttgtttttttaattcattaaccagtggttagcccttaaggggaggaggacggattgattccacattccacttcctagatctagtttagaaaacatgttccccatctggtgctcttaggaaggagtatagtaaatgcctcatttaataacatactcctttttgaaagttgccttttctctccacccttgagtagatccagtatttgatgaaactcatgaaagtgggtggagcccatcttgcccctcctcttttctaggacgcactatatgtgactgtgactttcaaggacatttgtttgccatttgctgatttttttgggaagttaatttctaacttctttcactgataaatgaagaaaagtattgcacctttgaaatgcaccaaatgaattgagtttgtaattaaaaaaatttttttccctttcagtcattgtcttatatgcttagcatagatttgcagctcagtagtatatggtgttcctagaatgcagctgaagacctgttatgtagaggaaatacgaggggtggtgctagaagacagacatctgtggaatgattcacatcctctcaagttaggaggatggaggcctgcttcattaagaagctgggggtagggtgggggtggggagaacacttaacaacatggggaccagtcaggggaatccccttatttctgttttgcatatgaggaaccctagagcagccaggtgaggctctctagtttaataaaaatcatggaaagactcttaatgcagactcttcttaagtgttaatagggattttttcagcttattttggttgcagtttccaatttttaaaaatgttgaggtaatctttcccaccttcccaaacctaattcttgtagatgcattagtgttgaaccaatgctttctcatgtctcaattctttgtatatgcattcttttcagatgtattaaacaaacaaaaacccttcacaagccagcctgagggttgttattttccctccgtctcttacttttcagatattgaggagtgggaatttgactcttgataacatcaatttctaacaaactttgggataaaattttaaagctttattatttttattttctggcattttagtttgagataatatttagccctctatatgttcaggtttgtgctttctcctctaagtttgacccttcccttaaataccaagtaggtccataataattcttagtgaagcagtgttcaggaagctcactgctcatggtggaaggaaatgtcagtgtacctttaatccatagatcattgaaaagcagctcattttcccccaagttttctgcatcagtggttctccaactggagtgcagcttgaacaatgtgatttttaagttttccaggcatttctaaaatgtagccaagtttgggaatcaccacacctagttggttatctcaaactactactatca

SEQ ID NO: 6072 - DNA, 1260 bp, Homo sapiens
aggttcttgagctatcaagggacctggccagattcatgcttggaaagatcactgacttgcaatgtgtggtgacgttcagatgagccagatctggtcctggacagtcacagtaaagccagcttgtcggttcccggctagactgtgagctccctgaagacagagacccatctggctcatctttgtgtccacagttctggtctgaagagctctgttcaaattccacctccccagaggccttccctgattctctcttctaaaacagacccagttctgcttctttccatcccacctgctttgttgtgcttcatgaaacccatcgccacctgaagaagcatcaaagacttgtttggcatctgccttgcccactagactgtaaactccaggacttcatctgccatgtttgctgtgacatctccagtgcctagaactgtgcccagccatgcgggtgctcagtaacggaatgacattgtcagctgaggaacatggaatgaattgaatgttgagtgaatgaacagatgaatatatgatactgtgttatgtgataagtattgggagaatgatatggagatggagggaagtccatctggcagaggaaatcaaggaggtcttcctggagggagataccaaggggatggcttgagtagagatgcaagaaagtgctggggataacgaatagaccagttcagagggagcagagcattcagatgggccagcagccactgtgtgctaggtagacaagtccacttctgatggggggtgggggaagcctgcctccctccctcccccagctcaactctcccaccccaacctctaccctactgggcccacctctggggcattacctgtctaagacccagcgaccttccatgggattaatttggaattggttttccttttatgtctgtttcttttgcttctcatttttaaaggaggctgctttcatgtatttgtcttagccaggaaatcagggcttagatttaaaacctaaatgttgtagaatcagaaagccagttgacttattcactcattcatttctccatccatccatatatttttaaagagtcaccaggcacctagttcatgtcaggggctggttgggagaagggattctgcctgtggtggggaacggggccagctgacttcacaggcagtgtgtggtagagaaaatgcatagccttcaggcgcaaacagacgtgagttcaaatcccagctgtgtgctctggggcgaggagcgcagactccctgcacttcagtttcccc

SEQ ID NO: 6073 - DNA, 1458 bp, Homo sapiens
gaatggaggagtccagagtataagtcaaataacatttttccttattcaggttttctccctaaaaaacaaaaccatttttaattgcacttccattttgtaatggctcataggattgctgtaaggtctcaattactaggggcttccagggcatttctgagaaataaccctgggtccttgtctagacccttatgccagaccccactccaaagagcggtaagaattccttagtgtcatagcccagacctgctgagctgcgaggcttaagtgtccctgatcaccaaatgtcctgtgcttcagggtagcgaggctccctcccagaaggtagttatacatgagggaaggacgctttacaactgggtatctaaactgatgagaacacatgttaagcatcactttaggactgagcctaggtagagttttattgtctcatttctacttgtcaattctgggaaagtgcctactgataagggagactcttcgatagaatgatgaatagtaattgggggggtcagcctttaaaaaggtcaacagcaatttaagtacttagcaatttaagtacaagaataaaggtatatgtgcagcctgccaattttctctttttcccctaaaatagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttttgttttttttttatattttgagaataaaacttcatataaaattggccctctcttttgttcctttgagttggagttacatacaagatgggggcattactcctttggaaatgccaagtttatcctatggcaatagtaatacatgttttctccatgtttaaataaggaagaagatgttcatataaaagagaaaaatggtttgatcaggtcagaagataaggtaggggggccggtcctgtagaagcagtggacttcctggtcagtcggactaggcttcctcacttgggtgggggtggagtgtggtggtgtgccaagaacatggttattaggaaactttggatgcactttcaagatagaacacaaaagagctgaaacaaagtc

SEQ ID NO: 6074 - DNA, 1312 bp, Homo sapiens
tgttgaagagggacagctgtgatgcccttttgctggggctgccatcttgaaatctgagtgcaataggatttgcttgtaacagttatttcaggatattttgtttctttaatctgcacactttctagatagattttatttttaagtgtcctcagcattgcagaaaataacattgtaatagcaagtaaaggctggaggctgtttctctgggcttcaaatggctggcaaggctggctctcaaatcccaaagttgggaggcatgtttctgaaaagcaactgaggtgtgactgtttggacccaggcctcatcatcaggggtcctggaggaagcctccaagtagaggggagacctggtagttgaatagttgtttaatcaagccaaatagtcccactgcccccggtcaacaaacccacttttatgacagttttcttccgcagcttggctcttaaattttactggcaggtgtatggttgttggagggttcctagtgagttgggggacctggcaatagagctgcttggttggaggaagtgaagctggcttagtaccagcagctgatctcttccacgtgctgctgctttttttgccactctgatactaaaccagagaaagctgcaggtggataaagaagctgtggctgttttttgcttttgggtggcaatgagaaagagtcacagtgtgggttaaagggatctgcagtggggccaaggatgccaccccaccctcagctgtaggcaagcttgcacataaataacccccgtcagtggagtgttcgggatgcagggggcactatagtgttcttggacttgtcgtcctggggcagttttagttctttatatttagtgggtcagtgccaagtgctaccacttcccaataaaggaatggggacccagaggctgggtccctggctaccttgttatgaggttttgttatttctctgacaagattgctttggaaagagctgcttttagggattattttttgaataccccgagtggggagcagggttctcctcaaagcctcacaaccataggatcataggaaaggggccctattttcctgctgcttcccagctcagaacatatactgaatggaatgtatttttaagagaataaagtctatttttttgtattttaaagattgagagggctaagaaagtagccctcaaataaactgttattgcattataggcccctttgttgggggcagcctgttggtccacacctacttgctcaggcaggtgctctggtctctctcacccctgccccttagagtctaggtgcagcagctccaagcatgggaccaaggaggccag

SEQ ID NO: 6075 - DNA, 1057 bp, Homo sapiens
tatgaagtagacactattgccctcagaatgagagaacattaaactaccagtctggtaagctggatttttttccccatggctttacttccttgctgtgtgaccttgggtgagtcattgtcttcttggagcctcagtttccctgtctgtaaaatgagttctttgaaatggatgatctctaagggcaccaaatctggtattctaaggttctcctgttttcaccatctataatagtatgggatgatttttgcttgtggaaggtatcatccgtgtgggttcttccctcctgccctcaattgtttttctgggccttgttttttagtttctgtatgttttaatctcatggggatgagctcagagaagctccgtgggcctgtttcccaatctgcaaagtgtgaagggattagatgggatggtctctgaggctctttgtggcatcagccttgcccagtgccacacagtatctcctggcgttctaggagtctaggtattatggaaagtacccaagtctgtgtatctcctgttcctgtgcatctcctatgaatttcctggcaagaggaagactcaagacttcctccagaggaatttgtcttctctgccttcactcagcatgggaaccagtgttcatcctgaccttgtctgtatcagatttggcagtgaggaggcttggggagcacctaccttactttcagggacaggaatctattgctcatacttctgcttcccagagttttgccaatctaaaggcattgtcatgtggcctgcctttcctgtccacatccccacctctgatgctcaagatgctatttccaagatctcttactgctgcttctcctggcttactggccagaaactagctcactcaaggctgccatccttcacttgcagcctccctgccattctccttcactggttggcaaccttgagagttcaaagaaaatcaacctctgtggtggtcaactaaaggtattaggaaactaagtctgtggctcttctctgctgatggaaacagaagggcgccaagccatgcctaaaaagatctcgccaataattcttgtct

SEQ ID NO: 6076 - DNA, 1102 bp, Homo sapiens
cctgaagctttggacatttaagaggagagataaaggatgagagacgggaatgtgagctttttggtagtttgtatgtgggaaggaggaagagagctgtccggacctctcttcagctccccatcaaggatgtggacctcatccccagaatcatgcggcctgcatgcatgtgcagaactcggagactgctggcccctcctcaggggtgctagtcccatgcccccattccaggctctatcctctgtaaggctcctgttgagttgtgagcctcctcctagcctaccctgattgttcccagcagcttggagttcccagtctgccgatttccaaggaatttacatattggcccatactcaggcaaaagcatatctttgcagttaacttatggcctgtctgggctatatctgcctctgctgggttggaaaggacccactatggtagcaggtgagggtgtctcggtcctcactttactgacctccacagctcacttttgttatttattggcacaggaggaagaaggggaagactgtacactcagtgtctacaggcaactgcacaactccctggatccgtctgaactgcctgggaagcaggggctgccagagtctgggcgagtacgggccgaggaacgattacggccaaccaggccctgtgctgaggagaactgagcccgctgggtgtctgttgtctgccctctgctcctgcttctcagctcttccaccgtcctgccccacgaaggatccaaggccagttaaccaggcaagacacaagccttggctggaaaactgtggtagagccgggctgtggctcaggtaatttttgccatttggccagagggaatcagagactacaagctggacagtcacccaggcccaaccttccccaatgcacgagtcctctctctctccttgtccctgtccaccaagtagttggaccattctggcccccaaacaagggaagataaagtccccagcacacagcaggagtcaaaaattcttctcggctccttggtgggttgtttctggatcctagggcagcctctgtctgtgtggttaatgttctggtttctcagtctcctcactatatccacttcactcctcatttg

SEQ ID NO: 6077 - DNA, 1695 bp, Homo sapiens
ctgacaaggcttctgacacctcctctgagactgtctttggcaagaggggacacgtgcttggcaacggaagtcaagtaactcaggctgcaaactctggctgttctaaggccattggagccctggcctcatctcgaagatcctcctcagaagggctctctaaaggcaaaaaggctgccaatggccttgaggctgataacagttgcccgaattccaaggctcctgttctatcgaagtatccttatagctgtagaagccaagagaacatccttcagggattttcaacctcacataaagaaggggttaatcaacctgcagcagttgtgatggaagacagcagtccgcatgaagccttgaggtgtcgagtcatcaaatccagtggcagagagaagccagactcagatgatgacttggacatagcatctcttgttactgccaagttggtaaatacaaccatcactccagagccagagcccaaaccacagcctaactctagagaaaaggctaaaacccgaggggcacctagaacctccctatttgagaatgataaagatgctggaatggagaatgaatctgtgaaatctgtcagagcctccaccaataccatggagctcccagataccaatggtgctggggtaaaaagccaaaggccctttagccccagagaggcgttgcggtctagagccatcatcaaacctgttattgttgataaggatgtgaaaaaaatcatgggaggatctggaacagagactacgttggagaaacagaaacccgtctccaaaccagggccaaacaaagtgacaagtagcattactatatatccatctgacagcagcagccccagagctgctccgggtgaggccctgagggagaggcacacatccactagcaatatccaggtggggctggcagagctcacatcagttagcaaccatgtcagctccccttttgagctctccattcacaaacatgacatcaccctgcagcttgcagaagcggagagaatggcagatgggcccctgaaggacaggccagaaacagtggtctctcggagcagcattataatcaagccatcggatcctgtggagaggaatagccatgcacctccagcggagacaatcaggtggaaaagccatagtgccccttcagaagtgggcttctcagatgccagacatgttactgtgcggaatgcctggaagagtaggcgagacttgaaatctttagaagaccccccaactcgaataggtaaaaacgtggaatctaccaatagcaatgcctacacccagaggtcttccacagacttctcagaactcgaacagcccaggtcctgcctttttgagcagggcactcgaagggtaggaccaagttcaggggatgcccctgagccctcctccagaaggacccaaagtagcctcactgtgtcagaggtgcttacccgtcggaatcgggtaggagacaccatcactgtcgcagcctggaaccactcagcaagcatggtgagttccagcctctctcccctctctcttttctccctcccttttccttctttgccttttcctttttcccctctgctctggcctgtgtgacccaggatcttgagaactgagtagaactgggttccttagagaactgttgaaaaatcaggggggtttgacctttctcctaaagaaggtttttggcagcatcactttccaaaat

SEQ ID NO: 6078 - DNA, 1102 bp, Homo sapiens
gattccctcatctcagccttccgagtagctgggattacaggcacccgccaccacgcctggcccatttaagtttataattcagatattttgaagaattcttagtcattgaggactaatgatgaaaccagttgctgacttctatatgacagctacagtacttaagtaccttttatgtgtttatttaatctcttttcagcaacccattagggtagatattaatgaggataactattattatcctcattttgcagaggaaaaaactaagtccctaagatgtgagatcggtttgacccaaggtcagtgccaagctaggatttgaccttgagtttactcttgaacattacattgttttaacacataatgattttatgaactgtgtactgccctgtaagtaaatgaggtcaacattgtcttatgtttcctaggattgaaagaaagccatttttagatcttgatggacttaaagattcattaaatggaagactttacagaagtatacagaaactagttaaatatagaagattcttatagagatatttagaaaatgtagttagggtgtgtaaacaaagtaatggtccctggtagatttaaatcaggaataccagtttttatgcttcttgccacagctgtaatggagtataatatgatatattcttagtgtaatttgataaaattagacattttccaacatatgcgaaaatattttctgtaggaacttgaggacttatcattatgttagaattttgttttgagactagatcctagggcagttttaaagtgactaccagaatcttaaagacatgtgatggaaaaatagatgggaggacagttaatggagcagggagaattaatacggaaataataaggtaacttagagggagagaaaaggaaaataaaggaaagaatcccagcactttgggaggctgaggcgggcggatcacgaggccaggagatcgagaccaccctggctaacacagtgaaaccccgtctctactaaaaatacaaaaaaaaaaaaaaaaaattagccaggtgtggtggcaggcgcctgtaatcccagctactcaggaggctgaggcaggagaatggcgtgaacccaggaggc

SEQ ID NO: 6079 - DNA, 1425 bp, Homo sapiens
ggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaacattacctatttcaaattcaattgtgtcctaaaacattattttattcgtaatccttgcaaggaatattgttttcaaagtataactgcctatgtgagtgatcaaattcatgcaaaatttcttgtttattccaacatgtgttgtggatattagactgaggattagtctaaattcaagtatttattccaattagcactttcattgattggtgttctctcatagtctcttctaattttgaaattttatcttttattaaaaaaaaaaaaacaggttcatagacttttgagcattcttgcaggcattggataatttgcattaaaacaaataaaatgtggctgggaaagcagactgcaatttattttgacccacattctttataagggataatttgtgactgaagaccttatttgctggataagtgaatgtacatacagggaaaattgttagtactgtggcgtcaattgcactgcggactttagttttagtgaaaatgatcgtgactaccatttcagttactggtt

SEQ ID NO: 6080 - DNA, 1178 bp, Homo sapiens
ttttccacattctccgcagtctctttattgtatatggctcttcccagcaacagctttgtcttcctgatcttctttggctcaggagaccaagaaaatgaggctgtgttccccgagctcctccagagggtggagggagtgggaggctcggaagcctgcctaggatgcagtgtttggacagaaactctgtggttggtggccagggatgacttcctgccgggtgagtggagagagttaccgtcaggaggggtctggcttccagccctgtctctgccgggaatttgcctggtggccttgagcaaggtcctacaccctttctaagccccagcttcctcatctgttaatgggagaagtaactctgaccagcaattcccagcgtgggttccatgggatggtaacaggtcttgtaggggaaaggacagaggggaaggggactctataatcaaatttattgggaacaccagattaaacaaagctcagtggtttcttttttgcaatacttcgtagagccttaaacatgtggctcttaatcttttcctctgacagctggactcacaacctccaggggcccttccaaactagaagttatccgcatccttgtcatcatcttagcagcccatacatgttgagcatttgatatatcccagacaccacactagtgcatcacgtggcttagctcacagaatccttgtattttataaataaggaaactcaggcgtgtagaggttgtgtgactcacctgaggtcacacaagaggctcagacaaacccagggtcctggtgtccctgacactatagtgcttgctatgatctgatcttaccccagaagctattttctttctctgctacttggctgaccacaaatgcccaagagacatcaccacttggagagtcagaggtcacaaaagaggggcccaactcctgtagaagtccgaggagaggaagaaagggttctggagctctcaggcgtcagggccaggcctgcacccttctgtgcccctccatgaatggctggccggcccttgactgtgtcacatatctaccaagagctcaagagcacggacatgaagtaccggaaccgcgtgcgcagccgcataagcaacctcaaggaccccaggaaccccggcctgcggcggaacgtgctcagtggggccatctccgcagggcttatagccaagatga

SEQ ID NO: 6081 - DNA, 1548 bp, Homo sapiens
gaaagaaatggcacacccaaaggtgtggaagtgggagtgagcacgatgctctgggaactgtagctggagtaccaggaagcagaccacggaggataccatgttgacaggggagaaagttgactgttctcagttgtccttttacctggctatcagaatgatttgccatttgcagagcatgctcgctgatgcagtaactgaaatgccctcgaggtggcgcacagaagcagcgggcccggcctccagatgcctctactcagacctggggcaggaggattttctaaggactggtgcggtgcgggcacatccggggagcagaaggaagctgttgataaatccaacctcccaccccggccgatgatgccctctctgcagtttggctcagttcccaggcgtgtgcattgaaagcaaaatgagtgtggctgcctgaaatgctgcccagacacgaattccagccagccagccagctcctaaccggggaggcgggaccagggctgggtgtgccctgccaggaaggtgggaagaaatgctccaaacagcctagtcttgctcaggtaggaggactctggaaacctctcttttaaagacacagttgatgtgttgaaaagaatttggaagggcgacaggcaggttcgtggtctgactataccctttgctagttggatggataacttggggcagtaacttggatggataattcagttcagctctctgagcttcagtctactgatctgtaaaatggagacaattatgaacccctttcaaggtcattgtgaggattaaatgaggtaatgaaatacccagcactgttcccaaaccatgtaaatgctcaataaatacataatactttgtaataatactcatatgaaacctggttatctatgtaaactgcctaatactttgtcacttagttgctttcatctgccccataagatgggtactattattattccgattttacgtgtgaaaaaaactgaggcacctaggggttaaggaactcacccaaggtcacatagctacaaagtgttggtctcaggctgtgaacctgggagtttggctccagagactaggttcttaataagtaaaccaactcagtgcagtcgtttcaaaaacgaccaccattattactgtcattcgttggggctccttcaaagcagcatgctgcaggctcccctgacagttttcctgtggtgagtcatagctgttgagaatgtgcaatggcacgcacaggtcagcgagacaccatcccagctgcaggagatggcgttgcctgggtcctgggagttgacagaggctggctttgagagagatccctctcgtactcccagagagagagatccctctcttaggcccagagagtggggccactgtccttccaaagaggaccttcctctttccacatttcagccctgggggaccctctgggtgtgcctttcatctctctgtggtcagttcctcaattcatcatgtattcattcatttattcatttatccatccatttagcaatgatgtatcaagtgtccacctagagcactgttacaggagctgga

SEQ ID NO: 6082 - DNA, 1205 bp, Homo sapiens
taatcccaacactttgggaggccaaggcggttggatcatttgtggccaggagttcgagaccatcctggccaacatggtgaaacaccatctctactaaaaaaagataaaaattagccgggcttggtggcgggctcctgtagtcccagctactcgggaagctgaggcacgacaattgctagaacctgggaggtagaggttgcagtgagctgatattgtgccactgcactccagcttaggccacagagtgagactcttgtctcaaaaaaaaaaaagaaaaaggatgcttgggagtcatttcatgcctctgctttctctgggtttttctctgctctttggaagctgggagaggtcatactgggtagttggggtgtgaatctatagtcgaggtatagtgaggaagtcaggttgtgttctcagccaagtttcattgacttctgtttgctctggggtgcatgttgcaggctgagctattaatagttacttgggggtgggagggagttgaagatgacaaggaatgttattgctgcatttttctccacaggtgcgggagtatgagttaagaaaaaacaacttctcagatactggaaactttggttttgggatccaggaacacatcgatctgggtatcaaatatgacccaagcattggtatctacggcctggacttctatgtggtatgaatatttaatcttttcccgctcctggtctgtgaggagaggggaatctttatttcatatgtggtatgttggtgttcacatgttgagttgcagctttgaatattgtctgcctttgtgttctcctcccccttggggaaatgtgcctcatttgtggcaaatgtaggggtgcagctctgaacaaggtggacaagatccctgctgttggggaacttgcagtcgaggatctgtaaagcacccacatggcttaaaggtggatgaaggaaactgttccctccagccagtgatttgaaactttggagagaggcagtattggtgccacatttggcctatgggttggttggctgcactgaggctgttctccccctggttcttcctatagaaacagctttgggtgatgcagtggtttgctcaggaagggggttttaacatagaaatgaccttttgtgttactgccgtgttttggtccaacaataaaactgaatagcctaaatcagaagtcctgactagtgtggaacctgaaagatggtgg

SEQ ID NO: 6083 - DNA, 1365 bp, Homo sapiens
ccagtctcctgccccagctcagctctgtgtggactctggtccagacagaggactgggcatctccagagcctgcacagtacctgctgcacgtagggcaaggaatgagcactagaccgcctgtccccaagggagcctcagtggggcgacagggtgctcggcggactccacctcaggccctccccactgttgctgtgcattcctgtgcaggtgcatctctttcttactaactggtatttattaagggaggtgctctgtaggtctggagcctttccctcatcctttttgcgagtccccacctttttgtttttttttttttctttgaggctcactagaggacgcagaaccttgggagattgatttgcacagaactccccacctcccacttttacaatttccagtttctgattgaaaattttagggtttctccccactgcccttccctatctttccttcccctcaacaccatgaaggaaaaacacacacggcagggctttttgtagccctgaaggcaactttagacatttaaaatccagcactttaatctcttgttctctgtgaatcactatgagaagtgaatggttttaaaggctgtaatgctatgttggaaattggtttgttttgccttttattgaaaaggtaagatcatgtgattggaagaacacaactgttggcttgggaagaggactttgctgctgaagtgttttctaccttctgagtgtgtttaaggcaggatttggagggaaggaccagcttagggagagtgtctgagccacagcgtcaggatgggggaaaccacatgggatccatcaagttccagttgaacaggagcaagatcagaacttaggagggcagtgtcagctcccttgttggctgtcaaggaacaccgatctagtagaaacccacttggttgtgacccaggtagaggtagatgccatacatttgagatatgcgtccttaaggaacctgacaagcagactgaagggatggtaagtgtgacagcctgataagttttctcaaagcccaggatacagagccagtgttttctgtaactggagacctcagttaggccaacttcgaattccagagcaacgtaggaagtctattcagcagaaactcgacattgttcagtgtgtattgctgtgcagggtgcctattgtgacaggacacaaatgttactatgttttaatttgctatatttttgaatgggtaaagcattactttacttctcttggttacttgtaccaccattccacccctatccctagcctgccccacaaatctaatattaggaagcctcttaactgaaaccaaatgaacatttgggtcaggtgccagatgtctgctgcctagaatagctttttctag

SEQ ID NO: 6084 - DNA, 1139 bp, Homo sapiens
ctaccaccttgaatttatctcttaactgtgtgttcaagtctttgtcattgaaactagtttttcatatcttagattcagttgtgtatgatttaatgtcccttattaggagtctttaggcagggagggaagaaaaaacagatttgttcatagcaatgtcagtatccattttggcacataaagatttttgatgagccctgtttgcatagagccagatgttttcccctcccccaagagtatctacatcagggatgtgacttggtgcgaagagtcaggggaaagaggaaaaacccaatttctaaatgacctccttgcccagcttactaaaatggctgcagagcagacacaggatgaatttgaacctgacacaggatgaatttgaacctttggtctcatttatggaaaaacttgtgcaattttttttctgtgctacactacatacaaatcaccaaattacaaattacccttttgtgatccttggtgtactgagcagtttctttggggctttttctttctgggaagcgggagggaaaggagcaaggtgtcatcctgctcttcatttgtattttggtcccaaaatgtaaatacaattttctatgttacttttttgtggtaactaccgagatgaatattttaattagataagttatatgaaaaggaaaattccatgtctaaataaaaaacaaactccatatactgtgtcttccttacttatagcatcagtggaaagaagttagaaaatgcctgattcttggactgtttaaggcagagtttttttttttgtttttttttttgagatggaggaggcaatctcagctcaccgcaccctcctaaggcagagatcttaatcagcatccttgggctgggccttaaacgatgccgaatttagtagtaagaggaatttcagacggaaagaattctgtgagcaaagggcgggaactcagcatttgtggggaacaggcactgtcccttattatacttggaaccctggtaaccccatcttaaaattagaaactggttcaaaggggtgaaatggggccgggcatggtggttcatatctgtaatcccaacactgaagggcggaggcaggattgcttgagcccaagagttcaagaccagcctgagcaacatattgagaccct

SEQ ID NO: 6085 - DNA, 1493 bp, Homo sapiens
cccgtctctactaaaaatacaaaaattatccgggcatggtggcacatgcctgtaatctcagctactcaggaggctgaggcaagagaatcgcttgaacctgggaggtagaagttgcagtgagccaaaatcacgccactgcactccagcctgggcaacagagtgagactccgtctcaaaaaaaaaaaaaaaccggatgtctaggccaatgataattatttttgatgcagtgtggattagttcttttgttaaccccactgtcttggggaatgatgccagctgggaaattgagtttttgactgaaacatggagccttcactgctttttttctggttcctatgaagatttggaacatagaaaacacaaaaactcaccttaaaatttgagcaggtcgttgatggcaaaaataattttaaggaaaaaggaatattcttatgtagttattctaaagtttaaggagcgttgttgaccataatattgcttagttttcttactgctgttaagtaagtaaattgtttcaaagtaggttttgtgtgtgtgtgcctagtgtaaaagaactgaaattttgatgcttacagcacttggctcgtgcatttgtatcaaaatttgcctgcctctttatgagggaggcctgcttttcacacctcagtttatttaatacgaggcaagttgtaagacaacactcattctaggtgattctgtggtgccatgaaatttaaggtaatttggggaaaaggattagtcagttttaagcaagagtcacatcttttgagctttcgattatcagtgtagtacctgactaaaaatgaagtaatacccttaaaccatttataatttctagtatttctctgaaagatcgttttggggacaaaagtgacttgacatgtccaatttcatttcagaataaaaagctagcatctttaaaaatctcagattgcttgcttacagatacaagtacgaattatggacaaacgattccttttagaggattacttttttcaatttcggttttagtaatctaggctttgcctgtaaagaatacaacgatggattttaaatactgtttgtggaatgtgtttaaaggattgattctagaacctttgtatatttgatagtatttctaactttcatttctttactgtttgcagttaatgttcatgttctgctatgcaatcgtttatatgcacgtttctttaatttttttagattttcctggatgtatagtttaaacaacaaaaagtctatttaaaactgtagcagtagtttacagttctagcaaagaggaaagttgtggggttaaactttgtattttctttcttatagaggcttctaaaaaggtatttttatatgttctttttaacaaatattgtgtacaacctttaaaacatcaatgtttggatcaaaacaagacccagcttattttctgcttgctgtaaattaagcaaacatgctataataaaaacaaaatgaaggaaataatgattaactggaattat

SEQ ID NO: 6086 - DNA, 1213 bp, Homo sapiens
gaggtgcctaaaatgtggcaggtacccactgggtatgacccatcactcatcctggtcactcagaaggcctgaaaacagggcgcctgctgtgttccaaccacatcccctcttccattccagaatcttagtcaacatggacaacaacatcattcagcattacagcaaccacgtcgccttcctgctggacatgggggagctggacggcaaaattcagatcatccttaaggagctgtaaggcctctcgagcatccaaaccctcacgacctgcaaggggccagcagggacgtggccccacgccacacacaacctctccacatgcctcagcgctgttacttgaatgccttccctgagggaagaggcccttgagtcacagacccacagacgtcagggccagggagagacctagggggtcccctggcctggatccccatggtatgcttgaatctgctccctgaacttcctgccagtgcctccccgtaccccaaaacaatgtcaccatggttaccacctacccagaagactgttccctcctcccaagacccttgtctgcagtggtgctcctgcaggctgcccgttaagatggtggcggcacacgctccctcccgcagcaccacgccagctggtgcggcccccactctctgtcttccttcaacttcagacaaaggatttctcaacctttggtcagttaacttgaaaactcttgattttcagtgcaaatgacttttaaaagacactatattggagtctctttctcagacttcctcagcgcaggatgtaaatagcactaacgatcgactggaacaaagtgaccgctgtgtaaaactactgccttgccactcactgttgtatacatttcttatttacgattttcatttgttatatatatatataaatatactgtatatatatgcaacattttatatttttcatggatatgtttttatcatttcaaaaaatgtgtatttcacatttcttggactttttttagctgttattcagtgatgcattttgtatactcacgtggtatttagtaataaaaatctatctatgtattacgtcacattacttcacatgctgctctcgttccttttgggagagtctgctggaaagagatggctacattggtcggggcctcgctcctctttctcccttcgctctggctctgtgcggagaacgggttgccctggacttgaaggatgctgggacgtgcagg

SEQ ID NO: 6087 - DNA, 1241 bp, Homo sapiens
ggcgggaggatctcttgaggccagaagtttgaaaccagcctgggcaacatagtgataccccgcctgtacaaaacaattgaaaattagccaggtgtggtggcatgtgcctgtagtcctaactactcaggaggctgagacgggaggattgcttgagcctaagagtagtttgagggtgctgtgagctatgattgcaccactgcactctagcctgggtgacagagcaagaccctgatgccaaaaaaaaagtatatatatatataggtatgtatgtatatcacctactccattacttggagataattttcattcggatttcagtatatctccttgtttttttctagtattataaatttggggtcacattgcacataaagttttgtatcttggttgtttaacttgaccttacttgtggaatatttccccatgtcatcaagtagtgactgaaagcatacttttcgaatgattgcccaataatccgttgagctgctgtgtcaaaatttgctcaacagatcctcattgctggatattcaggctgtctctaatctggagtggctgtaaaccatgaacatcctggagtgtaaatctctgtgctgatctctgatcctttccttagatatagtcatataggtacaacgaataggtcaaagggaatgcaccttttttaacaaggggattttaatgacaaatttaagtgttcctaaatacctatcagtgcagcatctgattactgggatttattgaaaattatttttttaaagatcagagaggccaggtgtggtggttcatgcctgtaacttcaacactttgggaagccaagacgggtggatggcttgacctctggagttcaagaccagcccgggcaaacatgatgaaaccctgtctctaccaaaaatacaaaaaattagccaggtgtggtagggcacctaccacacaaaaaatacaaaaaattagccaggtgtggtaggaccacctgtggtcccagctacttgggaagatcatttgagccagggaggaagagattgcagtgagccaagattgcaccactgcactccagcctgggtgagagagtgagaccccacctcaaaaaaaaagaaagaaaaaaagatcagtgactgctaataccgtagagctaaaggagactttagagatcatctcatcaaacctctcatttgatggactggaacagtgaggctgggaggtgagaagcgacattcttaagatcctatagcaagttgagagga

SEQ ID NO: 6088 - DNA, 2100 bp, Homo sapiens
cctgccagtcatgcaagaagagcacggctccagaagtgcctctggggtcccctaccgagtcctagagcacaccaagaaggaatgagactcgcctccctctatttataactgtcccctccaggctgacagtggttcaaccctgaatcctaaaacttgcctttcaagtctcattttgtttctaactgagaactctatggatgatgatctcaaaaagcctttgtctctgggaaaggatgcgttatcttggtcttggaaatttcaaatgatgagggttgggggatggaagcattattccaggtggacgggatagaatccagcctctgcctggattagcccagggggatttggaaagcctttctaccatccttgaggatggtaactgagcttcctctgacagtgaccaaaggatgctgtatccttcagagctaaggcaagacagagagtctgctgttaattctcaaatccagcgaaaggctggacatctctaaatctcgtcttcctccacctcatgtgcatgcctgatctcaccctgacactcctgatgccgcatctgtgatagcactcgtgttgccttcacatggcaggctgggccaaccctgggtggaaggttctgacatttgtgttttcagaaatgtacatctgccttccagtcatctgtgcccttctagggaagatgtgcttgatatgttcaaattggatctactctgaaaacgaaacttggttttggtcctgtgaggactacttgtttgtccacctcctccaccaaaggaattaggaagttaagagaaggggaagaatatggaggataggagagggtgatgatgctttagcccattaaggaagaaaagttccccttactcttacaaaaggtgattgcaccacttaaaaaaggataggtagaaaatctggccattttatgtgttatttttttcctgcataccagtgccccctggaaagatggggatgctcatttcagagacagcctcttcacctgtcctccgtctctccattacagagccacaagccaagcttgagttactggttaatttccttgaagtcaatagagactctctgggtcctcatccccatgcatatatgtctgggagaagcaagcattctccaaaacagggctgttgctttcttcctggccgcatatgtgactgtcttcccctagactgatggtatacttttgagaggggcggataaaggtttgcaaactttaatgggcataaggatcccctagaagcatatgtaaaatgcagattcctgcaccccaactgcagacactgttaagtgggactggagtggggcccacgggtctgcattcttaactggtaccaccagtgattctgatgcgatgcttcaatcccgagatttcacatctggaaagcctaagaatttacaaagatgttctgctaaaacccccagggccccatgcagtcttgctagaaaatttcctccctagggttcctttggaaggttaaatactccccataggatctgtggcatttctccatccaatgaatactacttagagctacactcaccacttccctagacagcctttaataggcatgataacagtgttaatagaccagtgtgatagatcacttatctttatggattgtgcttaatactgatttagtatcttgactccaaaaactgacatctgttgtctgtgataaccacttctgtattgcgtcttaaccacttctgtattgtgtggtcttaactgcctaaggcggcaatgggcagtgggcccctttcccttaggatgggtatcaattcaacaatatttataaggcatttactgtgtgctaagcatttggaagacccaggctacaaaataagacatagttcctgccctccaggccagcagagggaggcacaaatacccaggaatctctgatgggtgtgaagtgcggtcgtgggccacagaaaatgaccgtcatggagaccctgctaaaggtcggaccctgagcccaaaggggtattcagaagtggagatgattttggccccactcatagatgggtggcaaatctaagatttgtataaagcatataaaatagggtgatcacccccgaggcagaggggccagc

SEQ ID NO: 6089 - DNA, 1169 bp, Homo sapiens
agaaagttaaatggtagtttcctgactggaagccacacgtaggtcacttgagtagtcaggaagcacagtgggtgtggagccatcatctgtcttgggctggttcctcccaatctttgtccagtggtataaatggactgtctgctgatggccatacgcagcactggctgttaagatggggaaggggtacatcaggattccactcatagccctggttcgttattgttactcatggctctgacgtccccaagccctcttgaatgttgcaagcaatgttaaatatcacacctcggtctccttttgagcagcccaggtacctaaagcaaggtcaccaaacttgggtttaaacttcagttgccatcacagcagggttcaggttatgcagtttttgcagtgtggagttgaacgctgggtaaagaagggagagctgactctccattgcttttctagtggaaaccagccagtttgacggcacggtgcggatacaggactccatcaggctagtgttggggaaccagcccggcagccttccatgtgaattccaaagctgtttcaacactggctgataggcagacaaaaggttacttgtgtgtttctctgagaagcggtgtaaatgaagtcaccttagaatatattctgtgcggatgcttatattttgttaacttcacgacttatggcatgtcttatttaaaaaaaaaaaagtactaggtgcaaataacattatgaagtggtatttaattaaaaatccatgcagtgacagctgagttcgtgtcttatgtttggctaatacttcctagaattatctagaacagtactgtctagtagaactttctgcgatgatggaagtgttctatgtctatgctgcccaacatggtagccactctccacaggtggctgttgaacactttaaatgtggctagtgcaaccaaggaactgaatgtttaatttcatctaattacatttccatatagttcgtatattaacagtacagatctagagatgcccattattgcagctgaggctcacttgagcttcccctgcaaccttcaccgtggttaaaagcacagactcttggccaggcacggtggctcatgcctgtaatcccaacactttgggaggctgaggcaggcagaccacctgaggtcaggagtttgagaccatcctgaccaaca

SEQ ID NO: 6090 - DNA, 1193 bp, Homo sapiens
acaaggcagatttcatgtctgctgccaggctcgaccgctttacagacaatcctctctcgtctggtaaacgcgtaaaacctacacaatcacaactttcacaacgagagggaagccgcaggcctctcgtcggcgcacgggccgcctcgcccgcgtcactctgaggtaacagcctttctcttcaatcgcttcatggaactccaggacgccaagcctcttccactacgggtcgaaggatgggtcacgtcacattgcgcgaacaaggatggtcacgcgccacaaaaggacttgcagggcggggcgactcgacggccttcccttttgctcccattggctgcggtcgtcaggttcgcctcctccactacctaccggggagtttagggcctgacagaagcccgcccccgctggcgctcgtgcgcacgcgtggcgggctctcggcgcactgagcaggcgcggcctcgtgtcggccggagggggcgggcgcaacgacgcgcgctgcgtcccggcgctcggctttccctccgccggtcccgccctccgtcgcggcggcgcggtgtaccctgggatagggagcgatctccgagcgaggcggcaagatggacgcgggatttttccgcgtaagtagaagcgccgggcgccggggtgaggccagggacttctcggtaaggcctggtaggagaccttagcttggcacagggtggccagcgaggggagcttcggagatcttaaggattcctcctagagccggcgcaccccccccccccccgtgcgctgcggcggagaccggtgcgcccctgcgcagtctcctcctccggaatggtcccccctacgcggcggcgacggtggccggaaaatggcggcgggaatgggccgggatggtacctcgctgcccgcctgcctggcggggcctgcaggccgagcgccgtgcgtgccgccgggtcctggggcctagcggagccggaggaggaagtcccgagtgggaggccaaaggaaagccctaaggtcactggtggcggcagggcagggagaatatggtttgggggtacatcttgggagagcaccttaggggagggagaacaggaagaagcattcagcggctttttttgaaaaagcgccctccccgccccccaacgtcctccctccaggtcctaagccttcgtggaggcgccaggtcagggttcgcgggagctcccgcc

SEQ ID NO: 6091 - DNA, 1037 bp, Homo sapiens
ctcattccaagttcctaaaagttgtagaagactaacagcacagtcctgggatgttcttttttcctttcaccctgtttgtatgcattgccacagtagttttgcaagcatgcaactggctttcaaaaaagaatgaaatttcaaatacttcaatgtgttctcatttaaacagaaaagccctacgtatctattagcataggaaaaggtgtgaaaggatacaaatcaaatctaacattggatatgaggaggtgttggctttatgctgtatactgttgttttaggtttgacttatgatgaacatatacttgataatttaaaaatccagtcaagttttccaagtatcagctacattggggaaggagtatgcatttctcatctatgaaaactagtttggtattgtgtttacttggttaccctattttggctataaaggtcgtaggtgataaaaagtaaggatttaactttgaacccttagttaagatgtggttctcttcctgcagggaacaagtgcagaacaggataatcggttcagcaacaaacagaagaaactactgaagcagctgaaatttgcagaatgcctagaaaaaaaggtattcttctggatgagactgttgtgcatctttatagcacacttacttgactcaagttctggggttgttttggagatgcattgtaacttgaatgctaagaaaaacataattgaacattaaccaccttttagccaccacacgtggcacagccatataagaattagcagattgtggctgggcgaggtggctcacgcctgtaatcccagcactttgggaggccgaggcgggcaaatcacaatgtcaggagattgagaccatcctggctaacacggtgaaaccctgtctctactaaaaatacaaaaaattagccgggcgtggtggcgggtgcctgtaatcccagctaattgggaggctgaggcaggagaatggcacgaacctgggaggcggagcttgcagtgagctgagcaccactgcactccagcctgggcaagagtgcaagactctgtctca

SEQ ID NO: 6092 - DNA, 2851 bp, Homo sapiens
tcaggtggacatgagcaaagtaaatttggaggttataaagccttggataacaaaaagagtaacggaaatccttgggtttgaagatgatgttgtgattgagtttatattcaaccagctggaagtgaaggtactaatatacaaatggctcttgtttctgaatatgtgatataatttgtgaatctttggaaactgaattttttctatggagtgcaaatatagaagggttattttacaatgtttgttgtgaaaagaattcactttgtaaacaactattaaggctggaagtttagtgaaggtgcatagttttgaaagctacacaggtgaaaaatcaaacttattgtttgtaattttgctgttacatgttaagttactttgacagcaattttctaatgataatgtgatttatgatttaaaaggcctgaaccaaaatggaagttattccttgcgtctgaagtatagcaccatcaccttattaggtcacagcagagtgagtgtcccaatgtcgctctgacccaactcccttgatgatgcagtgtgtgtttggaggtgagttgtgtaaagtggccaaacatcaacaacaacaacaaaaaacacaaacaggaaagagcaattgggtaaagctgtacactgctcttttaaaatactattatgagatggacatttatgtgaagcatgaggggcaattctgatttgattggatattgtttttaaaggaactaaggtctttgtagctgcatgtcagctagtcatcagttacattttagagacaggatttttgtttatacttaaacttcagacaaattggcagcatataattgttcctttatacatgagataatatgatgatataactgatgtttaagaacattcttattgtaagacagtttctgttttgccacagcaacccaaaggacagttaagatatgtaccatatgacctttttgcatatataccaatgtgaatttacttttacattaatcatttcccccaaagagttcaccctatgttttgacagaacagttggcatttcaactgataaggtatttctagttttaaaataatttggtgtttgtattttgttttgaatatttttaaagactaattttaagaatgcactttctataaagtatatgcatcttagaaaaccaggaacaggggagaaagttttttaaatgatgattgaagatagattttattggagaaatgctttactgatgtgtattttagtgcattttaaaaacctaagtatctggtagtattccccttgtagtgagcatgagattaaagtttagaactttttaagacaattctttttttgtggttgtgtactcattattgcttgttcgtcttttgcaatttagataaatgatataacattaaactcaaggtggttgagttgcagtagggagtcggaagcaagccaagggaacatctttctctacaggggacttggcgattccaaacccccaaggttccaagaagaaactgaagacacctggaatctgtacttgctttgtgctattgagctgtgcttgttatacagaccttgttgcttgaccaacggatttagcatttaaaaacccaattatttttgagaaatcttgacctcttagcactttgtggacagttgagaatttgaggcattgttataatagattttccttatataaaactcaggcctttagcttagccctcagaagttacagactgcatgcataacttgttagttttcataactggacaatagatattttatgcaaagctatctgtagtgttagggagcagtttatgtactttttccgtttctcattgggggaaaatttccaggcaagcaaatacttttcttgttagtaaatactagaatttgtggatgtttcatgatggtttttaaagttaataaatgtaaggcccactaacagccacagagtctaaaaatacttacgaaatccacaaaggattaacaggctgctctgatgcttttggtagagtgagagagaatttggtaatctgttagagattatattgctgagaagctactagggaagactatttgtaaaatagtaaggactatatatatgtctaagcccctatggtagacttaaaaaatactaatttaaatgagttttaggttggttgatttgttggttggttggttttgaagtaacctgtttttcttcctgtcgtgtctttttgcagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacaggtaataaccttttcttttctgtaatgtcgatttgagagtattggccaggctgccgagacaccttaggtagtatatgactcagctaggatcttcatgtagttttgctttgctgtactgtatttaaacattcagttttggttcactgctcctccctccaaccaaacattgagtttagaatgtcattttcccagtctagtgatttgctagatttttacaaattcttaatatgtgagtgcatgtagcttaaaagaaatttgaatttaacactgaaaggtaagcataaggatttttggtttgttgtttttttgagacacagtttcagtctgtcacccaggctagagtgcagtggtgtggtctctgctcactgcagctttcacctcctgagttcaagcgattctcatgcctcagtctcctgagtagctgggattacaggcgcacaccaccacatccaactcatttttgtatttttagtacagacgggatt

SEQ ID NO: 6093 - DNA, 1606 bp, Homo sapiens
aaccgtgtaaattctgttttttttaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttttttggttttgattttctttttgtttttctttcttcttcttatttttttcatttgagtcttagctcccatttaagttatgcttctgaccttgtatggtctgtaagcttgcccagaaataagaccactgttttgaactaccacaaaagtataaatgaatattttaatgccacaatctttcctgttgcctgtggagtctctgctgaaatgaatcaggattcgagctctaggatgagacagaaaatgaaagcatgttgtttgccaggacactgtgggtttatattgatgtgtaacaagttgatttggaacactggactctcattctgttattctggttttgttttttttgttttgttttttttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattttttttttgttttgattttttttaaactaaagctatataaagcttgtggattaaacagaataaatttctaaatttaaaaattttgccactcttacttagtagtgcttatgtaaaccttttggtgtgttgggagttgggcaggggaaagaaaaggtgatgaaattaaggttttaccatctttatttcaataattactgtggtgagtgctataaagggaatcagcatgtgattggaacatttagaatactggtgggagaagtccaccaggcaaagagaacaggattgcagtcagacaaacagtgtctgtgtcttccctgaggcagaaggagcctgctggcatgttaggaagtgaacaaaggctaaggaatgactggaacaccctctgtcaggggcggggtgggggggggggggttgtgtgtgtgtatgtgcgtgtgtgtgtgcgtgcgcacgtaatatttggctatctacaaccaagtctgttttgcatttaaaactaagtggaacgaaaatttggggaaacttggagttgttaacatagtgtgaggtaaaacagcaacattcgtatgaaagaagt

SEQ ID NO: 6094 - DNA, 1181 bp, Homo sapiens
ttttgcacgaacatgcagttattgaagattaggatcaaggatagacaaggtatagtagttatcttaaaatatacactcctaagcagtattattttaaaatcctttaccctggctacctcccctacccgggttcccctctctttaatttggagacactccaccacaaacttttcactttagaggtagcttgccatctctcaggagccctcaccattgtgtccattcactgtgtatagatggcagaacttttgaggtgcaatgtttaattgttaaaaatagtagccacgactttatcaggcagccccaaactggtgcataatgcatggtacaagaaatatttatgtattttttggaattttgtaatatttagtaagagtatatgaaaggattgctactgtatcagaaatattgtttcaatttagtctatcctggatatgtactaacgaatattaccaccagagaagagagctttctacaaaagtcactacagattttgctatattgctttgtagatagatttttacttttgcctaaaagcatttatccttcataccaattgtaacatctgacaccatgtagaagctaaaagtttagagggagtgagggttttctcaagaccttcctcaagcattttatctttagaagagaaactgatgggcacctgatactctgtctaaatacgtttgttatatgtgttttgccctgtgccattcatttggaactttattgcattctttattttaaaaagcttgtttttacgtaatcatagagcttgctatttgtacatctgttgagcaacactacataactgatttttagttgacttagctatagcagtacaatgattagtaatgtaaaaattaacacagaaattaacctaaggaatgaagggtgggtttgtcaaaatatcaagtaaatttttgtttctaaagtacatttaatgtagatgacctaaagaatgcgttatccatcctatataaaagaaagataaaacacaggtcaccaattttctcatttcaccccatttaccttgtatagaggattgttcattcctttgggactaagttatagttatggtgagtgtgtatttactgtagttttgcctgatctcactcattgcacttcctggagttaaattttccaacagccatgttgaggaatagcactctgcatgtttttgt

SEQ ID NO: 6095 - DNA, 1704 bp, Homo sapiens
tatcattaattagcttagtatgaaagataagaaaatctccatgttgtatccatttggctcaggaagattctttgccttacctttcttagaactctttattgcttatcaaaagtttgagtacccgcttggtttttttttggtaattaaatattgtatgatttatctggttcaaggaagatgcactattcagttatctattgagaaattattttgcagtggttttagtgggtgaaaatgtcccatctgcaccagtacacaggcaggcattatcattcttcacctactttttaaatagtggcaacttgggattcattctggtgattctgaaccttgcctcatagcttaaagtataaaaaagattcaagagcagtgaggtttgttctttccagtgaatggtggactgagtggtgcgaggtggagggctaacaagaggaaagaactacattcttcagaatacagtgatgaaaattcattttgaaactcaaatattttcattttggatattctcctgtttttattaaaccagtgattacacctggccatccctctaaatgttctaggaaggcatgtctattgtgattttgatgaagacagaattatttttctctgtagaaacacagataccactttatcagggaagttagtcaaatgaaatggaaattggtaaatggacaaaagctagctagtaaaaaggacgacccagcaacatgctttaaccccattgtatgtttgtggaaagagcatagtttaacatcttgagaaatttgggacataaagttttcatggtagacagttcatgcagtatatgaattgccataatggaaataatctgattttatttttacaactaacatccattccccttcatttaaacaccttttgtgttttacttcagtgaggagattggagtctgaatggatctgttttccaagagattctgagaaatttttgtattcagcagttggaaagctctctattctagttgataaaacttcccttttttgatgtagatgcagatattctatacagttctgttgtcttttactaggactgtaaacttttgtgataaaattcaaataagattttatttcttggtaattttggctttcacaatttatctttaaatccttgagcaatctgtatacaattaagagatttctgacatttattcttacactaaatggatcaactctaggatttaggcatgttaacttctgttgtgttttgaatctctccagagttgcatgtagatagcatttatttctgtgcccttaaacccatttagaaaataactacaaagtaaaaatgtagaggaaatagaaatgtattttttcatgaacattttgatacaaatttcatcatttaatgattcaccaatttcttgcattaatttgaatttaagcatttaattcaaagagaggggagcatccattattgatacatgtgggcttttaaaaactccatcctttataaatagtcaaggtttgggccacacaaagtatatttttatcatggaaaaatttcaactcctcaagccgtaatgttgaacagaattggagtattttctttataatttcttgaacaggcaaatgaaagcttattatagaatgcatgtattttcttttatctttggaacatcagcaccagtatattgctggcagctattgtattaaaaaataaagtatattttcactatcataaagg

SEQ ID NO: 6096 - DNA, 1274 bp, Homo sapiens
cctgtagtcccaactacttgggaggctgaagtgggaggactgtttgaggccaggaggttgaggcagcagtgagccataatcatgccactgcactccagcctgggcaacagagagagggcctgacttttaaaaaataatagtaaaaaataaaataaaaaaaaacctgggttaaaatcctgattccccttgtatgaccttgggcaagtcaccctgcctctatcctcagtttcctcatttgcaaaaccagagctacaccgtgcaccaccaaggctagctagagattcaacaggaggacgcagataaggaacggattgccccaggcgcgcagtgaacactggcctcctctctctgcttatttttactcagcttaaatttatctgtacatccccaaccaccacctgtgtcactaactcgctgtggtgacctgacatcagacctttctctctctggtcttcatagcatttggaagttgaggagacttcaagtttcaagtcttgagcccacaccctcatgcaatgacaaactaagacttccaaggtcagcgccgaagcagggctttggtctcgaggtgatccagccagagactcatccctgggtcctggctctccccatcgccccactaggagagcttgagcaagtcccgttccctctctgggcctcagttgcccatcagaataatgagggttggggtcaggtattttctgaggactcttcttattctgttatttgtcaagtaagggattctgagttggatcggcagggctgcagctctggccacctgggtgacttatctaagaagtcagctgatggctcccctcgtcccaggctgggtcacacctccctgcctgtgaccgtgtgactctctcctcctccactggtgagtcccttcgttcacaccacaggtattgatctcacgccactgtcacctctgataggaagtgttttctgacctctagccgccaggtaaaacaaacctctctcttcttcatgcctcccaggccccaagcacactctcagtgtcaaacacggagcactctattgtctttgcgtgtttgtttgtgtgtcctgggagcttcttgaggactgtgtctgggcctgatccaggcctgtatccagcattgggcctggggcacagttggcagagtaagaatctattgaggaagaaaggaggaaaggagggaaggagggaaggatagaaggaaggaaggaaggaaggaaggaaggaaggaaggaaggaaggaaggaaggaaggaagtcaggcaggctaagctcca

SEQ ID NO: 6097 - DNA, 1221 bp, Homo sapiens
tggctcacgcctgtaatcccagcactttgggaggccgaggtaggcggatcacgaggtcaggagatcgagaccatcttggctaccatggtgaaaccccatctctactaaaaatacaaaaaattagccgggtatggtggcgggtgcctgtagtcccagctactcaggaggcagaggcaggagaatggcatgaacccgggaggcagagcttgcagtgagccgagatcacgccactgcactccagcctgggcgacagagcaagactctgtctcaaaaaaaaaaaaaaaaatcagacatataatggttacatagtaaacactggtaactttttaaaagtcacatgtgtattcagtacttgaaagttaaggttgttgggaatatggtggttaatagcacagttgaacataatggaagaattcactaccttagaatgatcagtttctgttttgatacatttcgtaccaaaatttcttctacaactcatcaattattcttcgttgtttgtttcacaccattctcgaaatctcacatactcttttctcaaattcagggagtcatgtgatatttcttgttttattcacagagggctggtttttaagtttggccgcactgaagacttatggcagtgaacacatctgatttcccacagcacaacagccctgcatgggtttgtttgtttttttactgctcactcccaaccttttgtaatgccattttctaaacttatttctgagtgtagtctcagcttaaagttgtgtaatactaaaatcacgagaacacctaaacaacaaccaaaaatctattgtggtatgcacttgattaacttataaaatgttagaggaaactttcacatgaataatttttgtcaaattttatcatggtataatttgtaaaaataaaaagaaattacaaaagaaattatggatttgtcaatgtaagtatttgtcatatctgaggtccaaaaccacaatgaaagtgctctgaagatttaatgtgtttattcaaatgtggtctcttctgtgtcaaatgttaaatgaaatataaacattttttagtttttaaaatattccgtggtcaaaattcttcctcactataattggtatttacttttaccaaaaattctgtgaacatgtaatgtaactggcttttgagggtctcccaaggggtgagtggacgtgttggaagagagaagcaccatggtccagccaccaggctccctgtgtc

SEQ ID NO: 6098 - DNA, 1197 bp, Homo sapiens
taaactatgaggatttgcttcttgattagcgtataatgagtgtgcaaactaatgtgaatttcttaagtgtagataatagtttgttgaattaatctgtgttgttaaacaactaaatattccggtgggggctttttgtttgttggtttgtttttggtattgtagcagccaaaggattacctgatatggattcttcgatccttatacaccacaatggaggtatcccagccaacaaaaaactctccacaactttgccagagatagaataccgagaaaaagggaaagaaaaggacaaggatgccaaaaaacacaaccttggaataaataacaacaatattctacaacctgtagactctaaaatacaagagattgagtatatggaaaaccatatcaatagtaaaagattaaataatgatcttgtgggaagtacagaaaatctcttgaaagaggactcatgcactgcttcctcaaaaaattacaaaaatgccagtggagttgtgaactcttcacctcgaagtcatagcgccacaaatgggagcattccttcctcatctagtaaaaatgagaagaagcagaaatgcactagcaagagcccaagtacacacaaggacttaatggaaaactgtattcctaataaccagctaagcaaaccagacgcactggtcaggtaagtgcacatgctgcatccttactaacactttccagtaaacttgacatactcttgacatactcccatatgggcctgtagggattgtttgtaatcagatattgtgactagtgacgtgtggtgttttacatgagtttgttggccaccttgtgttattgtgttgaagcattgatttcagctctttgcagtgttctgaataatgagtgacactgattacttcccacatgtgacaaattgacctgtaacttgattcttctagtcgtgttgtaaggcacttctttggtccttgtccttttctgtttgcatgtccagagttctcttggcgtaaacacaaaaagaagagtttgtgcttgttcacgcaaatctctgtcaaacagatatacattgcaggagaggggtgagaaagttgtccttactactttgtgcttgttttgtttttctgtttgtttttctgcacttagaatatgaattatcctagataactctgggaaagttagatttgaaaagcaatctctttcacaaaaatccatgga

SEQ ID NO: 6099 - DNA, 1935 bp, Homo sapiens
tggcagtcaagataaaaaaacagtttctattgtattttgtggaactgtatctgttgtcatttttaaaaaggggggaaaagataacatccaagtctgattagaactgcccatcagtttttcttgtaaatttttagaagacctcacagaactttacagtttatttttctcggccaacacattaaaaccattcttggatttcaagtagccaactttgccttttatgtattcttacatagtttcctcttgaagaaaaaaaaagcagagtttttgtttttcaaccctttatgtttgttttgttttattcttaaataagcaagcaaaacctgcacattggattcacgtgagatgataatgaaaacttttagtttaagagtgaagggttaagtaacctaacagagctttgatgttatagctgcattaaagaaggtgattgtcaatattacagaaaacaaaaatggattgcccctccaaggaccaaacagattcaaggagcatcatttaagctaagaagagacctaagtgatgaaactagctgtaagaatgtaacaggggttgtgtttgaaatatttatattcccatcggtgtgtttagtcctagaaaattgctagcagcagtcttcttcacagtgccttgggaaaagacatttcaagaggaaacttgataattttaaactcttttccccctttaccgtcatctatcctctatctgtatcaagctcactgcggatcctgctgtaaaactggtgggtagctgggctgtccgttaccaccacagctacatcttctgtttctttgaatagaaagcaccacagtgttttgcacttgcctccagtaaagtgccctgggaagggagctgggcagtgtttgtggacgagagactgtaacgatggctaataaaagctgcgggtctaggtttttttttttttgttttgttttttcatttcatttaactgtgctttctccacttttcatcattttgtgtttgatgatttaaaagaagcttgactattcctcagctcttgtgccaaggagggttttttttttttaagactcttaaactcaaaactctgcacaaagatttcagtttcaaatgtgtattatacatgggtagaaaagtgtttgcacaggcaacttttggaagtgtttaagaatcagggtgggggtggcgggagggaccgggtgggggcaatgcaaaattgtatttggaaactaggaaaaattaagaaaccaaataaattggttttgcttccttgccatggattctggaaggacatagttcttctaaaatttcctgttaattggcatgtacgtctcatttaaagcaaattaagtaggacaagcaagtcagtaaaatagaagtattaaaaagaatcatcctttaaatcacagatcttattttgagattaaaaaaaatacttctagctttagccaggtgtgcatgttgctgccattttgcatttttgaatcatcttgtgtaattgtcaccatgaaagtgttactcagaattgtcatagattttctcttctttgtgcaaaaacatggaaaattgtcactgactttgttttgaggtttcccccattttgctgccttttgggacacttcgttaaatactggtcttggctgcattcttttttttttttcctgtggggttcaaaagaataaacattttcttacagataaaactagttttctgcctttttaactttcaggagagcacagcaaggtagattgttctgagtggggcttagccggttgctatcttgttctcatctcggcctgcatcaggtgggggtccccccacacagccgatccctgggtagggggcagacccaggatttgggggagacccatcaggatctcaagttggtttggtttctgtgcataagacatgtccattctcatttgttttctcccttctctggcatctgattagagc

SEQ ID NO: 6100 - DNA, 1088 bp, Homo sapiens
tcccttctctctttctaaggacccaaatttccctgggggcatcctgcttcctgaaagctgttggatttcagtgatttttccccccaccccccagcacaggagagcacccacagccgcagaaggggaatgtgtcctcctgctctgcttcctcagggcccagcaggcgggggtttgagccctggaccccaggctcttagagactaaggggcagctcctgaccaaagacgatacagcttggcactttaaagcattaacagcaggtgtgaccctgagggctcctccatggtgctgcattgagtccagctttccttctgcccttcctccaggagaaggggcccaaggtccccgtggatggtctccacctgtgcttggaaccagtgtaactggctgctccctgctcccagggactgacacggggatcatctctgtgaccgccctccgtcgggcccctgcctgccttctcccctccacgcaaggctgtgctcttcctctggtttctgtgtgtccgtttgagtgtctgcgccccgcctccccatacttcctgggatgatgtgtgaaacctgacacctagatttatttggaaatattctatgaccactttacagatgaggaaacaggcctcaagcgtggaggggtagagtgaagagtagaacccaggtctgatgccaaagctgctttcttctctgcctcctcctcacgcaactcacacctccttttcttctagctttgttgtcctcccaggaaccaaaaaaccccagctattttctgaccaaaatgtgtttcataacaaaccatctggtgcctttccacacagaactggcaggagcctcgtgtcctgctagctgtctctcttgttgatttccgtgaaaatgcaagtgtttgaagtctgctcattccgagggtgaaacaaaatccaaccctgtcagaatcatgctgttctctttgctgacactgtgaccctgggtcgggacagaccagcagcaatctgtctttagaatcgctttccttcctccccttttgcccccgtggggctcccggcatcctgaaagccagcaaagcctccagcatcttttccatcctgaggtgcc

SEQ ID NO: 6101 - DNA, 1249 bp, Homo sapiens
ctctccgtgcagatcaaggcaaaccccaaccgacctggtgtgccctgctctgcctcgccagcagccccagctaccacggaagacactggaagctgctggccagtgggtgtctccacaggcagaggctgacttcctagctagacaccagagcagatcccacctcttccccagtggctgccctttggggccacttctctggacatgcctagtttagaactccacaggggtatgtctcattgcattgagaccctgctttgtccccagtggcactgctcagcctgccagtggggcccacagtgagcattggtgcccctcagagaaggaagccttcctctgggaggtgaatgccagcctcggaagggcaggaaggagggtgcacatcttgaacaccagcagcatccacacgtaccagctagtttaagctgctgcacggcccctgtgcttgcacgtattgttagcccattttagagatgatgataccaaggcctgtggcggttacatgatcagccagcctcacacagctattaggaggcaggcctgggactcagagccagtgtgttccccactgtgctgggtggccctgcctctgcaggtcacttgggacattggcaaatcaggatgaccttgcttgcttaggaacttctgaacccagcccagagtaaccttagccaagtgtccagcacagaggtactggatcagatggtgcgtttgtggccaggacagatgtgggctgtgtcatgaatccttgttgccagacagcaattctgactgcacctgctgagccccagcacggcctgtctcagggtgactgaggcacagctgctcttgaccccctcgcagtccaggggttatagttcatggtgccctggaaagtccccgggcatgagctgggcttgcagtaggccagcgggacattggaagtcagagctgaggtatggcagctggggaagccaggtcaggctcttagaagaggggcatattcctgctgggcatcaaaggaagggtagaatggttggcgactgcatgtgctagcctgggagctccctgaggacatgcctgtctgatttgccccatggcctcagtgcccagcctagcacctggcacagagtggccatcagtgagtcagttcatcaggaggggagaacagcctggctcccatgagagctgtgagaaagggcagccctggctcagcaggcagcgctggagtccctgcagcctgggagtccactttgccggctgtcagaccctt

SEQ ID NO: 6102 - DNA, 1440 bp, Homo sapiens
cgtgtgagccaccatgcccagcctcagtcattttaatatattcacaaattgtgaataatcaccacaatcaattgtagaaaaatttcattactctgaaaagaccccatgcccatgaacagtcactccccatttctcccttcccctagtccctggcgaccactaatctgctttctgctcggatggatttgcttatgctggacatttcctataaatggaatcatactccaggtagcatttgtgcatctggcatctttcactaatcgtagtatctcaagtttcatccatgctgtagcctgcaacagtgcttcattcctttttccatctgaataatattccattgcatggtataccacattctgttgatccattcaatcaatggacatttgggctgtttccactttttggttattacagatagtgccactgtgaacatctgtatccaagtttttgtgtggctgtatgttgttatctttctggggtatgtgtcaggggttcccaagacaccacccctaggttcagtgatgcactaggaagactcataggactcagcccatagttcttgtcatggcgatgatttattacagtgaaaggtttcagagcagatgagcacggtggctcatgcctgtaatcccagcactttgggaagcgaggcgtgcagatcacctgaggtcaggagtttgagaccagcctgaccaacatggagaaaccccttctctactaaaaataaaaaaaaaatctactaaaaaagaaaaaaagcatacctgtaatcccagctactcaagaggctgaggcaggagaatcgcttgaacccggcaggtggaggttgcggtgaactgagatcgcaccattgcactccagcctgggcaacaagagcaatactccgtctcaaaaaaaaaaaaaagaaaagaaaagaaaaagtaaaaaagaaaggttacagagcaaaattagcaaaggaaacagtggatggggacaacccggaggaaaccaggtgcaggcttccaagagttctctcccagtgaagatgtgtaaggtgttatcgaccagggaagctctttagagactcggtgcccaaggtaggcacccccttcctaacaagtaccagcattccacactccagaaggaaagtagctgtttagcataagccacattgtacaaatggtccagacacaggacaccacctttatcagttagagactgataggagcactcgcaaaacccaggttcctagacaccagctgaggacccacctcgcaagcaggcctttctgaggacagacgtctaagacctgctgcattaacttttctgcacaggtccgtacctagaattagaattgttaggtcatatggtaactccatatttaactttttttgccaaactgttctccaaagtggccgcaccgttttcattccaaccagccatgtatgagggttctgatttcag

SEQ ID NO: 6103 - DNA, 1156 bp, Homo sapiens
aggcttttctctgcagccacagcctccttccccaggactagcacccccaccctgctgcccacagttttggggttgcaaggctccagaccttgaccataggcctatcacaaaggccctgagacttgttcccaggcccacccttcttccccaggccactgacagactgtgtcttgcttccctgccctgcgtggggcacaggtatctctatcttctgttctctgaagatgacttgctctccctggaagactgggtgttcaacaccgaggcccacccactcccggtgaaccactcagacagctccggcagagcctggggcagacactgaccccatctcctgccgccgccctggggccgccgcagggatgccttgccttttcaggatttgagactgttctcaaagggattgggaacgaaggccccatctcgggcagacccccagcagatgtgtcggacaagcaacttcttttcctctgtgaggagacaagacttggagactcagcgatgtcaggccagggccatggccacactggcccacacattcctttctacagagaatttctatgaagcccactcacttgccattccagggccaaaggaccggaggtttgcatatccgccccttgtatttgatttgcttccttttggtttcttggtttttgtttttgcttgattttgtcttttctctacagtttagttttgtcacaattacacatatagttttcaaaatcatgcactttctaaaatggtgtcatcctgaaaaacaaaacccagtgtttgcacacacacaaaatcttgaccccgttatctatattttaaatgctttttgcccaacactgaccctatgttcaactttgtgtcatttaccttataatttgaggaggggtttccctttgggcctcagtgttacaaattactagtgctattttcattattattgtaatggaaaaatctgtggactagaataaaagagtttattgaataagaaatatgattgggctcattgcacatcagtgactcctagaaaaaccattgcaatgttaccatcagaaataataatcagccagcagttgatttaaggtataatttagtaaacgattccaacttctattacctcccctgaaatcggtcctgatatattcgagaagcatgaggccag

SEQ ID NO: 6104 - DNA, 4208 bp, Homo sapiens
ttgcccaggctggagtgcagtggcttaattatagctcattgcagccttgacttctggagctcaagtgggctcaagcgattctcccacctcagcctccatagcatctgggactatcgacatgggccaccacacccacctaatcaaaaaaaattttttttgtagagatgggctttccctttgttgcccaggctggtctcaaacttcagggctcaagggatcttcccatgttggcctcccacggtgctgggattataggcatgagccatggtacctggccttgggaaatggtatttagataataatatcttgcctgcaaatacatcttcccctagtgtcagtagactgataggaataaaaaggggaaaaaaaacacaactttcctcatcagccctagtttaatacattaaattgatttgggttttagaaaattatagtacagtttattagaacaggagaatcctggttttctgaattataaatataatcaattctagatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaaggtaaacgaagcaattcacagaaagcaggatattaatttatgtaatgggcagatcaattttatttctataacaggaagaaaacagaattgtagctacactgtgattattacatatgccagtgactggaaggaaataccagtcctcatttattgaactcctgttacatgcccgctcctttgtttatatttttctcctttaatacatggtgttgcctcaaataatggaaattagaaacagtttcaggaatgttaagtcgtttttctgcagtcatacaactagtaagtgttggggtcagaattcaagccctggtctatcttaaaccaaagctcatgcttctctcatgcttcctctttgaaaagatttgttgccagatgattctttggcactttggttttgttttttgagagctgtacaataacattttaaattgctagtgtgattgtgttgctcagctggtatcatggtagcttttctcttatctaaacaattctattataaagtaactatctttaaaagctaatcagaagaatcaataaatattaatatgctagttgtagaaaatttgggaaatacagaaatttataaatggaaattaaaagtattcattatcccgcttccgagaagcaaccagtgttaacattttggtgtgtttctttccattcaatgttactcattaacaactgtacataacttttcatttaactccctttctcaacaaccctgataggattgattttaaagctggggcaagtgaggcacaaaaggtaaggtaataaccttccccagaccagcatagtgatttgtagtatacacacacacccgcccgaagagcctcagtgcttacactaaggagtcgtcttctatgcaatagtgtgagttcatggagtaggaggaagcaatacaaccaaaggttggacagtggaaagctttttagacatcaaccctggccctgtagtcattagcctgtgctttacatagtaactggctaaatataatgaaactcccatcatgactaggatttggcagaagagaatcaatagaaccagtgtcagatgctctgtggttatcctgcaagtcagtggttccaatgtgttttgagaacaagctgttctgttgaaggggtcataccaaggtatggtctggtaattaatgcagtttcctgagacaaaagctaataagccttttccttgaaacaaatttttctgtcttaaatagtaatctacagacttagtcttgaatttcctatcattgttttatcagttatggttaaaatttttacaatgagctagttttctttgggtagcttttgaagttaaatagtgaaattctttacaataaaagtgccactcgcaagtacatattcctcaagtcatccagataccattaagcagtaaatcttacaaggatttccttaaggactaattgggtaagatttctgaacagataagcacttttccaaagttaaatacaaatactagaaaaagaatatcattttcacagtattttatgatagggataattcaggtcctaattttggtgttatttaaagggaccttattttctgccccttttcaatccccttagtaaattatttttattgtaattttaacttatgctgaatacattttattttttgaggcagagtctctgtcacccagggtggagtgcagtggcacgatctcagttcactgcaacctccacctcccgggttcaagcaattcttctgcctcagcctcccaagtaacttagactacaggcacccgccaccacgcccggctaatttttgtatttttagtataggtaggatttcaccatgttggccaggctggtcttgaactcctgacctcaaatgatccacccaccttggcctcccaaagtgctgggattacaggcgtgagccaccacacccagcctgaatacattttagagtgcctagcctattaaacttttttttccagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggttggtttcttactttgtaaaagggttgagcttggagtttgatgcaccaatgagttggcttgaactaagtgctttgataaaaggtgtttggtgtctttttgtcatccattttggggcttaacatattaaatgaaaggtatattttaagatggaatattcagtaattcccagcataattgcacagtccttggaagtccagtaggcagcttgttaggttctacaagggacccaggagatttgatgatgatgtctcagaacttaaattgtgtggttcccacaggctgtaatatatgcactgaggttgtgttgggcctctttgaggtgggggctgggggtcgtgacttgacaggcttttttttttttttttttttttgactgatgacaccttacccttcctttacaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttggtggcagtgacttcttttgagttaggttaataaatcaagccatagagcccctcctggttgatacttgttccagatggggcctttggggctggtagaaatacccaacgcacaaatgaccgcacgttctctgccccgtttcttgccccagtgtggtttgcattgtctccttccacaatgactgctttgtttggatgcctcagcccaggtcagctgttactttctttcagatgtttatttgcaaacaaccattttttgttctgtgtcccttttaaaaggcagattaaaagcacaagcgtgtttctagagaacagttgagagagaatctcaagattctacttggtggtttgcttgctctacgttacaggtggggcatgtcctcatcctttcctgccataaaagctatgacacgagaatcagaatattaataaaactttatgtactgctgtagcaactcctgtgaaatgact

SEQ ID NO: 6105 - DNA, 1112 bp, Homo sapiens
gcccaggctggagtgcaatggcacaatctcagctcactgcaaccttcgcctccagggtgcaagtgattctcctgcctcagcctcctgagtagctgggattataggagcccgccaccacgcccagctaatttttgtatttttagtagagacggggtttcacttggccaggctggtctcttgacctcgtgatccgccctccttggcctgccaaagtgctgggaatacaggcgtgagccactgcgcctggcttagcttcccattttctgttgtgttcactcttcctagggaagaaagggagaagaaataggtgattaactgccctgagctgctcaggggccgatggtggttctccagaggggagaaacacatgtccccacccatacctatactcaggctgcccttgggataacagctttggggcagccagatattctatagcccatgtctctgctaggatcttgtcgcctgcctgttagctggaatggcccctttaagacaaaggactctggataccccttgatcatcttctcccatggcctaggagccttcaggtaagagcttctttcccccagaccttgccatactccttgcctggtgacagctgctgagtcttagcttattctcaaagggcaaaaaaaagacatttccatctgctagctgtcttatctcccatctgcttcgtcccatagcattgggttcaccttccccagaaggcctttttcaagtccttttcaccttgtggagcctttcagcagcctttatatgctttacttctcatggtccagcatttatataaataaacacttttagctttcctcctatgtgatagcccagaaatgctagaaggagcatgagctttgtgatcagagcatcatttatttatctattttatttttatttttttcagacagggtctcattctgttgcccaggctggagtgcagtggtgtgatcacagctcactgcagcctcaacctcttgggctcaagcagtgctcctgcctcagccaccaagtagctggcacgtaccaccacgcctggctatttttaaattttttttttttttttcagggacgagatctcactgtgttgcccatgctgatcttgaattcct

SEQ ID NO: 6106 - DNA, 1234 bp, Homo sapiens
tcttccagctcctgggccagctctggaagggctgtatttgggcctaatcctcagcaaatgttctaccactcgcaggggcaaaggtggtgagccacgggacgtccaaggggaggctggccccagcgcgcccatactgcctgcctcatgccccattctcagcctggctggcctttgcctttatgaatctgagcccctccatctgcctatagcaataggcacgggggtgaggaccctcacactctcatttgagcctccctgaggcagggagccaggaggcacctgaggcctatctgtgccttagtcacttcagctatgagccaaatgttccctttcctggaggggagaggcttcttactaggtaagagacaggtttcctctttccttatttcctcagctgtgccaacacaaaaaacaactttggcacaggtggtgggcagggggtagagagatttcagcttgggttctgcactaacagcctccaagccccctggcacttctgttgccctgagagtgtcccaggggattcagagtctccagaaagatatggctgggccaactctgttgcctacctggcctgacccagtcggagcctgacatggtggagggaaagggagacaagtggggctgcactcggtccagaggccagctaggagggaaaccgcagcttcctggggcttgtgtgtgaagattcctgacttaggggtggcttttgtttacaagatgcaagaggggaaacctgtccccgactcatcgagacaacatgcccagttatcagggagtcctgtgtcacaaggtctgtctctgccattgtaagcaagtgccttgggcgagctggcctctgccccacagtctcatctgtacaccgacagggttgatgcctccctcacagggttgagaacaagagccagttggccaagtacctgtggttgttgaagattggttacttttaccatcctggggacagggaactctgtggcccgaggctgcctcactgaggagtcaggtgggcttcccagcctccccaggggcagtgctgagtttgtcttgactgttctggcccaaggtgggaggaggtgggtttggtcacttgcctcccactttaaatctctgtctttccatctgtgaaatgacctctttgtgccttcccagcactgtcatcctgatcgcctgtgttctaggtaggtgggtccttcagcccctccaggtctgtgaaaagtctgtggaaagcactggc

SEQ ID NO: 6107 - DNA, 1182 bp, Homo sapiens
gtccacctttcttctccatccaatgggatggatccatgttcattcccacttcacaccttggtcctgctgattagagagctcatcagaggggcctggaaaggctgagcaagtaccagtgacaatggccatttaagaattctcaggccccatgtgccagccttcttgggaactgagctggctttctgggttttctcatgcctggtcttactgcttcttcctcagggctcttgttctcccagaagcctcagggtaatgtgttggttagcacgtaactactaggattggggccctagggattatagccaggactctaatctgcctaccatgccatttaacaagagatcccactctccagctgccttgtgtccctagggtcctggccatgtgtttagtgtgctaaactttctcctttgttctcaggccttccaggtagtccccttcctggacttaagagtgcaaactcttctctgtggttctagccttgggcagaattatatcccagagaccacagagcaactgtcaagctgcttaccccctcacccagggctacagcctgtgcccagccctctaatttgtgcctctcttgtgttgggggtggtgggggttattcctttccctttcctgctctggcctccttgaaagttcagagtacccagtacaagtcagctttaaagtacagcttttagtgtttcctgggttgtttctctggggctttagtgagggacctttgccctctggtttttcttgcctcctggtttagggagcatctcacacttgttagtatctggttgttgggccagccgtgcctcctctagatctggagccaggccaggcaggggccacgtgtgggccagtcagccactacaagatttttgctaagctttgggctgttggcagcatcttggacctcatgcctgggcctgaatgaggctctttcttaagtgtttttacaagtttgtgttttatttatggagtgacttatcccttccattcagagcagccccacccagccagcccttcagcctctgggctcctgctgcttaaaggcagagccgcctggttggtctccaccctgtgcattgggagcccagccaccatgctgacgggtatttttcctcataaagtttataaccagttatttatatgaatctttgttatgtccatttgtttgtattgcgtatt

SEQ ID NO: 6108 - DNA, 1235 bp, Homo sapiens
tatccactaacccctacccaccctctgtccccagatcaagtcccagcagagcgaggtgacccgaatcctggatgggaagcgcatccaataccagctagtggacatctcccaggacaacgccctgagggatgagatgcgagccttggcaggcaaccccaaggccaccccaccccagattgtcaacggggaccagtactgtggggtatgggctgggggacgggggggtggggggagtgttggaagaggactctagccagggtcatatctgccacaaagcacttgggccccctgcattcaggtgaccacccctcgcctccccttctccaggactatgagctcttcgtggaggctgtggaacaaaacacgctgcaggagttcctgaagctggcttgagtcaagcctgtccagagttcccctgctggactccatcaccacactccccccagccttcacctggccatgaaggaccttttgaccaactccctgtcattcctaacctaaccttagagtccctcccccaatgcaggccacttctcctccctcctctctaaatgtagtcccctctcctccatctaaaggcaacattccttacccattagtctcagaaattgtcttaagcaacagccccaaatgctggctgcccccagccaagcattggggccgccatcctgcctggcactggctgatgggcacctctgttggttccatcagccagagctctgccaaaggccccgcagtccctctcccaggaggaccctagaggcaattaaatgatgtcctgttccattggcactgtgtctggttggttgtggcctgggcctcctgggtccctgccctgggcaaggttggtagttgtgactgtgctgagactgctctgtgggaagggtggctgagctgttctcttgtgactgtcacctctgtgtttgttagtgcatgtgtttggatatgtctgacacacaaatacctgtatggaccagtggtttctggagatgtctgggtgggccaccctccagttcacatgcatgtgtccatatcatgcttgtgccttggtgtgtagtgcacatctccatgcctgtcagtgagtgtggccatcccatgcgcctgtgttggagcacaatggctaagaatgagtgtatcatgggaggtgggtacccagctgcagttctgctaatttgggggcatgggtctagtggcaaaatggctttgtgcggtgttgaagtgtccccacgagttgg

SEQ ID NO: 6109 - DNA, 1339 bp, Homo sapiens
aggtctagatcatcatgccaaggaatgcaagctgccaccccagcccaagaagtgccacttctgccagagcatcagccatatggtagcctcatgtccgctgaaggcccagcagggccctagtgcacagggaaagccaacctactttcgagaggaagaagaagaaatccacagccctaccctgctcccggaggcacagaattgagccacaatgggtgggggctattcttttgctatcaggaagttttgaggagcaggcagagtggagaaagtgggaatagggtgcattggggctagttggcactgccatgtatctcaggcttgggttcacaccatcaccctttcttccctctaggtggggggaaagggtgagtcaaaggaactccaaccatgctctgtccaaatgcaagtgagggttctgggggcaaccaggaggggggaatcaccctacaacctgcatactttgagtctccatccccagaatttccagcttttgaaagtggcctggatagggaagttgttttccttttaaagaaggatatataataattcccatgccagagtgaaatgattaagtataagaccagattcatggagccaagccactacattctgtggaaggagatctctcaggagtaagcattgtttttttttcacatcttgtatcctcatacccacttttgggatagggtgctggcagctgtcccaagcaatgggtaatgatgatggcaaaaagggtgtttgggggaacagctgcagacctgctgctctatgctcacccccgccccattctgggccaatgtgattttatttatttgctcccttggatactgcaccttgggtcccactttctccaggatgccaactgcactagctgtgtgcgaatgacgtatcttgtgcattttaactttttttccttaatataaatattctggttttgtatttttgtatattttaatctaaggccctcatttcctgcactgtgttctcaggtacatgagcaatctcagggatagccagcagcagctccaggtctgcgcagcaggaattactttttgttgtttttgccaccgtggagagcaactatttggagtgcacagcctattgaactacctcatttttgccaataagagctggcttttctgccatagtgtcctcttgaaaccccctctgccttgaaaatgttttatgggagactaggttttaactgggtggccccatgacttgattgccttctactggaagattgggaattagtctaaacaggaaatggtggtacacagaggctaggagaggctgggcccggtgaaaaggccagagagcaagccaagattaggtgagg

SEQ ID NO: 6110 - DNA, 1154 bp, Homo sapiens
caaagtgctgggattacaggcatgagccaccatgctgggccaaccatttcttggtgtattcatgccaaacacttaagacactgctgtagcccaggcgcggtggctcacacctgtaatcccagcactttggaaggctgaggcgggcggatcacaaggtcacgagttcaaaactatcctggccaacacagtgaaaccccgtctctactaaaatacaaaaaaattagccgggtgtggtggtgcatgcctttagtcctagctattcaggaggctgaggcaggggaatcgcttgaacccgagaggcagaggttgcagtgagctgagatcgcaccactgcactccagcctggttacagagcaagactctgtctcaaacaaaacaaaacaaaacaaaaacacactactgtattttggatggatcaaacctccttaattttaatttctaatcctaaagtaaagagatgcaattgggggccttccatgtagaaagtggggtcaggaggccaagaaagggaatatgaatgtatatccaagtcactcaggaacttttatgcaggtgctagaaactttatgtcaaagtggccacaagattgtttaataggagacgaacgaatgtaactccatgtttactgctaaaaaccaaagctttgtgtaaaatcttgaatttatggggcgggagggtaggaaagcctgtacctgtctgtttttttcctgatccttttccctcattcctgaactgcaggagactgagcccctttgggctttggtgaccccatcactggggtgtgtttatttgatggttgattttgctgtactgggtacttcctttcccattttctaatcattttttaacacaagctgactcttcccttcccttctcctttccctgggaaaatacaatgaataaataaagacttattggtacgcaaactgtcatccccttgtcagatgtttttgcccttccgataactcccactttcttggattgggactcagaagtttttctgttcagccagtttgttaggaatgaatcttgaaagttcagtcctcttagcacctcattacagtggatttttgtttctagttaaggcctcttgtcctttccttggaagcttccacattcaagaggggattaggggcttggcatgcataagaatg

SEQ ID NO: 6111 - DNA, 1219 bp, Homo sapiens
gagcccttagaccttgtgaagatgattcctggcagggcgtggggggaccttggtgcctgcctcccttcttatgccccttccggtaggaagggctgggcccttggggagtttggcttctgccagcccagactccccagacaacccagctccttctctctcagaagcagctcctgacctcccttgagggctctgtggctccagtccctaagcgtgcagaaggccacctcttcctgtgccttttgaccccagggtcaaggtcaagcccctgaatgagctggtggaaaacttcctccttaacctcttgctgggaaggaagcaggtgatattctccttcccaggtggttgttgggggtatgcagggagggaatggagacctcatttgagcccaggagctgagatgactttctcccagcttgggcctggagcccctgtctcagtcccctcctctgccctctcttacctagggcagccaccaagtgtcctgcctctcaggaccacaggcttagatcagggtgagcacccagggtccccagcccccagggtgtgctgcccctttaaagggatggccgacactggctattggagggtgggcgcggcaggattaggtaaccaacctgaaggagcaatttggagtaaattgctctgggattcctgccatggggattttacaggcactgctaggctgctcagaggttctctcgctgactcaccctctgaggtgaggaacactgccctctgcagcccctgtactgccaccccgctactaggaccggggcgcaaggtcctgggggtggtgctcagaggtggattcctttgcccaggcacgcccctgggaccaggcctccaaaggagaaggtagggctgggagaggctggggagtgactttatgctgatagggagggtggacacccaggagctcgatcctggggcaccacttcctgcttctctttagggaatcctgaggcaggggccagcttcaccagggagccaggtttaactgggaaactcatctcagttttgagttctgtaacatctcaggtctgtgagaggggaagaccagcggacttcctgggattggtggggcagggggacgcaatttcctcaggagcttcgctccagaaacgatgtgtgatcctcagtcagtcctcagcctgtctgggcctctgcttctccagtggcaagtgctaggttctagcctccacttcctgggcctgagagg

SEQ ID NO: 6112 - DNA, 1223 bp, Homo sapiens
aggcctaagctgagtcaaagaacctgctgagaatcagaactgcccaataacttgtattatttaaaaaaataaataaataatatgaagggtgcccacccagacccatagatcgggattttaggcccagggatccagctcaccaggtagccgttcttaccagccccgagaccagaatttgggaatttttatgccagatggaaagcagagctggtgaaggcatgccagggggaggtgcagaggcaaagtctgaggatctgacaaagcagagaaccctgggggagcaggttgctcagactggctgattaacaggtcttgatggggtctggtgggaaaagggaccagagagatgggcagggtgccaaggccccagctgtgggcactgctgtgaggggtggggacaaggagccagccaaggagccagaaacagactggcaaggaggaaacctgaggattgagtgtccccaaagccctgggtgagggggctttgggagctcaggcctggaggaacaagtggaaaagagatcccttagcgggggcttgggagtggctgtgttgagtgtctaggctactggtgacttcctttctcgtctggccagtacgtgaccgcgtccggaccaagatggagagagacatcctggctgatgtaaatcacccattcgtggtgaagctgcactatggtaaagcttctggccctgcctgagctcctaccccacccatccttcgcccttgcctgtggtctgtacactgtcccaccgcctgcctggcaggccaagggagccagggccggagaagcagatcataaggccgcgccgactctaccattgcctttctccctcttcccagccttccagaccgagggcaagctctatctcattctggacttcctgcgtggtggggacctcttcacccggctctcaaaagaggtgagctgacatctactgccagagggccccgggatggagctgagggacgacaagtcctcccatcccagggccctgtacagaatgtgtttggtatggcttgaacctggaaccacccaggcctgcctagcagcccctggcccaggaaataccacgcaccctggaatggaggccatacgctggcaaggtctctgagagtttctcccaaggaaactccagggagctaagggttcctctcacctctgcacctgccttcttccagggctgctctgggcagaggtgtgaagataggggagaagccca

SEQ ID NO: 6113 - DNA, 1560 bp, Homo sapiens
agaccagcctgaccaagatggtgaaaccccatctctactaaaaatacaaaaattagccaggtgtggtggcaagcgcctgtaatcccagccatttgggaggctgagacaggagaatcgcttgaaccctgggggcagaggttgcagtgagccaagattgtgccattgcgttccagcctgggtgacagagtgagactgtatctcaaaaaaaaaaaaacaacaaaaacaaaaccaaaaaaagtgggctgtggaacactgagaggggctggcctacccttggggcatggatcccctccccgctacatctcccaccattgtgacctgacctccccacttctctttcagggagccatggctgccacgtactccgcactcaacagctccaagcccaccccccagctgaagcccatcgagtcatccatcctggcccagcggcgagtgaggaagttgccatccaccaccctgtgaggcaccagggcattcgggccacagggcggtgctagcttgacacagtcagcatgcttcccagagggagcaggccggaaccacagggccagagggagctggaacccgaggggccggggaagctgccagcccagaacacccctaatgagggtgtgagaagtgccttctccttccccaggatggactcttctcggctcaggctctgctggtggaaagcgattcactgtataaacttttttttatgaaaaaaatggcatcaaccaccatggatttttacaagatccatttgcctttctgggagcagaaacagccattgcggccccaggaggggaactgagtcacgctggggctctctgagactctttagagcagctttgggatcccaccctggggacccccacgattggccacctgtagccatctgcacacacctccgagacagtccagtgtcacctctctcagagcatctggctgtttagcagaactcattctatccccaatcagctccttttccgttctgttctgctgggagttctagaaccacttcctgctacaggaggggtctcatgtcctgctggcttccagcttcaggcaccagcatccaccttggctctgccagtggatcccctgcggtcaggctgggcagccccagagagaggatgtggaaagcactttttggctgacttcatctggggttggcaacaggacagagttcacaggaggccagtgggcgggccatgagggacagggtcttttttcatttcttcctcagctggttactcagggttcatctgtccatggcctttctaataaactgttgagttgaagcacgctctcctgcactcttcatccctgaatttaccctctctctgctatcggatgttgaagacattggcagtgacagaaaatgggccagggccagttagcccagctgcttggaaccaggtcatctggggagtgtgtgggaatcccgctggcctggcccacgtgttcctgccaggggattccattatggtattgataacagtattattagccaatggtgaccaagtgccaggcactatgcctgggcctcacatgaatatctcatttaatctt

SEQ ID NO: 6114 - DNA, 1144 bp, Homo sapiens
aaggtctaatatatattccacctggtccttaacagagtttgccatatgtaagttatagtatgatgactagggccgggcgcggtggctcacgcctataatcccagcactttgggaggccaaggagggtggatcacctgaggtcgggagttcaagaccagcctgaccaacatggagaaaacccgtctctactaaaaatacaaaaatttagccgggcgtggtggtgcttgcctgtaatcccagccactcgggaggctgaggcaggagaattgcttgaacccaggagtcagaggttgcgatgagccgagacgtgccattgcactccagcctgggcaacgagtgaaacactgtctcaaaaaaaaaaatttttttttttaataaaaatagtatcatgactaaagaacgtgtgtgatgtatttgctcttggttgtttaaggaaaatgctaagcaagtagtaggattattgaaagtagaatctttctgcctaatattactaatccatgttcttatatatatgttctaggatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggtaccctcaagtgctgggctttagggagagggaaaggtgactgcccccagtaatattaaggagccctagtcttccactggcagagaaagcatctctggctcatgcctgcatagtttccccttagcatttggagaaggagattggaacctgttggctggatctctttgtgtgtgatactgggaggtacttggcctcttcatgagccatttctagctctgaattaacttcctagttagaattcccaggcttagccatgatatgcttatgttgttctttgtctggagcaggcaaccagatgccacctcggccacccagtggccagtcggacagcatcatgcatccttccatgaaccaatcaagcattgcccaagatcgaggtgaga

SEQ ID NO: 6115 - DNA, 1144 bp, Homo sapiens
gaaccaatttccattccagtttggccgagaccgtgtctctgcaccccctggcaccaatgcccagcaaaacatgccaccacaaatgatgggcggccccatacaggcatcagctgaggttgctcagcaaggcaccatgtggcaggggcgtaatgacatgacctataattatgccaacaggcagagcacgggctctgccccccagggccccgcctatcatggcgtgaaccgaacagatgaaatgctgcacacagatcagagggccaaccacgaaggctcgtggccttcccatggcacacgccagcccccatatggtccctctgcccctgtgccccccatgacaaggccccctccatctaactaccagcccccaccaagcatgcagaatcacattcctcaggtatccagccctgctcccctgccccggccaatggagaaccgcacctctcctagcaagtctccattcctgcactctgggatgaaaatgcagaaggcaggtcccccagtacctgcctcgcacatagcacctgcccctgtgcagccccccatgattcggcgggatatcaccttcccacctggctctgttgaagccacacagcctgtgttgaagcagaggaggcggctcacaatgaaagacattggtaaggagatcttcctcattcggttgcctaatctgcccctttccatcttgtccattgttccctccaccttactattctggatgaggttgaatctggtccagtgttgactaaaatagaaccaaagaactttggaaaaggaagaaataagctaactaaaggttctccttcattgccatgcaatgaagtcctagacagacagcttagaagccatgaggggctggtgtgtttcatctcccagacagaaactgccttccaccttgtgttatcttcagagtagcttcactgatggggcagccctaggggtgcctccagccaacctgggcttggtggatagacgacatggaggtttatttcaggaaccccggaggcatggcgggtaatgatgtccctcaagtctggtctcctggcagagagcacatgggcattagataccatcaacatcctgctgtatgatgacaacagcatcatgaccttcaacctcagtcaggtgagtatcagtgcctggg

SEQ ID NO: 6116 - DNA, 1623 bp, Homo sapiens
cgtgaaggtaggttgggcagaagaaagaactttgtgttgggcatagaagagattaagatgaacaatttgctctgtggagaacctttgggaaaggagcaactctgcctctcccaactgatacagaagacttggggaggtctctcaagtcaataattctgttcttaggccacttttctcccttaatttatttcctgttctttctctttttagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagc

SEQ ID NO: 6117 - DNA, 1463 bp, Homo sapiens
cggtatcaccgttgatgaactcattggtttcacaagtcatttgtgatgtactgtttttgattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgcatcaacgggatgccacatttcataactgtttttaatggtaaaaaaaaaaaaaaaaaatacaaaaaaaaattctgaaggacaaaaaaggtgactgctgaactgtgtgtggtttattgttgtacattcacaatcttgcaggagccaagaagttcgcagttgtgaacagaccctgttcactggagaggcctgtgcagtagagtgtagaccctttcatgtactgtactgtacacctgatactgtaaacatactgtaataataatgtctcacatggaaacagaaaacgctgggtcagcagcaagctgtagtttttaaaaatgtttttagttaaacgttgaggagaaaaaaaaaaaaggcttttcccccaaagtatcatgtgtgaacctacaacaccctgacctctttctctcctccttgattgtatgaataaccctgagatcacctcttagaactggttttaacctttagctgcagcggctacgctgccacgtgtgtatatatatgacgttgtacattgcacatacccttggatccccacagtttggtcctcctcccagctacccctttatagtatgacgagttaacaagttggtgacctgcacaaagcgagacacagctatttaatctcttgccagatatcgcccctcttggtgcgatgctgtacaggtctctgtaaaaagtccttgctgtctcagcagccaatcaacttatagtttatttttttctgggtttttgttttgttttgttttctttctaatcgaggtgtgaaaaagttctaggttcagttgaagttctgatgaagaaacacaattgagattttttcagtgataaaatctgcatatttgtatttcaacaatgtagctaaaacttgatgtaaattcctcctttttttccttttttggcttaatgaatatcatttattcagtatgaaatctttatactatatgttccacgtgttaagaataaatgtacattaaatcttggtaagacttttgtgaagctttttattgttttcaaactaaaacttg

SEQ ID NO: 6118 - DNA, 1144 bp, Homo sapiens
gcaattccctgtttacatgtcttgttttccccactagaccataagccacaagggggagggactcttgtcttatccgtcgtcattattcctgctgcttattgaaggtgttgcctgccacagagaagacctcagtaaatatttgtggactgagtgagtgaatgaatgagtgaatgaacactgcaggatggtttgtctcaggtgacagtccactagtgtctgcctgaagctctgtgtgtagagggattctctggatgcagaggttaggagtgctgggatctattggacacatctgccatgtgctctggaggaaagtatatcacaaggatcaattagtgatgtctgttcccggtacttattggggagtggctgcactcatcaaggagctgtgcctctgcctcagagcgaggctgtattcaagattttggtggtggttgttggaatgacagcgcctgccacgtgctgtagccctgtgccgcagggagcccttggggtgtctgctgatctctctccatctctcgttctagctgtccctacctggctcgcaagctgacccttgccatccccatcatcgctgccatcctcttcttcttcgtcatgagctgcctgctgcagacaagcttcaccgaccctgggatcctgccccgggccactgtctgtgaagcagccgccctggagaaacagatcggtgaggtttctactcccagctgaagctgggtctccatagctccacattccctgacttgggaggaggcctggttttctcttccaaaactatactaggaactggggatgcagtcgtgagcaaggcaggctggagctgacactggcacagagggagacagatgatcaacaagtgagcaaataagtaagcaagaaatgctggccagccagcaaaggccccgatggcagccagcgtggagctgagtagttcctgggggctaggcactgttttaagctctttatatgcatgatcttatttaatcccccagtaatcctatgaggtaggtactgttgtcattctccttttactgattaattaaatcaaggcaaaagagggtccaagatcacaaagtaagtagaagagctgagatgagacctcagtctagagcacctgctcttaaacattcatatacacttattcatt

SEQ ID NO: 6119 - DNA, 2490 bp, Homo sapiens
cttgggcccccagatgggcagcagctctcctttcctcagcctttctcagcctgggcctttccttggctgagatagactctgccgtccaacccctggcctagagcctcagtgttgggcagagccctcatgtgtctcccttgtgttttggaagcctaattgaccggaggggatttgtgcagtccgacaccgtgttgccctcacccatcagaagcgatgagccagcctgcagagccaagcctgatgccagcatggtaggaggccacccctgaccacggctcagtacttgccacctgctggcctgtctgaccctccgcactcacctgccgggaccctccctattccatccaagggaagcagaactgccaaagactcaagtcttttcatatttatttcccatcctgcgtggctttccctgaactgttccgtggctgtgccctctgctccccaaacccaggttcccacagccttgggccctaggtaccccagctgatcagtgccaggagagaccagagcctctggaggctacccaggggaccacaccaagtccttgcctgtgccgggcgagccctgtgtgagtgaggctgtgaactgagcgtgaggcctcccaggtgggggaactgcttgggccttgctgagccagggtcctcagggtgaagcaggactgaggagtggccagctctggatagctggctgtggagaggaagcctccatgggctgctttggtctgtgggctccttcattcccttggtgataatttccctttattctgtgggatttttggtggggttttccccccttttttatggagttggccaataggattgagttggggctccagtagagaaggcagggttggtggtgggtgggggcagcctgtatcagacaaaggtaaatcagccagccaggcacccacagcctcagctcctgtgcagttcctgggcagcacagtggaagtgggagcctggtccttcccctgcccatggagagctctttaagggatcccagcctgcccctccacttctctcccaagccaggtcccggcatgggtgggttatgctcatgctggcaatacttgaaacgggtttattaatgctgggtattttgcacaattttatagacctcttttctacatagtcttttttaaatggaaggagaaaatgtcagccacattactgtctgtgtagtgccaggtgaagggttatcagaaggctggttggttttaataagtttattccaagagaccttctggctggaatgagtgagagtgtgtgtgcatgtgtgtgtgtgttcatgtgtgccctgtatgaatgtggctggctcccatatcccctgggctgccccctgccccatcccctttgagtgtcagaagcactctgagccaaggggacagggggcacgtgcactggtcacgagaaaaccctgggctcccactggggctcagcccagcctcctatctttccttcttctatggacttcagacagccagtgtctggggactctgccactctacccccagccctacccaccagcccccaggtgaggcttccagctgggacctgcccagacaggctgagcctgggcgtggtgggtggggtgatggctctggggagcggctgccatcctacaagccacaccccctcctctgagctctgaatatgggacccagtgccaggagctggaagacaaggtgtttctgccaaacggggacctccatccagagaaaaggaagaaggtgcagggtgggccaagaggcaagtgaaggttggcctgagtctgggccggaaactcagaggatgtttctcctctgctgggagctgtagtttcttatcaaaatagatattgttccaccatccccctccttggcccttcaagtgggctgaagcccttggaaagtgacataggaagtccccagatcttgcccttctcactccagaggctagtggtcacagacagctgggaatggcagccacagagggtcccctctgggagaaacagcttcaccccagcctcagggccctgggccatcactgcagtggccctgggaggtgaggaagaagctggctagaggagggggctcccacctaccttttatttaagccagtattctttgttcctgcttgtaataaaacttcagtttataagagttgctttgctttggtttggtttttgtttgcttttcctttgctgaggccccaactgggagccctctgttctttcagacaaatttggttctttcctggggagactgtgagaaggcaggcagcccagtgatctggctacattttccctcacctggctggagctctgtccgctggaggaagagcagagagggctgcggctgagcccccatgggcacgtgaaaagaggccatcctgtcccctctttgtcccctccaccttcccctgcctcaggggcttggagacccccaaattcttcttccctactgcctttccactccgatccccaatgagtgcccagctaagaaaatgt

SEQ ID NO: 6120 - DNA, 1398 bp, Homo sapiens
ctcatcctcctcctcattcagaccaatcttagtttctaaccaaagagtctctggctcagctgtggtcccacccaggaagggagggagctgaggcctcccttgagtaggccctgctttatcaggggacaaaccaggggtaccaggcacatggctgggggagggactgctgacccaccaaggtctcacactcctcctgccagctctgtcaccctggccaccacccaacctgtccttactcagagctgcgggctgagggcatctctgagtgtctctgcctggagcaggggtggtttctacggtgacagtgacgtgactcagagcttttcgaactgtgctcccacggggaccactgggcccctcaggggaagctgctaggggaaggactggccgtggctccagaatgtgctgcctttttaagttttgtttgttcacactcctatatatgattgtttgcacagagggcgctcctgtttttaaaacattttgaaaacccctggctgaacagtgctctgcctctaactccctcctcacactccagaattacccttcctcatctgtgcctgtctgtccaacccctcccccacgtctctctgcctgctgggctcttaactgttgctcgaagactgtgacatcagaagtaactcccactcctaatcaagagtctctccagcctcacagatgctggcctcttggcacctgcctagctcttgggcctgacctccagtcctgctggcctgctcttacttcccccaccctgggtttggcccctggaacctttcccttgtgtgtaccacaccctgcctgctgtggagcccattgtggaggcggtgggggggagaaggcctcccctgaggatcccctgtcccctggggctggtggattgggcagaatcctgggcccccagagacctttgcccacacacactccttccccttgtccctggggcactcccccaggattgtgcaatagtcagagtgtccctttttgcaggggactgggccatgggtcctcggcccatctgtccatcctcctctccatgcaagtgctgtttgggcaggagtcaccatgcaagggtgacatcgacaaccacgtaccaagccaccgcagctgctgccactctgctgcctgtacagaagaaactgaatctttttcatattctaataaatcaatgtgagtttttaatagagtcaagggctgctttctggggacgagggtctttaggagggagggtggcctgagggcgtgaagtacttagttcaaaggctggcacagaaacacttcatggctgtcagctgctggggtggttgttcccacatgccaggcactgagataccacaatgagctaagcaggacgtgccctgccccgcgggggagagcggcactaaccagtgcccagtg

SEQ ID NO: 6121 - DNA, 1396 bp, Homo sapiens
tgcaacttctacctcctgtgttcaagcaattctcctgtctcagcctcccaagtagctgggaatacaagcacccaccaccacgcctggccaatttttatatttttagtagagacagggtttcaccatattggtcaggctggtcttgaattcctgacctcaggtgatccacccacctcggcctcccaaagtgctgggattacaggcgtgagctaccgtgcccagccagcagtgtgaactttgacttgtcaccgtactagcactgcccagattcctacctgagagtaggaagggctttgggcatggagagggaagttcctcctctgtcccaaggatctcaagagtaagtaatgagagcagaggcctggccaggcatgcaggttatcggaaatcttgggtgatgtcccagccctgtgtattttcaagtcagctgatatttgttgagcacttcttgtgtcctagccctgggtgtataatgataagcagttatgggatctgcctgcacagagcttgcaagatagggaaggggaggagagagagctttgctttcttctttcttttttttttttgaggctgggctcaagtgatcttcctgcctcggccctcctaactagctgagactacaggtgcataccatgcccagctattttttttaagtggagatgaggtctcctatgttgtacaagctggtgtcaaattattggcctcaagtgttcctcccacctcagcctcctaaaatgctgggatacaggcatgagccaccatgccaggccagagagagctttcctcttgagcaaagggacaaaccctcttggctatgccaaccctgggagcatagtacccaacatacaactagatgctcagatttttttccacctactttcccaccccaaaacaaaacaaacaagtaaaccactcacaggagctcagggttctctggccatacctgatattgagagaggccctctcaacggggatttttgctactcctcagctctgggtttgaagccttaaggtggactacagcagagcggcctgttgctggccaggacacggcctggggagatggctggtgggtcccaggcagaggggtgtgtgaggaggccttgatgggagggaaggataggagagcttgaattacagaactgtgcagtttgatgggaactggggcatcagacctgtgttctattctagttctgctccccacttgctgtgtgactttgggcaagtcccttcccttttctgagccttagttgccccatctttaaagtgggtggcattgagctagaagcgggatagcaaatagattttatctcacctgccaaagctggttgccactgacatccttgagccgtgtcttgagcagctgcctggactcagtaggaaagcctactgtttt

SEQ ID NO: 6122 - DNA, 1205 bp, Homo sapiens
aggagtttaactgagctcgctgggagcgacactcacagaatgatgccttaggcgccagccagtgtttaagtggtgctgccttggccacctccctcggcttggctctaatggagggtctgcaagggcatcttctctgggccgggtggggtctctctgggaagatctggatctgtttggtctgccctcaatttgtgtaagtaaaagtaagataccagagcttccttggggagctgccgagagccctaattgaattaagcttttcctgggaagattcctcaagccgtaaactgcactgtgactgtgaattaatgagaccagtggctttaaaccatacaagaaggcaatcttgttaatttatagttgtacctggacagatttacttatggcttctctttgctttaatgtgtgttgggaatgggtgggctgggccagaatctcctttctatggcagatttatttttataatatgaataaataaaacatgtcaatggtaaaaacaaaacaacaaaaataaaacccaacagtacagagggtattgaggtgaaagggaaaagtccccctcattacttctctgaccacccccactgtcatacattccagaggttaccactgttaactgtcttgtccatcttttttagaaattctccatgtatatattgagtatgtgagtgtgtgtgcatgcaaggcaaatttagttttcataaagccattgcataaaggaaacgagctctaggctggtaactggggacctgggtcttagtcctagctcgcctctttcctgcatattgacctttgctaagctatgtttgccttcctgggccttagtttccctatctgtcgatttcatcttgaagggctctctggggctgtcctgtgggaaaggcggtcattccagggaagcctctgttccgttgaggcctaagcagactgtgaggccctcagatggggaattccacagctctatcctttgggagtgggccagtgctgtcattgagccctggcttcaaagcacagggctttgtacaagtacagatcacggtcatctctaagtccagctgagggttacaaggttgaagaaatgagcccacagggagtcagctttcttgctggggaagtgagacaacatacaagggagaaagcacaggtgggaaattgtgtggttcaggctggatgcttgggggaatcagaggagaggagagatgagg

SEQ ID NO: 6123 - DNA, 1559 bp, Homo sapiens
ttttttttgccagtctttgtcagaaaatatatttattattgatagtgagtgaagtaaagatgtgagtattcactatagaggttatatcagccaaggttgccttcatattgataaaaataccttatctcacttgtaatcataaacattattccagtagaagaggtacattttctctcctttttgtcttcttgcctgtataatcaccataataagttacaatgaaatagcttttatataatcaaaggagaaaagaaagagagacaaaaccaacatgccacagcctagacaattccatccagcactgctgcctccagatctgttttctggctttctccacccagcactgctgcctccagatctatgttttgtggctctctcctcaccctactccaattaatttagcccccgaccccatctactttgttagggtggaggttcaccaaatgatggggcttgttcagaagagaaacattttatggtcagtggaagttgagtagaaagtaccaaaatgtggagagggctgcccttctcttttaatcatcataagagggtttgctaatactgaagagtgtcctttaatgactgatccctgatcaaggctttggcccttcaaattgctgctgttcaaaatgtgaaatgattctgctgaatccattcttggtgtctctctttagtggtcttctcattagtggtcttctcttcaaatgggttgttttctcactaggaaaaacaatgttccatctctggaattaacgttgatggtgttttgctcattctgaaagtttttatcctcccttctcaagcatggccactctgggtggccagagtggagcatttgaaggtctggtgggtgttctcacggtaacactgaagaattttggcctgcagatcagcacagactggatgagactcataccgcttgaactttgcttccacctcttcagcagctttctgatattgttcagtggtgactctgaagaactctgagttcctcttctccagtctagccagctgttcgttgtagaatgcatcctgcttctttagcactcggtctttctcttccagctgcctagccaggtgctttgccttagcgcgttcctcctcgctagatatcctctcccgaaggatggctctggttaactgctcattggcagcaaccctctctcggtccagctctttggctgctttagtcgtttctcatcttcagattctttcttggcttgctccaatgccagctcctcagctactcttcttttcaattcttcatcagaaactgaggcaccataagcaccagaataccgctgagacttcgaaccagatggagaggattccttcattcgatcaatcacattttctgaaagccggatgcccttcaccacggtaatgttctcattctcgtccgcctcgaaggtgacccggcgggtgctggtggtcccacccatggctccggttcctgccccagcggagacctagcgcggaaccacgagcacttcggggcccccgcgcccacacgcgcatggaagggcctggattcttttcccgcacggcgggagcaaggc

SEQ ID NO: 6124 - DNA, 1208 bp, Homo sapiens
ctacgaggatgttaaagaaggatttctttattaggttgggtcttggacacggtcaccattacatttcctttacactgtttaattctgtgaatctactggagacttgagagttctgtctgtgatactgatttggtttcggggagagccaagctgaggatcagagatttgaagcataactaaaagttcagacgagctgccacagatgcctactgagcaagtgaaacttgatgtctttctagctttgccttgttctaactttaaggatatgctaccattatccttcatacttatacacaacctgccattttccgatgaagcataacatatttcttccgtgtttgttccaatgcttgttgggatgtgctactgttctccccacccacttcacccattccagaggtttttcaacactatggagcagggccagcccaccatgccacaaatgacaggcaagggccacttcactgggtgggctgttttaggggtggaattaggtcttgggagtcactttattatccatcctccaaagtttgatgatttttttcccccaggtaattaaatgtgtattttgtggacctgggcttggctggaatgctcaggggtcctgaagatcctattatagcttccttctgttgaaccattaagaaaagatggcgaaagtcaacataactagagacctcatccgtaggcagatcaaggtaagcagcccagacttctgcaccagatcatgagatcttttctttcccacagattgattttacagatgaaaaaactgaaatctatagtctgtgacttgcctaaagtcacgtagctagttagtggcagacccaggactagaatcaaggtctctttctctccatcttgtattgtctaagaacatggatttcatggagactctgtccacatacttgtgcctgggctgctgagattaatgcaggctggcaagggaggggagctgtcaatgtgttgtgcagatacatacacatccttgtgttgggcaggtggtgcacaagagcaaatataacttcttcatgttgctccagctgccaagttgtatatgtaagagatcctgggagagtattagtcccagttcagcttgtattctctttgaggctctcctgtgctaaagcctgtcctctgcagtttgtatgtagaagacactctgatacctgtgagataaatggatgactgggcagtcaagttcagtt

SEQ ID NO: 6125 - DNA, 2967 bp, Homo sapiens
acaaaagtcaagtggtatgtctgattcccaagataatttgctgtgacttttaaagagaggacccctataggcttccccattgagaggagaggagaaagaaagatgaagcaagagttgtggcaacaaaacagaatggggtggggaagttgtatctgccccttgtcccaggtatcccagtatgtgtgtccaacatatcctggtgtgtactgtcccccacgtatatcccagcatgttatgacctgcctgtatatcctgaggtggcgtatctcccatatatattccagcgtgagcacccccaacaatatgtagccaaggttgtgtgttcccctccaccatatacacctcctggcatgtatgtgtacctccccctatagatagtttagtctgtgtatttccctccccctcccctatacgtgtaccctggtgcctctccctccctgagccccacgtgtgtcacccctttctccaccacagagtgaagacctcacaggccgagtcgtggaagatatggagggtgcttcacaggccaaccagcggcgcatgaatgcagacccgttggaggtgatgctgctcaacatgggctaccggatcacgggcctgagcagtgggggtgccggggcctctgatgatgaggacagctctgagggccaggtgcagtgccggcccagctagaccctccagccctggtccccagcccctgctactggctggaccctctgccctgggcaggaggtcaggggattctgttttggtttgtcttccccaccacccttttttttcatttcccctgttttgtttgttagtttggcgttaggggtggaggttgctacaacttgctggctttcggactctgggctgattgtcccctgactatccccagccctgaaaaaaagagcaggaggggacacccctccatatgcccccccccatctcctgctttcatgtccctggagggctctggcctgcctcaaaaccccttctgcctcaggtggggaggaacaagctgaactgtcttcagggactgtcctgccctttagctggcagcagcaggaggagtgggattcccaattggtaagggctcgccttggcctgttgccactcttgctccctagcctgcaaggctagctcccctgtggtcttcaggaaaggttttgaaaaaggatgggtcccaccctccctccagagccaccagtgttagagcggagcccaaaggaaggatgggagccctggagtgggcaagaccaggccacctgctgaggtcgctgtggagcaccctcgctcctctcctggctactagctctggccctgcacctactctcactggccacctctggaggctctgcctttcccaagggccctggcagagggtggggcactgcaccttaccccacccatccatgccagcacttctgcactacggccattctcctcttgggcgctcctcagcctcactgtgacctttctgccagagctcccagccaggcctactctgctgaggtggcgcttcctgctaagggcccttctctgccctttctgccctccttcccatcccacatgctgagccgccacaaagaccaaagaagtgatggcttttctctgtcccctgctgctctgaggggagaggggtgggtctcctgagccactcagatgggaaagtcccttactcggcccctccctccccagcagccccaagctttacactggatgcagcgatcaacccaccactcaccaggcctctcctcccctctgcccccggctcttagctccagctgctccaggtagttggttcatccttccccctctctccctccctgcttccccttcagtgcttacttggctccagccctccagctgcagcccctggggaaaagcagcctcccttctcctctccctccactccctcgctccctccctcagcccctgtctctgccaggtgcctcctctcagtcaggcttcagagcagccctggagacaggagggccatgttaaaagctttttcacagttttaagaagacaagtggagggtgaggatagtggtggggggtctggcaccatctcattgctttaatcccagcaacacaggtggcagcttctcccccttccttcccaccccagtccctcttcccacccctctcttctagcttggtaatgaagtatatttattggtgaaggaaacagctgctgctgcttctcctgctgctgggacctgctcccctgtctcttctccgtgacctttctctagccagggagaagggagagcaggagtattggggctgggccctggggcccaaggaccagctgggtcccctttgctttcttgtgttccagccacctgccatttcctccctgcctcccaccctccctccctgccccctgtcctgcttcccaccccctgcctgcccagcctgggccctgcagtgtggagagacacataagccttactgtcctctgggggcaggagccgagcctttttgttgctccgctcccaggagagtgagggtgacgcaattgattaaaaccattttgttctaggtgtggctggtggcatttgtggggtgcagatgggtcttggaaccaaagtgagggcacctggtccctcacctctgtagctctatgacttagtaaccacacctctactggacagaatgaggcctgccttgaagggtcaccgtgagcagcggccacccagcccagcagggctgagtgcagagcccagctctcatggctgtgatttgtaatcatcagctttcactctctggctgttttctcatcagtaaaataagggacttggaatcttagtggtttttcaaaccattttacattgtgacccaatatacacatgattacttgtagatatgtgtgtgtgtatatatatataaaaaaaatgaacaaaagttttacacaataatatttacccttgctacatgcagtgtactctgcttacccttctgttttattagggaaaaa

SEQ ID NO: 6126 - DNA, 2577 bp, Homo sapiens
tcagaaaaaaactggtcagctctagccaacagtgaggtttcttttcttctgccctaactattgtgtagcctcttatgctgaaatcggcttctgctggcttctccggctttcagagccctgaaacaaagagaaacaggatctgtccctacccagcacagcaaatggttgtagtaattgccaaagccctcataaagccctccggcttgaggagagagtgtatagtcatgggttctgcctctgtgcccttgctggccgcttctcctctgccttctttcctggaactcagggtgtggggactgagcctgtaggggacagcatgccgtcttgctgtggccactcccaagtgtgccctcttccctctttacacatcaggtgtctctggcacaggacttggcactaagctccatgctgagacaccaggctatgtgggcccccaccttgtttcccagcctgcaccttagaagccgaaggtgctttcatcagaaccctaaaatggtcgttgaaggcgcctgggccgcagcccagcagtagttggagaggcaggcagagggcagtggttctcccaaataggagacctggggcctggccaggccagggtttgggcctaatggctttgactaaattacccccatcctccttgcccggaaaagggagagctagagccactcactgtcattctgctctgaccttgaagggggcggtgttggcctggcttctggaatggactgagtccatcgtggaaagggctgggggcaggaggaggtggggaggggcactgcctgcggaaggtaggattagatcattagctcagtgacctcctagggtttcgatgtgctatgttctcatcctacagttggtttggtaatgatctgcaagtcccggagagcaacagcacagctctgcctgacgctctcattaaaatctatgcagccaagctcggcactttgtagcagccggccttgcgaagcctcctcagctcggggggccggggacccagtgagccgagaggccctctgggctccacttatgcatatgcaccaaaaaaaaaaaaaaaaaaaaaaggcttctttagacccagagccctttaagatgataaaggacccaatgcaggtaatcctgtttttggactcacgtaatgtagaatgcaaagtttagtgattatttaatctgggcctaagctagtgagagtatggaacaatggcccataaggactcctaagcgccgaagccaaggagcctcctcccttcctggttcaccccgcccaagggacctgcccccattcctgtggccctggggcccagcttccaatagtgtcagaagcaacttgtggctttgccttggttgtgagatgggtacattccaaaggagcagcctgggggagggggcaggctcagccagcccttggaggctcagagcagctggcccaggctccagctcgcctccagtggaagcccgagcgccctcagaaacgaccctggccaatgtcaacgcagagccgaggcggtgttgtcacggctaatgtgaaatctcttcccgtggcgcccatcctctgactctgcagtgccagcttggacagattgaggtctctgtggctttggtgaccctgcttaagcattcccaccgtgtcccagctctgctctaggactgcctcccactgcggcccctcacctgacttcagggtatggggagggagggagccagtgctccaaggccagggggctttgctcatgagagatgtcaggcttcctggaggcatcaggctttgagccctgctggggtccaactgacctgggaccaggtgtcgcgcagagatgtgcctcattctgtgcctccttctgtgcctcctaccatgttccctttaactgtgcctcagtgtgggttagggaacaattttgttattgtattaagtttattcagttaattcacttgaggaactaaccagtttttactttctgtctagaatgatgtacatgtagtagagtaagccataatgctcccaaagtgccttgttttctctgatacaaacatatttataaggacatattcctgtgggttcttgggtgtgtttgccacatcaagattttagggaaggggggtatatgtgtagtagggatgccgtttgaaaacaggcactcttcccctgaggatgggaaaggagctcttcagttggagatctaggcagtgggttaagccagacccctaaagtgaccctttcctcttctgccctattcttctcagaccctcagaaagacatccaatttttttaaatccctgtagctccaagcctggtctcatttgcttccctgccaggctcatcgtgtgtataccacatttgtgccccactgacctgaaggttccatgtaactgtatacacatgaatacttaaatgccaacatttaaaataatttgataaagtctttgtagccactcagccacctctggtgtttgtggtattgttttaatgggacaagagattagaaggaaatgacactaacagccacaggtggtggccagagctcaggaggggctccagtgtgggtgggcctaaagggcaggaggcttttgggtgtggaaagt

SEQ ID NO: 6127 - DNA, 1121 bp, Homo sapiens
gctttgaaatcacacaagcctgagtgctggaaagaacctttttagctccaccacacccccatgcactcctttctcccattcccccaattccttctttctcaaatttcccctccctcaatcgtattttgctaccataaaagtacttggaagattcattcctcctaaggagaggcctgctagatctggccacatagtaaacctttgtgttgcctcattttgttcagtcgtgaaacgactgggctgctgacagccttgtggggcttccccagagggggagggaaaaaaaaagcctggctgcggacagccacagccaagaagtgcagcagctgaggcctctccgactggtgtgactcagtgtttgctcaaatagcctgtcgtccattttctaacgccttccatcttctctcagtgtcactgcaaggaatcaacacccgaaaagccttcagaagttccaccattcaagaccagaagctttttgacagaaactctctcccagtgcctgtcttagaaacatacaatacctgtgatactcctccccctctcaacaatcttaccccttacaggtaatggctggctagttcctccctttttcaacctatggtttaataacgctagatttttttttgtctgaagcggttgtttccatcagaggattgtatctaaaagcttactgcctaccccaaagttgtggtagtttctgtggcagcagaaactaaaatttacaccataaaaattgtcacttattattgtttggtttctgaaattcatagtgaatataatacatattgaaagtttactgtaaccattgcatgctacagaatttaatttcatataagccaggtccatcttggattccatccaaggaatttagttattatagaaccaaaaggactttgttacaaggcggtcctacagcatggatcatggatcccaggggcaacattctagcaaggctcccacttacttggaaaccactagattaccagatgtttgggtgtgttagtggggccagcctcttggcctggctgctctgggcccaaaggggtctttccaaagcttaaggagtaattcgcattcttccaaatgagcatcgttcactttgttttgaacatcctttggac

SEQ ID NO: 6128 - DNA, 1123 bp, Homo sapiens
gcgagggcctgggcgctgcgggggctgcctggcccggactcaggcaccaagcgggcacggcagctgggagcgcaggtgctgccctggaaatggggtggttgtcctgggagggggcgggacaggggaaataaagggggaatttaacccttccttcccccaggcttggctggggaggggagaggccttgaccaagccctgcgccatctgcctccagcgtctctccagtcctggttgtggctgcactgagggtccccatccctcaggacgtgctcctcatcactccaggccctaaagtgactggtgaagttaggggtgtgtgaagtgccccaggactaggtggagggggtggtggcacgtgaagggttaatacgtcctcataccttgattccagtcccggagctgccctgaccccctaccccctcagtcccgctgtgttaattggcgcggaggggtgaggcctatcctggcgtggggggagccagcagagggtttgcaggtagaggcagtgggagggggcctaatggaggggggagccaggcggttgcctagcaaccccacagctgtctgttgacctagaagaagctgcgccgtcttgacacagctggtgtttacatgtaaccgaggctctggcttagcgcttgcttggaggaaagctgaggtagggccctcgtggcagcctggccccggcccccggctgtcgtgggctccctgcctgcctgccctctttgcttcagctcccacctgaagtccaacggagaaagagtgggagagcagatctcagggttgcaggctgtggggctggggaaagttgctgaacacacacacacatacacacacacacacacacacacacacacacacacaatgcctgaggccttccacacagaaatggtgggagattaggaaaagcagaggcagattccaacccacatggaaaacaccaacatacagagggacacgtggccctacagacctgcaaaatcaaactgacctaggcacgcaacacaggcacggaggtaccgcagacataatgacaaccaggaagacagacacacagacacacagaaacatggtaattgaaacactgacacacagatgcacctacatacacctccatacacag

SEQ ID NO: 6129 - DNA, 1135 bp, Homo sapiens
gcaggtcacatcccaatgtggattagaagataaaagctcagaggagacagaatggggaatgtggagcctgactgatctgagagctgtggctgatgggacggggaacagaacgggtcaagcaaggagggggccttggccctgtgcagacatcttctctgggcctctagatggaaagtagagccagacagactggctccacgttgggccctgtgggctaaagatcgaccctatcagaccctggggacaggggtgggagggtatgaagggccctccaaggtgttcaggattctcgagtccctctcccctccctactccctctcaggcctgacctgaggccaagagaaatgtcacaggtcctccaaggttacgcggctagggcctgactgaagcaggaagcagtttccaaggccaccatccagccggggtcagcaggcatgcccgggcctggaccaggccgcagctgctctgggctttgtctcttcgtgtcttgaaacctcgagaggtcacttgatcttgcctgtgactctgagcaagaggccttacgtcagggcccagccagtcctgccctgactcttctgggcacaagttcttccccacactctctgaggccatcctccctctgatcctatctcttgccactcctgcagccatgtttaggccaggccttgttctgagccctcatttcctgaaaatgtaatctctccacgaccataccgactcacccttcttctttcttatcttcccacgtcccagagcagggccacggaactggagggtggtggctgggagcctgcctgtggacacagataggcctctatgcacaacccagttccatcccttaccagctaggtgacctggtgagtcatgtcacctgatgagtcacgtcacctctctgcatctcttgtgagaattaaatgagattacacgtgaagcccttggccaggtccctggtacacagtgagcacgtagtcagcggctggtgatgggtaggtaaatacccgacagaggctgaactccggggcctctgaccagcctgtgtgagtcacacacctccaaccctcgcctcttgtaccttcatgcaggaccatagagccggccctccctcgcctgtgctcctcctaggaaggaggttgta

SEQ ID NO: 6130 - DNA, 1593 bp, Homo sapiens
caaacggggccggggggaggtagacgctgtgactgggaagccaaagcgcaagagacggtcccggaagaatgggactctgttcccagagcaggtgcccagtggcccaggctttggggaggcaggtgctgagtgggccggggataagggtggtggctgggcccctcaccatgggcacccaggcggacaagctggccgaaactgtgggtttcaggggaccgaggcccgggcctttgcctccactgggctggagagtggagcctcaggccgtggcagctactacagcacgggtgcaccctcaggccagaccgagctcagccaggagcgccaaaacctcttcaccggctactttcgctcgctgctcgattcggatgactcctccgatctcttggactttgccctctcagcctctcgcccagagtcccggaaggcatcgggcacctatgcagggccacccaccagtgccctgcctgcccagcggggcctggccaccttccctagccggggagccaaggccagcccagtggcagtgggtagcagcggggctggggcggacccctcctttcagcctgtcctgtccgcgcgccagaccttcccaccaggacgagcagcaagctatgggctaactccagccgcttcagactgccgggcagccgagaccttccccaagctggtgcccccgccctcagccatggcccgctcacctaccacccacccgcctgccaacacctacctgccccagtacggcggctatggggccggacaaagcgtattcgccccaactaagccctttacaggccaggactgcgctaacagcaaggactgcagcttcgcctatggcagtggcaacagcctccctgcctcacccagcagcgcccacagcgccggctatgccccaccgcctaccgggggcccctgcctgccaccaagcaaggcctccttcttcagcagctctgagggggcccccttctctggttcagcccccacgcccctgcgctgtgacagccgggccagcacagtctcgcccggtggctacatggtacccaagggcaccacagcctctgccacctctgcagcctctgccgcctcctcctcctcctcctccttccagccctcgcccgagaactgtcggcagtttgcgggggcttctcagtggcctttccggcagggctatggaggcctggactgggcctcagaggcctttagtcagctctacaatcccagttttgactgccacgtcagcgagcccaacgtgatcctggacatctccaactacacaccgcagaaggtgaagcagcagacggctgtgtcggagaccttctctgagtcatcctccgacagcacccagttcaatcagccggttggtggcggggggtttcggcgtgccaacagcgaggcctcaagtagtgagggccagtcgagcctgtccagcctggagaaactgatgatggactggaacgaggcatcatctgcccccggctacaactggaaccagagtgtcctctttcagagtagctccaagccgggccgtggacggcggaagaaggtggacctgttcgaggcctcacatctgggcttcccgacatccgcctctgc

SEQ ID NO: 6131 - DNA, 1626 bp, Homo sapiens
tgagactctcttccaaaaaaaaaaaaaaaagtgaaactgggcccatgaggggctcactatacacatggtggtttgagaaaggctgggagtcagcaaggggatggggcttggggtggggaggggagcttggtaaggagatgagacctcaggagggaggggtccaggagctcatcaaggatatgggaagctgatgaggatgtaggtgttcagtaagggacctcctgctcttcctgcctggcaggtcctggtcccggcttctcgcaccctcatgtcagccccggccccgcccggcggcctgcggaggacaaggtcaggatgcgtgtgaagccccagggcctggtggtgacttccagtgccgtgtgcagctctcctgactacctccgggaacccaagtactaccccggcggcccccccaccccccggcccctgcttcccacccggccccctgccagcccacctgacaaggccttctccacccacgccttctccgagaacccacgcccacccccacgccgggaccccagcacccggcgcccaccagtccttgccaagggggacgacccgctgcccccacgggcagcccgtcctgtctcacaggcccgctgccccacaccggtcggagacggcagcagctcccgacgctgctgggacaacgggcgggtgaacctgcgaccagtggtgcagctgattgacatcatgaaggacctgacacgcctctcccaggacctgcagcacagtggtgtacacctggactgtggtgggctccgactgagccgcccgcctgcaccgccacccggcgacctacagtacagcttcttctcctcacccagtttggccaacagcatccgtagccctgaggagcgggccaccccacacgccaagtcggagcggcccagccatcccctctacgagcctgagcctgagcctagggacagtccccagcctggccaaggccatagtcccggagccacggctgcggccacgggtctgcccccagagcctgagccagacagcactgattactcagaacttgctgacgccgacatccttagtgagctggcctccctcacttgcccagaggcccagctgctagaggcccaggccctcgagccaccatcgcccgagccggagcctcagctcctggacccccagccccgcttcctggacccgcaggcactagagccgctcggggaagctctggagctgccacccctgcaacctcttgctgatcctctggggctgccgggcctggctctccaggccctggacaccctgcctgactccttggagtcgcagctgcttgacccccaggcactcgaccccctgcccaagctgcttgacgtcccaggtcgccgtctggagccccagcagcccctggggcactgcccactggccgagcccttgcgcctggacttgtgctcaccgcacggcccccccgggcctgagggtcaccccaagtacgccttgcggcgcactgataggccaaagatcctgtgtcgccggcggaaagccggacggggacgcaaggcagacgccggacccgagggccgcctactgcccctgcctatgcccacggggctggtggctgccctggccgaacccccaccaccaccgcctcctccaccc

SEQ ID NO: 6132 - DNA, 1119 bp, Homo sapiens
aatgttgaggttatccaataatccagtttgtgtctctgatttggataactcataattgtcacttttgcctcagatggtcatgactttccatttgccagtttttatataccaggtctgggggaatgcaagtgcttgagtgccctttttggcctcaaaatatgtatatatgattttaaggaagttatgtatatataaataataattttaatccagcactttcatttcacaagtaaaccgcaaaatcacacagtggcagaagaaccaggcctggaattcagggcttctgattcccagtctgggacttgttcatatatatgtttgttttacaatttatggctagttccatataatccatataagttcttacttaactcccacatcaacagtagggaagtgatgccagtattacagaggagaaaaataaggcccagaaagtttaagtgactcactcaagcatagtagctatgctagaaatagtacccaggtcggcttcctactgaaggctgtttccatttgtgactgccttttaaaattatatcctcatttcatttcaggaatgtcggattgcacaccctgttgtgaagtgcacctactgcaggactgagtaccagcaggagaggtagagttttgttgaccatgaaagatattaataggcttttttcctcttaaaatctgtaattgattgcatttcatgtacagatgctataatcagttgcattgtaaaatacagatctgtaatcaatcacattatatacagactataattgctaaatatttaggtctatgatccatcttgagttaattcatgtgtggggtgagatatacaatgaagggtatataatacatgtattgtttcctagttattatccattgattgcttaaatttttttttttttttttttttttttgagatggagtctcactctgtcacccaggctggaatgaagtggtatgatctcagctcactgcaacccttccctcccaggttcaagcgattcttatgcctcagcctcccaagtagctgagattacaggtgcctgccaccatgtccggctagtttttttgtatttttagtagacggggtttcaccatcttggccaggttggtcttgaactcctg

SEQ ID NO: 6133 - DNA, 1907 bp, Homo sapiens
ggatttcaagctcgctctctttctctcactattaggacttttctttttcttcttcctcttctctctattttggttctattctttttttttcttttttctttttttttttttttttttttttgtggtggtcactgctcagtgtaatgtgcagaatgatttgttttttgtttttttttttttttttggtccttcattgcatcctgccatacccatgagcaaacagtttggcattaattatatatcactgccaccctctgaactttgaaaactgccatcttcagacttggtataatggaagaggctttctctctccaataaaccttttgcttcagggtatactcttcggtttttttccagatgtattatgtatgaactttgtactatgtatagccagagttttatttattttttaaaaaagaaactttttcttgataaaggaataatggtggtctagctagttcttgtaaaagtgatgcctcttgaaaaaaaaacagtcctattcactagcttttagtaaaagaatcagatcttttctttcttgttaccttggagtcttaaaaactgattgctaaggtgaaacaattcaatgcataagtatggagctaagtgccttttggaggatttcttggaagagcatttatggagatacttaagggaggtagcaaagatttgaaccgtctgtctttttaagtaagggcagaaagcaaggttgtccaggttgtactggacacttctctccccacccctttcctgattgttttatgtgattgattttaaattctcacactgccacttctttaaaaaataaaatcctttatttgcttatatcagttgtcatactgggctgctgtcagagaatgtttttttacatgaatgaacagattaaaaatggaataatatggtcgggtgcggtggctcacgcctgtaataccagcaatttgggaggccaaggcgggtggatcatttgaggttaggagtttgagaccatcctggccaacatggtaaaaccccatctgtactaaaaaaatacaaaaattagccgggcctggtggcatgcacctgtaatcccagctacccaggaggctgaggcaggagaactgctcgaatcccgggaggcagaggttgcaatgagctgaaatcgcaacactgcactgcagcctgggcaatggagtgagactccgtctcaaaaaaaaaaaaaaaaggaataatatttgaactacagagcatttttggggtcagcatgagctgctctagtaaggactcttgagtctgggaaaagtggtatcactataccttctccccactcctcacccacccgagcccatacactccctgcttttcatggatatgtattgaaaacaggtgcttctcagaagcactttgcctcaaccagagttatgtatgccctgcctatcttcccttcttaaccctgtaggaatatggatttacttttccaggaaaggggatagatttacatttctaggcatactctcaggtcctctatgtgatgtttgtgaaaggaattagggtgtgtcatgtgtgccatgaaacaacaaaaccaactaccctagaatcatttatgcagggggtactagagttagaaataataatgagggcagataacatttgtacctcagtctaccaaaaaattatagtactaaatttaacttctaggcgtttcctggaagcagatgctctataatttgtgatagcattctcataaatggagtcctacacataattggacagagatgtggaaatggtggtttccttctgataagggatacagtggaccatgtcgcttatatatcaccctactaggggatataattttcccttctaagcaagggaaatggcagtgctaaatagttttgtaaagtttttgaatgagaagcttttaggtaaag

SEQ ID NO: 6134 - DNA, 1984 bp, Homo sapiens
atctcgcaagaagatgtgtatcctggtgcttgtcctgtcagtgattattctaatcttgggacttattatctggctagtttataaaacgaagtgattgcctccgatcgttctcccgctgagctgttttcaagggcaagtgcttgttgaagtcttgccagaacaaactgatcacaagaagacagcatatatcagaacgtcctgtaatcatttagttagaaactaactactaactagtctttggaattcgtgacctatggagacagtaattatcaatttattgattctattgatttctcaaattaggaattaacttatgtggattttgcttcctcttgtattctgattgcccttcatcccaagtgtttactgaaaattccattctagatattcttgttttgacaaatgacactacagtctcgtaatattgtcttttatgtatatacaaaatttacctttttactagcatctgagatagagttactttctggtacccagtatattggagtctgtcagaaactctataataggccaccagtttttattatttaacatttttatttgaatttctaagaagcctattctctatctattttgaaagattttggcactatatttaattggaaggtaaaatattgtacatgtgatccagagtaaatgagaagtctctatctgagctggtcagttactggagtacatgttactaatctgggtttaaagtttacttcattatctgctagtgtcatccacagcagttcatcctcatccacactaagccatcctgttagcttttaaaggaagttaatttaattaacattaatatactctatgggctccctctcccacctgtctgcatagaaaggcagaattagacatagcatgctttggaaaagcaaataggaattgttgggaatgatttaatcttgttgttgttgttgttgttgttcacttgtggttctacattcctggtgaatgatgaatgttgctgtcaaagggctgccccctaccttataagggttgctgggcatttgaaggcaggaagatttttaaagatagattgaggttggtttaaaattattcctgtaaaccaacaataaagcaaagaagaggttcatttttgtaaataacactggtttcaaatagtgatgttagacttaacctaatttataaacaagagattaatatctccatgcatagttttagacaaaaaaagatgtttcaataaaattactgtcttgtaatataaatgttgtccacttcccttttccacaggcctagaacagttaaagggaacataatttgtttaggctcccacataaatgtgaatctggccaacaactttggttcatcctttagtgaattagaggatttggctaccctgagtatatttatattcatttcttctgttctccttctgttattatacttaatcttctaaactaaactaatgtgaacagtagggaagcaagggcccaaatgcataagtttctttgcactgttgcacttacttaatacaaataaatgttttttaaagcttttgtagtatgtttttatgagttaacatcctaatgtggtaggtattaggtaatgtgctgtcatgagaaaaattgagacttccaagaaaactggacaccaggtgagggttggtttggagacggaataggtgtagctgcctttccttgaaaaacagtgtgtagagatggctgagtgcaatggctcacacttgtaatcccaacactttggaaggctgaggcgggaggatcagtatatcggtacgtctgagcccaagagttcaagatcagcctgggcagtatagcaagaccccatctccattttttttttaatgattttttaattaaaaaaaagaacaacaggatagagctgttggggtggcacagtggcccaaagagcagcttcagagataattccttggttctatgatccctgtttaactccaaattacagtcggacttggatacatcatttg

SEQ ID NO: 6135 - DNA, 1410 bp, Homo sapiens
aaatgaacccaagaagaagaaatatgcaaaagaggcttggccaggcaagaagcccacaccttccttgctgatttgatatttttggtcatggagaagggtgggattgggtgggaatggggtggaagggtgatggggagctaatgaactagggagaaaaactttccatgtgtgcggtatcgtctttcagaatgtctcctggcatcctaaccatgtaatatgacaattgggggtggggttgaaatagcccataaagacctgtcttcacaacacttgcattgtagagaaaggcttcttatatccttttcaatagactgccctggctctttcctaggccttccactacctcctttctttctcccactttctaggatcatttttatgtaaagtcacatatcccaggccctcaggttgaatccagagctgtagaggttacagtagcatcaccagccttgggggtccagagcctaatttatattcactatccttccaagtcccgggtagcagaagggttgccatagatctcagtttgatcaaaaagaaggcttagaattctgcagttaagctgaggtttaaactaaaaaatgtttccttgggtcagtggttttgaggtccagtagctaggcttttctcttttgtccttcctgttggaatgaaaacatttcgattttccttcatctgtgactggtgccatagacacaggtttatagttttaacttacagtattgtttgaaatttacctgtttttcttgtcaaacctgagcactcctcctgctgaagtttcttatttaattccagagtactgtcctctactctaaggcattacttttaagtgtattatgaaggcagttttcaaaggatatgaccagttggggtaattcaaattaaaaaggaaaagatttgtttggaagtaactggtgtctctaagaggaatttttagatgtcagtttggaggctctttcccccctcaattgagagctcttgttattcagagctccaagactagacctggctaacaaacataggagacaaagttaggaaacattgatacaagctttgtacagagatttgtacatttgtgtaataggccttttcatgctttatgtgtagctttttacctgtaacctttattacattgtaaattaaacgtaacttttgtcatttgggtgcaggctgtgaatttgtctctcagtcactgattgccactgccatctggaaatgtttgctaaaggcacagtcactgggcttgggaggcaatgctccatccccattatattacaaataaagatgccctaaatgagtgtggaaattctaatgagagaatgtagtccccagactgaagcctcacaaagcagcgttggttcggaagtgcttggtgcccttcatcaggagacctcatgacgggagacgggg

SEQ ID NO: 6136 - DNA, 1196 bp, Homo sapiens
agacagtggtttctactaggagattttgtgtgcaagtgtgactacagctttagatccttgttttcctgcttagactgtatttaagtgaggccctgttgtctttcctttgcacaatttgggagagggatccaagacagccctaatagccattgtctccatgaataagctctgttttgctattttactggcatttctccctgtgagagctttctatgtgcagaatacttgtgaattcttagctaaggtagaaagttgggagataagcgaagtttgcatatttggccatatccaaaaggcagtttccttctgaattggcctgaaaatgaccttttttttttcttctttctttctaggcaagctgtggattttctgagcaatgaggggcacatctattctactgtggatgatgaccattttaaatccacagatgcagaataactggatctaactgggtacctgagatattttacagctggacctagtttcacaatctgttgtctccagctctgcatatgtctggccagggggcttctaggaagtaggtttcatctatcaaatgtctcctctgacttccttttgaaacttactgctcttctgttttattttgttttgtttgaagctcagagggagatgggcaattgacagggatgcaatccagggtgggatttcttgaggaagttacaaataagcttgttacaacatcaagatagatggaattggaaggatgctaccaggagagtacttacatagtgctcaggagtttctcttcttaaaatgtttactgctgaaagatgagcaggaccagggcgttataggcagagccctagccgagaaacctgctggcctctgcctgttttcatttcccactttggttgtgtggcattactttcagaattgcactttcctgcttgtcatgactttttgacacacttgccatgacgtgtgtttctgtgaacatgaagttctgcggtagtgcctccaggggcagaggaaaagaagaagtgttactgcattttgtacaaaataaatacagtcatatgtttaataaaacagttctattgtagtaacttgtaaaaattctcgtttttctttctgagcagtgtaatgaccactttatcatctgaggcagtgtaacatagtgaaacttggatttgaattctggctttcccactttttagttagaatcttgagcaggc

SEQ ID NO: 6137 - DNA, 1114 bp, Homo sapiens
gtgggtccattcatcaagggggagaccctcttcattagagtcctcatgaaattagccaaatgatgagtccttccctagctgggcatggtgggttctctttttttttttttttttttttttgttgttgttgttgagatggagtctcgctctgtcacccaggctggagtacagtggcatgatctcggctcactgcaacctccgcctcccaggttcaagcgattctcctacctcagcctcctgattagctgagattacaggcgcccaccaccacgcctggctaatttttgtatttttagtagagatggggtttcaccatgttgaccaggctgttctcaaactcctgacctcaggtgatctgctcaccttggcctcccaaagtgctgggattacaggcatgagccaccatgcctggccaggcactgtgggttctacaggatgggtctgtaatgtcacggtgagggctctctctagtagtagatctggagtgaggtgtgtcttgggttgaggaggtggcttgactttcgaatgtaaaactgactgtgccttagcatcaccctgtccagtgcccctggggcagctggtagtgtccagaagaatggacacctgctccagatttagatgcccatctgggcttttgtttgatttgcggcgttcctgtcttctgtaaagctagtgagttgtcccaagagactgatgccacagcttgttcgcagtttacacaaactcagctttaaaattccaaatagaatctgacttgcaaactctagctgcagcatgtggagcttctagatgtttactaccttgaatggttgtcagtgtcactgaaccacaggggagaggagtatggggtagagcaatggtctgggccaaggaatggtgagcttagggtcttcctctgactccttactcctcaaggaggcagttagggtccctcttaagcaggcttctatttcttaccactaaattggtttcctttttcatccagaagttagaactccccagatattcacactataggatctgaattccgagattctaaaatatcttaaaccacaagagagaaaatctagttctgcctcagccccagtcagcaggccatctgtcccttcctctc

SEQ ID NO: 6138 - DNA, 1165 bp, Homo sapiens
atcacaaaccatggagacctagtatcccttcaccaggctttagagcttgattttctctaagaactggaatgaggagccttccccttgagctccttttcactcctgaagggagctggagactggaaccaactgagaactttctctgtctgtctctctctgtgtctctgtctctatctctctctctttctctctttctctctctccctctctccctccctcccttcctctctccctccctctctgcctctctctctctctctctctctgtctttatccatggaatgctggcgagaacacaatcagaaccaacagctgcaatttttgctaagagtgagctgcagccccgtgttcatctccatacagaagcagggacagttggatagagagaacaatggactcactgcagctacagtgcttttaatttttctgtgttttgtttttgtttttttgttttcaaaaaatgaaaaagaaaaggaaattcctggggcagagttgcactcttagtccatgaccagattgagaattactgataacttgtggtgatcagataaatgcagcagacttttatgataacatctcttgcagtcttagagtctccttagcttagaatctcacttatttccagcgaatgtgtatgttatttttataggtaagggtctgatctttgacgcaggtttcccccactttctttttctagcaagaaggggtgtttaaagtcttgaaaatagtaattgaaatatctaaaatacctccctgtggcagtagcacctctatagctgctccagtggtctgctctctaggatgatacctttcctgttcttctatctcctagctggtgaactgtggggcactggacactgagtaacttaaactttggcatttcccatctagaagccttagtcttctttccagtcccttttccctttagtcaaatggcacaaccctaaaaactccttcagcttgactgtcattcagactgtatcacaggaggcttagcttccaaactggagagaaggaactaaagtgtcttatgaatttcagcttcttggctcttgagaccgaaaggttctacctattccccctgcagagaagcacccatttcccatcagatgctcgtccctgcagcttcttccttcttggtcatcataatgctaggttcttaccc

SEQ ID NO: 6139 - DNA, 1327 bp, Homo sapiens
tccaaaacttcccactcattctccttcccagtttttctaaatctaccaaatgcacccaacacttcttacgttccttttagccaggtagggattacgcgcatttttaaagacctccttaaaagtgaaggctgtagtaccgtcaggactgcctagcgctcacccagaagctgcttgtctccgaggcactaagaggggcgtggccatgggcgtggctcgccgggccggcggagtgggcggagcctaaaagcttccccgcccggtcagactcaacacatgcgcccagaggtttctagtggaacgaggtgtggattgtgaggtgactctggccgcttacttccggttcctagcgatgcgcatccgggtcacgctaacgccgcggtttcctccgctcgattggttctactgtgggtctggactgatctccatgtcctgttgtggggcttttacagcctttgggtgagtctcagctgccaacagggtctgagcgcagccgggcgagcacagcgtgaagggggatgggtctagagttctgcctcggtccttgtgggtgggagtctcttcgcctgtcccttgtcactgcagtgcttcactcacctcagccctttccttcacgctggcctcgccttattcacctcagcttagccttctcgcgcttccgtgcctctgtcgcctcgctgtttttcctcagcctcatcagtccttttccaacctcggtttcttgccttacgcctcagcgcttctctcagccactgcctctccttttttctcctcctcccttcttttagaacctcttttcccctacccctgatctgggatctcagcgttctttcacctagcgagacggcccagcttctcattgtgctcactcttcaccacgagaaactgagcctctccctagggtcctagttccttgtcccccaactttcttcagctttgatccttcctcctgggaccagtaggtgacagtgcttctcctggggttcttctgcctgtccttagctagaggagagctttgccaaagccccgaaatgggaagacttccccagcctgggggaagttttgccttaaggcgccgggttagactgaactctggtagcttccatagttagggtacaacaaaggcgttcctagttcttcgctttacctcagttttggggctctctcaagagcagctaacaggtggcaggcacacggtactgctagcagttgggctggcgcgatcttgttaattgacaagtcatgaagaagttctgtcagttttgtgttcccatgagaatggatgtgcacagctgaggcaaaaacgccaatattttgggacgttcagctc

SEQ ID NO: 6140 - DNA, 1218 bp, Homo sapiens
tgatttgggattatatgcacccctttccagagtccaaacccgttttggctttgtgtgtcatatcctattttgtgatgatggggattctgaccatttatacctcatataaggagaagagcatctttctcgtggcccacaggaaagatcctacaggaatggatcctgatgatatttggcagctgtcctccagtcttaaagggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaattagtggcttggggggtgggggagataaaaagaacttaaaatgggtaaagtaagaaatgttaaaaagtccctgttttgtcctgaaattttagtctattctggataaataggattttctgacacagatatgagaagttgtagctctgatgtctagctgtagtctccttgatctgctgattgcattattttaatttgcttttctgggaaagcagttttgctaaaagctgtacagactttttcttttgtacctagcagtactttatatagtatagctttgggccatgtagcattttaagactcaattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaatttaaaaaacacatagctttttaatttgtttgaaacagactttctgcctgttacattttgtgcttttaaccaattaaagaagccaatggcattttagttttatattgtgtttcccactagtatatccctgttgatttgtttgtgccttttattaactgccattttctaaaatttttttcaataaaaggaaggaagatgtgaaaaaaaaaaagtcagatacagagtgtaaataaactacactgtagtgaattaaacttggctgcaaattactacactgtagtgaattaaacttggctgcaaattatttgacattcttcatattacaaagtggagtctatgt

SEQ ID NO: 6141 - DNA, 1418 bp, Homo sapiens
tgaactcctgacctcaggtgatctgcccgcctcggcctcccgaagtgctgggattataggtatgagccactgtgcctggccagctctattctactcttgggttattccagaggactgaagtgggctgggctacaggagggtgagtggatggcagaccaggtttaggcctttccactcattgactggtctcctcacctcaaacttcttttgtacttaggaaagtcgagatggtcgtgtggacagctggcgaaacttccaagccaatacgaaggggaagaaagagaagaaaaatcggaccttcctgagaccaccgaaagtaaaaatggagcaacgtgagtgaccgcccaaggtcacaggcacagaacctttcccctgctatctcccttcctgcttcgaaggactcattctttcctcccacttccaccccaacatagagtagtatttgctttttagtccattttgttttcaatacgatttaatatcgatcagagtaattcttttgtacattgaaatgaggggcttggtttaaaaaaagacctttccctctccctgcccctagaacaaccagtattagaaggtgccaccattggtgctgccttctcttcccacagcctgtaactcagtgttttgtacttcactgaattgtgatggttagaaacttcgtggatagtttgtggaaatcatccaattaaacatactgcttaaaacagtgttgctgtgacttcagagacaagcctggaaggggcaccttaggaagccccttcgcttcagttgctcgcttctgggtgtgctcccttcgaaggcccagataagacagggaacacttgtgagcacacagagcagcatctgatgccctgtggtgtttggcatgtgccccctgtctactgaccaatcagtgtggcatgaggcccacgccacccaaacctttcactttccaaagagctagccgtcctccacccagtaccatgtcctagcctgtctgcatttgttagtggtaatattctttatgtataataaatttttatacccaagccattgatgtacttttccttgtactctcccttgtgggtcccttgtctggcttggctgaaccccaaaatgctttggggttggacagacctggctgaaccttagtttcttcatctatgaaatgggaatatgaattactgcagcagcttttagggcagatttgccatggcatatacaaggtaactaccatagtgctccttgggtattgccaatatcctattatttctgtgtaaaatgaagatactgattgttttgaggattaaatgaagtaatatatgaaagcgtccagctcacagtctatgcttaaatgtcctgcttgctttcagggacagaatcagccctcaggaggggcccaaagtgagaaggggaaaggtgacacttgaaatgtg

SEQ ID NO: 6142 - DNA, 1181 bp, Homo sapiens
cattcatttctataggcaaagaaagctctagacagattggaataggaaatggatatttgccttttagctacacccctttgtctgtcttcctcattttgttcctttttttttccctaaaggggagtcaagttccctgggttgttcccctcataaggtattagggacttgtgtcacatctctctggagttttctattttaaagaggaatctgaaagcaataagctctttggtcttcttaagatggctacacctcaatttaagatggggtattctttcactagttgaggagtagaagaggatgaccagctagactcccatggaattggaactcctattccttgcttagacattacaggttatgctttgagatctctttggggtgaaggattgaaattaaaccctgagccaccgtgtccttgtagagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctactaacagattataataaattgtcatcagtgaactgtgtttgatgccttcttctatctggaagagatagacagacaccaatggactgctaaaatggattagaggcgtccctgcatccaggaacccacagacaatgcacagtgtgataagtgctatgaaacaacacgagttggggggataggtgtgacacagacaaagtacccctccccgtctaattagaggtgttcagagaaagcttcctgaaggataaatcccaatctgaagcataaagatcaggaggatcctggagatccgaaggagtcattgcttcaaaagatacaattaggccaggtgcggtggctcatgcctgtaatcccagcactttggaaggccaaggtgggtggatcacctgaggtcaggagttcaagaccagcctggacaacagtaaaaccccatctctattaaaaatacaaaaattagccaggtgtggtggcacgcacctgtagtcccagctactcaggaggctgaggcaggaaaaccacttgaacctg

SEQ ID NO: 6143 - DNA, 1275 bp, Homo sapiens
ccagacccttttgtgtcccatgcccaccctccccacgctgcagtgggcttgtgtgtgatgtgcagtcccgaagccacaccctcccttttcctcactggaatggacagttcattgcactgactctgggatctcagccctgctcctgggagctggaagagcacttggagatcctaagggaccacacccttcctccttcccctgcccacagaggcagagggcacaggaaagaagccgggccaagctcggaattaatgtgccacaagtgttgtggccttcctgaactgggaagtccctggctggcccccgggggagaggggcaaatgcctccgggactgacactccaggcagctttgccttctctcccctgtcatttccagatttcattacctcctacttgccattcacccatcaatgtgaaagtcagggtcacagctggtctgtgtgtccagttccctaaaagcctgttctgttgggcagcctgaggctgttgcccgaatcctagttcagttttttgacttcctttgccctttttcccttttctccatgcttaatggtgtgaggcgtcaggagagaggccaagtacataaaaaaaaaaaaagcagattatctctagagagtttgagcctttgctggtcacattgccttctgaagaggagggagtattagattataaatcctctttattttggtcctttatgcttgaggttccaacctggagccacagtgtgtgagaggaggaggagagggagaattctgttctcccagagctgcacctgcctcgcagaggccagcaccccactctcctgcctccagtggccctgccgcagatgtctcccaaaaagttgagcctttctagatggcttaggtggcaccatggctcagcaggaggggcgggaggcaccagggttcttgtttggaccctgcccctgggccatggccaggtgaccatggctacattgccaaacctctgactgccacagctgcagactgagagggtgggtctgagtccccacaatgtctgaagctgcccctgggattctcaggccaacctgccaacagcaagcggattttcttgcaagatcagggaccccatttctgcagccagtgtctcctgggtgccttctgaggactcccacccccatcccagtatctcatctgtcccctctcctggggcttaagtgggttgcttccaggcagaagcagccaaggaccgattccaggcactttctgtagcaaatgactgtgaattacgacttctcttgcccttcttctagc

SEQ ID NO: 6144 - DNA, 1207 bp, Homo sapiens
ctccttacataaggggtttgcaagagaacagggaaaagtgaaatctagagagaattacattctcctttaacaataccttaactagcaacttcaaggggaatttcctcccccaccccgcttttattcactaaatacctaaatttgtgatcctcaagaagggaagaggatgttaagtatcagatacctataggattttttccagctacacattccacttctttcacccaaggaattttgttgtggctctcctccagtagcctggcccttgtgtgaagaatcactaccacaatgagcatctcttagtgagcctttcttactgacatttcttaagtatggggaggttgggaggcattgagaatggtaacctataagctaatctataaattaattggtgaaattggccacaaattcatagatgtgttagctttttcagtttctcttgttactctctcttccctttttataccatacatgttattacacaggctcaactggaagccagcctaattctgaagcagagtctgttcctgagaatgtacccaaaccacctttacttcctcccaaaagacccttgtcctcttctcatgaagcaagtgaagggcaagcaaaggatgccacttcctctggcggcacggcaaggttcatcatctccacctccatcaccacagcacccgctgccaccactgctgccacaagccttgcaaagactgttaatctctctgtcaccccttccccagcacccaggactctgcctgctgctcctgccagcactaacactactgctaccccaagcctcactcatatggtccctgccaagcagccccctatccctccccctaaaccagctcacagaaatagcaaccctgtcattggtaagtaagtctttaggcttccagtgttttgggtttggtttgatgttggatggttattttatttgataactggtacaacattgatttggtctgtgagaattttccatatcttgtccctttgaatgacctcaatatggagaaaagtcttaggttaagaaaaaataggccaggtgcggtggctcacgcctgtaatcccagcactttgggaggccgaggtgggtggatcacaaggtcaggagattgagaccatcctggcaacatggtgaaaccccatctctactaaaaatacaaaaaattagccaggcgtggtggcacgtgcctgtagtcccagctac

SEQ ID NO: 6145 - DNA, 1134 bp, Homo sapiens
ttttggagatagggtctcactctgttacccatgctggagtgcagtggcacaatcttggctcagagcaacctctgcctcccaggctcaagcaatcctcccacttcagtctaagtagctgggactacaggcacgtgccaccaggcccagctaatttttgtgttttgttagagatgaggttttgccatattgcccaggctcgtcttgaacaccggggctcaaggaatctgcccatcttcgcctcccaaagttctgagatagcaggtgtgagtcatcatgcccagcctccttgaagtttactaacaattgggataactgagggaagagaagtgacaattccactcagtctattagaggtctggatataaggtagccacacaataactctaacttgacttctaaccattctatcttattgatttggaggctgtcttctgccagattttttgtggcttgagatgatattttcgaacccttctttcactacctttcttacccttaatgtgccaagcttgaaacaggatttgatttcctgagctacttgttcgccttctgtgcgtcaccaagtaatctggttcatctttcgtctcattcatgttattttcaagtgaaacaagacattttgggggtcaagtctctttgggtgttttgtttttatgtatataaaaatggattttgtgttccctttccatgtaagtaccaacttatatggaaactcacaatcataatgtaaagaagaaatgaaagcctggtgtattgtacttcaagatgcctccctgatgtatagaatctccttgtaaaataaataattgcattgtatatcagtcttcccatcaatattaattattaaatattttagaatttttaaataccaactatactattctggtgtgaggtattttcttttacattacactctatcccaaaagattaaatccagcttaaaaatgatatgtaagccaggtgtagtggctcacacctgtaatcccagcgctttgggaggacaaggcaggcggatcacctgaggtcaggactttgagaccagcctgaccgacagggagaaaccccatctctactaaaaatacaaaattagctaggcgtggtgacacatgcctgtaatcccagctactcgggagg

SEQ ID NO: 6146 - DNA, 1892 bp, Homo sapiens
gaacaagtgaccaccaaagcctgagtgggtgagggggatagccatggaggtcctgtagaagcctggagctggcagaggtgcttgacctgaggttatctgggaagacttcctcaggaagtggggcttgcactgtaccttgaaggttccattccttgtgaaaagcaaagaatgccattccaggcagaggaacatcagggcagtctcaaaggtggctggtcctgggaacagagggtggggtaggaccttgaatgccacgcctaggagcagcctttggcagtgtgtagggactgtgctctctggtttacagagttcttttttatccatcatctccttgggttctcccaacttccctgaactcccagagtctggtaccttgccaagctgctattggccaaggccacagtccacgcccatgtcccaggtttctcctgctacagaaaggtgggctggggatcctggagacagctgtacccatttctctctcttgcaggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaataggccacttgttttctacacattccctgctttttaagggagcacatattatgtgccaggcactgctgggaaagacagaataaactataaacctggtgttgaggctacaacttaagtgatgtcaagatgtcctgaggtgccaaccagctgtcagtgtgactgtaacaaaggcttcaaatctgtcaagaagtaaggaaaagttttgtttgaattttgtttgggtatttctgttttgggagtcactgg

SEQ ID NO: 6147 - DNA, 1244 bp, Homo sapiens
gggcgaggagtgaaactccgtctcaaaaaaaaagaaagaaatggaaagccaaggatgctgcagctgtgctttggggttcaaggtaatagcttaccttgttccacactttgtcaaagcactcaccctcctaagctaggaccagtccattcatttgaaactgtgcaatgtgatgtaaatggctctggttcttagactgtggctgtcacagggatggggctccaaggccatcattttcattgcatggctccaagagcagggagttcctcaatgaaaccagctgccttttttggtggggccatttttttggctttggaacccaaagcagccactcatttggtgcttcctcttgttctgccctccatccctcaactcttaatggcatctgtctcctagaacccacgctcttcagctttttggctgatttggagaacagtgacaggtgcctgcctgccttcgtccccttttagattcatttataccacagatgtttctgtgagatactgagatcataaaaagctttaggcttggcagagaggactcaacacccccaggctttcctgaggcaccaactagatgtctcttgagtgagctggactccctgggaaagaagcattgtctgcaacattatattataggaaatgtaccaggaatgtcaataataatgctttgggggggggggttattttgttttgttttgtttttaatgttgtttgtatatttagagctgggccattttccgtgctgcgatttcttctctttgaccctcttcagtgtttggggcaagagtggaccctggtttttatttctttgattgcattgtttactgcactaggaaaaatatagagatacagggaaactacagacaaatttaaggaaaaataggtcaaaaaagaaagcacacaccttaagagtgggaggaatatttttattaaaaacaaaacttggacctgtagtttttttttttcttttttatttttaagaaggcacctttcagaagccatgtttcttccaacagatgttggaaaccccatcgagcaagtaaaagttgcattctccatccctcagatggctgtatgtagtcaaagaaaccctgtaacatggtaaggttgctgttttttttttttttttctttttgagatggagtcttgctctgtagcccaggctggagtgcaatggtgtgatctcagctcactgcaacctccgcctccttggttcaagtgattctcctgcctcagcctcctgag

SEQ ID NO: 6148 - DNA, 1131 bp, Homo sapiens
aggaacgtcaaggtcgtgggaaataaaaggcagttctacacagactgcagcaacggttgcatctgcatatcctaagaggaaaaaatgaccttcaagagaattaggacttttttcttaatttcactgacttcagagacgattgcagacttgcagtttaagtattggaatttcacaaaagacataggacttaactggaaaatgaaaaaaaaaagaaaaagaaaaaactaaacaaaaaatccctctaggtagtttaggtgaaaaatgtcccttttattttggctttggttgtgatttcagagcataatgctatgtttttttgtctttttactatgtttttcggatttttaagtccgtaagtgcatacagttttctctaatttttaaaccctttcctcctcccattttgacatttgcacttggagaacacttgagttgtgaaggttttgggcatccaccccagaaagtgggaatttgattttatccttccgaactggaagaacatttttatgaagaatttttgtctaggagaatataacagtgttacccaaggttgtgtctttaagggtggttcattttctctgaccttttgttactcaaagtaaagtactaggagtcctaagaaatgttctgttcttgtacattatactgattaagtcaggattaatttgatttcaaagctgagaacagtggtaaaaactcgtttacagaaatgcattttggaagagaaaaatactgtaaaacgtgtcgtgaatgtttcttcagtttcttgttcagccaatgaggaaagggcattgcctttctttttaccattaatcacttctcaataaacgtgagatcctgttgagcatcacttctagtaccatttagtattatttgagtctgctgtgttttaaatatttggagtataagggggtataacaggtgagacggcaactaattttacagagtttgtgctaagagtaaacacttcaggcttgctttgtacccagggctggttaaccatgacctctgcaaaagcaaggtgggctgatattcataatgctttatatctggatactttgcagagaatgtagagtcattgctaaatcatttgttcaacagatattaagactattgggtgcctggcactatg

SEQ ID NO: 6149 - DNA, 1156 bp, Homo sapiens
ttcagattgataccctcaaaggacactaaaccacagtccttttttaaggaaggataaaactgtatttactgtatacagttctaggcattggatttaatatgtgatgtatttcactaaggtggcctccgtgggtactattttaagctactctctctgtgtgcatatctttagtgactcaaggcattaatattttattcaggatgtgtagataagatatttttgtaatttaatggaaagtctcatgtttaatgggtttgaattctgtttgttggcaattaaatacctaagtatattaattttttagggtttagggttttgccaacagtaatgtgttttgcttataagagccccccttttctatcttctttttaatagcaacatcatgacaacagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacagaagctgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcattaagcagtgcagaaacacaggtaaggatgtgtggatatgggaggtgggcaaaggaaggcaggttatacactttatttttcatttaagagtatttgggctgggcgcggtggctcatgcctgtaattccaccactttgggaggccgaggcaggcggatcaactgaggtcaggagttcgagaccagcctggccaacatggccaaaccctgtctctactaaaagtacaaaaattagccgggcctgatggcgggtgcctgtaatcccagctactcaggaggctgagacaggagaagttgaactcgggaggcggaggctgcagtgagctgag

SEQ ID NO: 6150 - DNA, 1567 bp, Homo sapiens
gtggaacgaagaggatggggaaaaggcagagggcactgagtgtccctttaaaaactaacccactgaatattccgtgtgatctagaacagtgtggcagctttcacagcacaggaccgttcatcgggggcctaaacgtttccctcagctctgtcaccaactcacttctctcggcttcgttgtctgtaaattggatgaaaagagctctaatgcctttcaggctcttagaagccatagatttggacaagcccagcaagatgggtgtccttccaggcctcttcccctttcctccatctctggcaacagttcttggggtttggcaattgtttggattttttttctttctgcagttgtgtgtatgtgtgtttgtgtgaagaaaaacagactctgtccaggtagaaatggtgaggagggggaagagaattacatttccagggtcagaaacttggcaacagttttcctagagtgactcagacacaccacagtaacaactctcgctgcaattttattttaatttgagaaataaagatttcctccaagccacatgaggactctggcacccacccacaaagcaagacctgtatttataagccgagggctcagggagcctaactgcgggacccgtcagggccccgtgacccatccccgtccccacccccccctccaccgctgggcccatcagtgtgtgttggggggatgcttggcagctgggggtgaggagacaacaaacctcgggaactggagccagagctgcggcctgactgacgccttttgatgctcacgggaaatttctgcccaggatctcagccccaggctggttgtttctacaaatctctctcaaatgtattattttggtgacaaaaatgaaggagctttgtaaattttttttaaaattatgaatcatatcaagtagttgtttacatttcttgaaaaaataggaactcgggcagcagaatcagattggcagaatctttagactacacaggcaataatcaagtctgctgttttggcctttcgtagtagaagtggttgtagtgtttagatatctgtttggtcttgcttcttgtattgcatttttttcaataaacaacaacaaaaagaactctctctgtgaggattgatccacttttaaatttctcttctaccagcaacttgggaaaaattaaatatgggtgggggagacctaaactcaagtcattttctaaagtaagttacccacattgaccaaaatgcagcttcaacgttgagtaaagggatttctgagagctggccaatgccttttgccagctgcagtgagattctgcagcataggccacgataaaggaaggagagaaggggcttctcagacttatttgcagaagggcccagaactcagtatgaaggcattggcagtagtgtagctctagagggatataccccagatggctgagggaagaaagggattgaggtggtaggagttcaaggctcagtccccgtcccagatggcagtggagagtctcatcccgtggtccatcttcccagaggccccacactccatcaccagtgccgccttggagggagcctgccccag

SEQ ID NO: 6151 - DNA, 1168 bp, Homo sapiens
atgacttgagtttaggtctcccccacccatatttaatttttcccaagttgctggtagaagagaaatttaaaagtggatcaatcctcacagagagagttctttttgttgttgtttattgaaaaaaatgcaatacaagaagcaagaccaaacagatatctaaacactacaaccacttctactacgaaaggccaaaacagcagacttgattattgcctgtgtagtctaaagattctgccaatctgattctgctgcccgagttcctattttttcaagaaatgtaaacaactacttgatatgattcataattttaaaaaaaatttacaaagctccttcatttttgtcaccaaaataatacatttgagagagatttgtagaaacaaccagcctggggctgagatcctgggcagaaatttcccgtgagcatcaaaaggcgtcagtcaggccgcagctctggctccagttcccgaggtttgttgtctcctcacccccagctgccaagcatccccccaacacacactgatgggcccagcggtggaggggggggtggggacggggatgggtcacggggccctgacgggtcccgcagttaggctccctgagccctcggcttataaatacaggtcttgctttgtgggtgggtgccagagtcctcatgtggcttggaggaaatctttatttctcaaattaaaataaaattgcagcgagagttgttactgtggtgtgtctgagtcactctaggaaaactgttgccaagtttctgaccctggaaatgtaattctcttccccctcctcaccatttctacctggacagagtctgtttttcttcacacaaacacacatacacacaactgcagaaagaaaaaaaatccaaacaattgccaaaccccaagaactgttgccagagatggaggaaaggggaagaggcctggaaggacacccatcttgctgggcttgtccaaatctatggcttctaagagcctgaaaggcattagagctcttttcatccaatttacagacaacgaagccgagagaagtgagttggtgacagagctgagggaaacgtttaggcccccgatgaacggtcctgtgctgtgaaagctgccacactgttctagatcacacggaatattcagtgggttagtttttaaagggacactcagtgccctct

SEQ ID NO: 6152 - DNA, 1159 bp, Homo sapiens
cggtccaagtctagatccaggtctgcttccagatcgccctcccgatctagatctaggtcccactcaaggtcctaactggctatggccacagctggaactacccgagaagtcttttgtacatgtttggtagccgtagcacaagtgattggagtagaacatgtcactgctgtacatttttaactcccctaatggtgtgtctataattgttaaatctaagtgcttcctctcagtaaagcctcctggcaccaggccttcctgctcgactgaaaaaaattttctctttgaaaatccccttttactcatggcccacagtagaatatccaaaacgccttggctttcaggcctggcctttcctacagggagctcagtaacctggacggctctaaggctggaatgaccacataggtaggtatggtgagttcaaccatttttgctcttgaattgatgcccttcgatgtatgccatttagtgaaagtgctaagtcttaagtttcctaccactttggtttcatatttttggacttaacaaagttgtgaatagcacagtcgaggaaaattgatacctgcagtaacccataggaaataaactgtagagttccatattctggtattgtgattatattgttttatattaaaaaagaaaagaaaagaattttttttaattttatttttccccgtcttgcaaagtatagtgacccctgtttccattaaatttgaataaagactatttttgcttgacaaaatttcatggtgtttgaattgaagttgtactttctgatatatcttgatatgtcttttcttagcataaaaagttcatgtgtaggccgggcacggtggctcacgcccgtaatcccaacagtttgtgaggcttaggcagacggatcacaatgtcaggagttcgagaccagcctgaccaacatggtgaaaccccgtctctactgaaaatacaaaaattagccaggcatggtggtacacgccagtaatcccagctactcaggagaatgaggcaggagaatcgcttgaaccccgaggggtggaggttacagtgagctgagatcacgccactgtactccagcctgggcgacagagcgagactccgtctcaaaaaaaaaaaaaaaaaaagttcatgtgtaatgactgttttgttccttgggatcacc

SEQ ID NO: 6153 - DNA, 1164 bp, Homo sapiens
cagcctcaacctccttgggctcagatgatcctcccacctcatcctactgggtagctgggaccacaggcgtgtgccactacacctgactaattttttcaatttttgtagagatagggtcttctgtgttgtcaaggctggtcttgaattcctgggatcaagcaatcctcccgcctcagcttgtcaaagtgctgggattacaggcatgagccaccacacttggccccaaaactttatttaaaggaacaatttaatgtgtatttattgtctctcccacccacctaatatggctggtgctttaaagaacctcagtacatgattgatgggtagatgaaaatatttaagagtaaactttattctgcggaatgctggcatttcttaaaggaaaaattcactcagatgattgcattagatattttagcaaaacatatcctaatgtagtcacacttttttttttcttcaggattatatgcgtcaggcaggagaagtgacttatgcagatgctcacaagggacgcaaaaatgaaggggtgattgaatttgtatcttattctgatatgaaaagagctttggaaaagttggatggaactgaagtcaatgggagaaaaatcagattagttgaagacaagccaggttccagacgacgccggtcctactccagaagccggagtcattcaaggtactgttgatgtcttttgtgtgttggagctcatcataaattcattagtgagcacatagataatttatttacattttcctgttgagttcttaataacatgattccatctggttcaataacttagaattttgaactgaacatttatttgtaaaactcttgaactcttaggtcatgagtacaaatagaagtcccttctcttagaaatcagaggccttgctcacgcctgtaatcccagcactttgggaggccaaggtgggcgcatcacaaggtcaggagttcaagaccagcctgaccaatatggtgaaaccccatctgtactaaaaatacaaaaatgctgggcgctgtggcgcatgtctgtaatcccagcactttgggaggccgaggtgggtggatcacctgatgtcaggagtcgagaccagcctggccaacatggcgaaatcttgtctctactaaaaataacaaaatttagttgggcgtggtgggtgccta

SEQ ID NO: 6154 - DNA, 1171 bp, Homo sapiens
caagacctgccagtcattatcatcatcattttgccagaggtgggggtttgggtcccatgaccccaggttggaattgcaggtcattcttgaccatactcagccctcatctctctgtctctcccaggtggtcctgccgtcctacgaggaagccctgtctttgccatcgaagaccccagaggggggcccagcaccacccccatactcagaggtgtgaccctcgccaggccccagccccagtgctgggaggggtggagctgcctcataatctgcttttttgctttggtggcccctgtggcctgggtgggccctcccgcccctccctggcaggacaatctgcttgtgtctccctcgctggcctgctcctcctgcagggcctgtgagctgctcacaactgggtcaacgctttaggctgagtcactcctcgggtctctccataattcagcccaacaatgcttggtttatttcaatcagctctgacacttgtttagacgattggccattctaaagttggtgagtttgtcaagcaactatcgacttgatcagttcagccaagcaactgacaaatcaaaaacccacttgtcagttcagtaaaataatttggtcaaacaacagtctattgcattgatttataaatagttgtcagttcacatagcaatttaatcaagtaatcattaattagttaccccctatatataaatatatgtaatcaatttcttcaaatagcttgcttacatgataatcaattagccaaccatgagtcatttagaatagtgataaatagaatacacagaatagtgatgaaattcaatttaaaaaatcacgttagcctccaaaccatttaattcaaatgaacccatcaactggatgccaactctggcgaatgtaggacctctgagtggctgtataattgttaattcaaatgaaattcatttaaacagttgacaaactgtcattcaacaattagctccaggaaataacagttatttcatcataaaacagtcccttcaaacacacaattgttctgctgaagagttgtcatcaacaatccaatgctcacctattcagttgctctgtggtcagtgtggctgcataacagtggattccatgaaaggagtcattttagtgatgagctgccagtccattcccaggccaggctgtcgctggccatcca

SEQ ID NO: 6155 - DNA, 1157 bp, Homo sapiens
caggctgccagcctcacacagatcttccccgaggaagaggggctgctgccatctgccccagactgtgcccttacgagctcatctcttgttcccctcatccctgccaccagtctggggcttcaggacctcatgtcagatggatgggaggaagaaagctcctgattggctggtggtggaagaaagggtggggcttgagatgagcctgagccctgacttggcacccacagtgctcactgagatctcctttttggggcagagaggcactcaggctggtttccaggacaaacatttggtaaacacagcccttgaaatcatctagacactgcaacctcttgctcgtatcccagggcctctctctagctgggtgagagggtgtcccttgtcaccagcctgttttgtcctggtctctctggggttgttgaatctctcctcttgcctgccaagtacacatgtacccagacttcatttctttctgcatcttcccccaagaaacagcttcctgagggtgctggggcagccactggtgaggaggggctgctctgatgtccctcctatgaggggactctgcacagacaccattgcccacactatcaccatattttcactcagtcacacacaagacaaaagcatgcaatgacaaaaccatacgcaatcctgaccgcccagccaatcaagacatatcacagaacacacgcgtccttccaagaatgtttatcctcatgcatcacttacacacccccagacacgtactgcaatgcaagtcactagtcatggtcacatgacagtgacagtgtggcctcctcctaccccaaatacacccacactctggcaccacacacattgtctccagctttcaggcttactggggagggtggaatcgagccagaacaatcagcccatattgggtccccctaagttgccccgtcatactcagtcccatgccatggtgcccacaccaaccatgcagccgccaaccccagccagtgtcagacacaatcccatgtggatgcacagtctcactccacatgacctgctctcaatgctggagggaaacaggcaggcccttgcctttctcggaaaaagtgtggggccacagcccttttagggcattgcatgcaggtgggcctggcttcacccctacctgcttcctccccacc

SEQ ID NO: 6156 - DNA, 1175 bp, Homo sapiens
cttcgagagacccgtggacctggagggctctggggatgatgactcctttcccgatgatgaactggatgacctctactcggggtcgggctcgggctgtaagtacccccctccctacctctgcctgggggcagtgaccagtctgtatccagcctcaactctgagaagcccacggggggcttgcttcagtgaggcagggggcattcactgcctgggtcaggcaagttcttcttgctctggatccccagaacaagaagggcagaacatccttctggggatagaacaagacctgggaggacctcagggcccagaatgtccaggtctccagggtcccacgtctgcatctttgtgtgtgctatgtggctttctctgcagaccttgcttggttccggtggtcccgtcaggtgcaataagctgtggccaatggtggggttagggcagtgatgacacagggcaggtgcttcaagtggtgcctgggatggccccgccctggggaaggggagccaggtcagctgggtctagcagaatctcgggagagaagggcaccgcgaaccccactctgccatgtagcaactgtgtgcccctcggtgctccccctccctgaatccctgtattttcacctgtggatggtgagaaatacgacttcttctcagtgcctctaggagggtttgggataggaagctggggtctggcacagaggaggagctctcaaaatggtagcaaaaagaaggcagctgagactgggcccagtgagggcacgggctggcatctgaggagatggtacggggtctgcacgccacagagctggctccccacagccctcgcctctggtctcccctccttagccaagtcctttgagcctctttcaaattaatctttgtaaaacccgtttatattgggtcacatctctattcgcaaagttccctggctcccctccctcctgcctggttccgagcccaggagctggctgtggcttctccctcccccatcccctactccccatctcatttcctcccaagttccttcactgtcccggctttgcgtcagccagattgctcaagcagttcccctgcctcaagggcttcttttcccttttaccctccgcctctgcctctgggggaagcccttagtgtaccacccctgccttgagcttgtggtaggggtgcctttggggtctg

SEQ ID NO: 6157 - DNA, 1595 bp, Homo sapiens
acacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagctttaaaaaaaaaagaaaaaaaggaaaaggtttttagctcatttgcctggccggcaagttttgcaaatagctcttccccacctcctcattttagtaaaaaacaaacaaaaacaaaaaaacctgagaagtttgaattgtagttaaatgaccccaaactggcatttaacactgtttataaaaaatatatatatatatatatatatatataatgaaaaaggtttcagagttgctaaagcttcagtttgtgacattaagtttatgaaattctaaaaaatgccttttttggagactatattatgctgaagaaggctgttcgtgaggaggagatgcgagcacccagaacgtcttttgaggctgggcgggtgtgattgtttactgcctactggatttttttctattaacattgaaaggtaaaatctgattatttagcatgagaaaaaaaaatccaactctgcttttggtcttgcttctataaatatatagtgtatacttggtgtagactttgcatatatacaaatttgtagtattttcttgttttgatgtctaatctgtatctataatgtaccctagtagtcgaacatacttttgattgtacaattgtacatttgtatacctgtaatgtaaatgtggagaagtttgaatcaacataaacacgttttttggtaagaaaagagaattagccagccctgtgcattcagtgtatattctcaccttttatggtcgtagcatatagtgttgtatattgtaaattgtaatttcaaccagaagtaaatttttttcttttgaaggaataaatgttctttatacagcctagttaatgtttaaaaagaaaaaaatagcttggttttatttgtcatctagtctcaagtatagcgagattctttctaaatgttattcaagattgagttctcactagtgtttttttaatcctaaaaaagtaatgttttgattttgtgacagtcaaaaggacgtgcaaaagtctagccttgcccgagctttccttacaatcagagcccctctcaccttgtaaagtgtgaatcgcccttcccttttgtacagaagatgaactgtattttgcattttgtctacttgtaagtgaatgtaacatactgtcaattttccttgtttgaatatagaattgtaacactacacggtgtacatttccagagccttgtgtatatttccaatgaacttttttgcaagcacacttgtaaccatatgtgtataattaacaaacctgtgtatgcttatgcctgggcaactattttttgtaactcttgtgtagattgtctctaaacaatgtgtgatctttattttgaaaaatacagaactttggaatctgggtttgtgctttattttaacctctccccccaccccacccccagtgtagttccccaggacagccctttcctgctcat

SEQ ID NO: 6158 - DNA, 1101 bp, Homo sapiens
atccctctgggtctctgtttcataatcgttaaatgaaataagttgatttgttgatttcttgtttttagctttgatacattctctgcttataccactgattaaataattaggtatgcccttgttttttgttggacataaatatttccagtttttctctgttatagataggtgcagtgaaccatttgtatatgtgtttgagaaaaatgaatatttactgccataacactccctccccttttaaaaatgaatatgtatattctattgtctagtaataatatgttcctgttttgtaataatagagaagaacgttactacctgtcttaaaaattgtgtgttcattagtattcatataaaccgttatggtggtaaaagaaagacaggttttaattagatataaggacttaagtaacctgcagaactggctttcacatacattttatttctcttactgtttctcaaacaggatcaatatggaaattatgtaatccaacatgtactggagcacggtcgtcctgaggataaaagcaaaattgtagcagaaatccgaggcaatgtacttgtattgagtcagcacaaatttgcaaggtacgtgctttgagttacaaggactatttcccagaagagaggattagtagtattgaactataattatcttattttttaatgttgttgttgttgttgttgttttcaaagtatatatagcttaaaagtcaaatagttttattacaaagtataaactctgagaggtcccttagtgggcttcttactctgatagagtcagccactttgaaatctggggaatatgttactaaagaatgtgagtgttacactttgatgaactgaatattttattaacttgtttgtttggaattgtgaaatgttgtttattcagtttccctttttagcacctgaaagaaaggcagtttaccatatgcatatctatatataggccttagtattcttaggatctcttttccagtcttcatattgtgcaagctcaagaatgaaatgcagtagttattcccaggttgtgaaaggtgtcttaggtcacttataagtagcagaggttggagaaggaatcaatggcccttccatgtggat

SEQ ID NO: 6159 - DNA, 1100 bp, Homo sapiens
ctctcgattgaacccactgagaaaacaggctttcatatagaagtcttgtgtagtggggcagtaccccatttacaaatcttttttctgtatcccatttttctacttgaaccttttcaattgatgaaaggcattcttctagtccattttcttccaccttttccatagttcatgtggccgtcagagctttttaaccctcccttatcctataatatacgacaccataggaaggtaaatttggcatatgtttgatggtcatgttaacctgagccatgtcctctttattacttatctgcccctagtactgctacattaacagttaggctgtctctgctgacaaatttgcggtggtaaggagtctggatcaaagtgttaggaacaggtcactgggcttgttcttcgaagaacaggcctgttcttatctgcattgttttaattccattttagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggtaagaaccattactctaacaccaccttgaactctagaactctcttgccaccgatgacattacaagaactttgcataagcaaaggacagtccctttatactagaagtgtcctgggtgttctgtgccttccgtaaatacctcatgttattcaggctgtacctatagatagtatagcagttttggctttattatagtttgggtacattccctgtatattcagttagctttagtatgaacattttattctttggctacctgtgagagtatttcaatgtaaacaatataaacacaggttcatttcagtgaagctaggaaacacagagacagaatttaatcacctagtatcaccacctgaaataccaccacaattaatattttgccttatttcctttcaaaatttcccctctgctatatgtaca

SEQ ID NO: 6160 - DNA, 1130 bp, Homo sapiens
tccccaatccatacatcatcagcgctgctcccccagggacggacccctacacagctggattggctgcagcagcgacactaggtgagacattctgctgcatgagggattttctcacctgctgaaaagtcatttgagatgggcgtgcattctttatactctttcccaaatccatgtctccagtggagattatccagattttcaatgccatctacctgccagcttaatatctctccgtagctgtatcataggcccctcagacttgaaaatgttcaaaggcaaattaatcacatacgccttgcatatgtgtttttgatccatggagccaccagatactcatttatattttgggaatttccccccttgcccagatctcctaccacctctagtctatcatatagttcaggtacttttactggtctctaatgtatttataatttccttgcctctctcacctcctcttcccctctaaattgttcaagaaaatgatttcaaacttagatcttacctcttcatctttctgcttaaaccttttattgatttcccttttttctaccctagtatgtcatactacagttattaccaaacatggctgatcattacaacttacttggagtcggggtgggggtggtggtgttttgttccttggaatcagtatttttaaggagcttccagataattctgtgggttagctagggttgggacccacagtatatagggctctatcaccatgcctcatacatacaggtctctacatatgtaccacccaattcccttcctagttgactgccattggctaacaccatacattgtagcagtacagatctgattttagtttgctgcagatactgcattggtttaggcccctgtctttggtcactgtggtcttctgtagtaagctctttttcccattctttgcctgtgaagtgccctagttggctaattactgcactgtttttatttgcttgtgggatgtatacatgagttttttcccctctttttttttttctctttctttctctctctctcttttttttttttggagacaggatctcactctgttgccgaggatgggatgcagtggcgtgaatacagttcactgtaaccttgaattcctgggcccactggattct

SEQ ID NO: 6161 - DNA, 1312 bp, Homo sapiens
cgacatgtaaaaacttttttcattctgtttctttcctcacaaatatgccaggaagataaaaactttttagaatcactgagttgtggaatttcccccagaaaccaactttttccattgtctctgtatttaaagagtagatagagtagatgttgcattttgatgcattttgggatctgctttcatggatgctatagacagtgatttttccactttatttcagttttcctcaaacccggcccccttggtgaagggatgtaaattaatagcaattaatgtgaatttaaggggtgagttatatggaattgccggcaatagaagcatcaatttagaagatgtaaccctgtaagccctgtaaagtatctctggttattttatagaaatagttttaaatactgttgataatgagctatgttgaggacattgtccttaaacttgggttgctgtagtccctccccactgaaaataaggtttaatgccctttactttctctgtttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtggactcagcagcagcaactgtgggactttttgactacaattctcaacaacaggtactgtgtgtgtctctgtcaccctctctactctccctccagccagcacgttgttcaagtaattaagaatggggggatgggggaggtggtggcattgtttcaggctatccatagctagcccttgtgaacctgttagtgatgtaggtttacagagtcccctcatgaagctggtccctatgctgaggtcactggcaagaggccaccgtcctctgtatgtacttcctttggttcttctctctcctcagcagctggggagtggatgaggtagtattgcctcttgtaacacaaccctctcgggtgctaaattaatctctgaagatttatgtggttgtgatgctgttggtttgttttgtttttaaaatagtaaactctactatccaccgctgtcaggagtgtagtgccaggtcatcttaccagttgtgtcttacagttaaacaagttactccagatagcatagacaaggatctggcatctttcaaaagtattagaatgcgatcagaggaaaccacacacacaaatcattcaacttaaaatctaccatgaaa

SEQ ID NO: 6162 - DNA, 1080 bp, Homo sapiens
gtaagggaggaatttacatagtgcagtggagaagtatgaaattctttttacaggcttaataattttttttttctatgctattagctgtcatacctggggcttattaagagtcatgctattatacagagttaggtttgggagtagagaacttgaccaagagctgcaaagttatggctgggctttgggtaggaagaaaaaaaaggaaggaagaaaaaaaaggaaggaagaaaatgggttggtgggacattggatatagtaagactgttctgaactctgtaacataaatgtatgtctgtctccctcatttggcaagaccttctgcagtgttcctgcctctgtgttgtttgttaattagattgtaatgtgtgaaagggcacaacactatcctcttctgagtagcatctagtgtagtctggtgcccacaacggttgcccgttattattagttgatgacgattagtgaagctgaagctattttttaaacagggcccaagggatgcagacagtgatgaaaacgacaaaggtgaaaagaagaacaagggtacgtttgatggagataagctaggagatttgaaggaggagggtgatgtgatggacaagaccaatggtttaccagtgcagaatgggattgatgcagacgtcaaagattttaggtttgtatgttttacacttctgatttttgaatatgggctatgggattttgtttgttttgatttagttttactttgattttcgttttcttcccctcttcatgttttctttttaagaatccaatctagtgtaggctatgctacaaagattgtaaattaactggtgaggtggaattttctaaaaggtgtcaatgcctgaagcgttgccaaaatgatagattttgcatttgcatagaactttaaaatctgaagaaagattccagagaagactatttcagtgattctcagatattaaaatcacctaggatagatgccttggaacctttcttaagtttctcccaaattaccgtattagagagctatggttactaatggaatatgtcatatccctctggtggtttagagggaaaaacagttgagaacttgtgcat

SEQ ID NO: 6163 - DNA, 1105 bp, Homo sapiens
gagatattgggatacttcattatagggtttgcatccccctttcctgaggtttaccaaagagaaatagtggattgaatcaaatgcactccctaatttaacttaactgttcacaactggggaggagccatgatcttttgactcattaggtcacatagtcatcttgaaggcatcattgctcttcagaatgttggtcttattaaattaaaaagtatgagaaatagctaacataattctcatgatggaatttgctttttcattcatttggattttgtgtttttcatgttttgaaaatataagggaatgggaggggagaaagtaggggtcattgctgaaccctgatggttaaaggtaagtgaatgtttaatctcttagtcacttgatcattgctattgtctttgccaatgtctgaaagtaaacatagaataaattttcaattgtgtgtaatgtgtatgtaaaattcaagatgctgacttgaagatttttccttctctattctaaacaataggtgcgttccatggatgaactgaatcatgattttcaagcacttgctctggagggaagagcgatgggagaggtaagtgaactggtgtgtcagaaaagtgggtctgtttttaagggaaggttggagttgtctttcatcaaatgtgtccaaatctagtctccagaaatatgtgcttgcttttccttgttgccattctcatgataggaacgggatgctggagaattttgccaaaactatgtcattaaaagaagaatgttaaccataacctaatgtcttaaaagcaaaacaaagtagccaaaatgtgagcacaaattattgaatattaatgtcagctataaattgagacattttaagtttaagaagtattttaattttatatgcattaaataaaaggccaacctttacttcattttccagtggctaggttttcccccaacccaccccccccgccaatggcaaagggagtcttagattggctgctaatcagaaaatgtcagtaacctatttttagagtagtgcctttttttgaggaagttgtttagagctccattgtgaaagggaagttgttaggtttctagtggaggaattacagaaggtagagag

SEQ ID NO: 6164 - DNA, 1540 bp, Homo sapiens
tttaactcaattccctgagctagactgggattaaaattctcattttgcagtacattaaaactgaggcccagagatgtgatttgcttgaggccacacagctagatttttggtggaagtgggccttgaacacagtgtactttctgcagtttctgactgtaaaacccagtgtctgctctctgagttccatttccaagcccccctccatcttggacctatgtggtctccaccatattcacacaccaccaccaccacttgccaatgcctctcttaaagcaatatacccattcgttctcttattgggaactggatggatgaagccccaaattcagccccacccacagagaagccttcctacactcagcctctgtccacccttggcaaatctttcaagctctctcctccaggaaagtggggccccaactcagtcactccacccccttccaggtccctgaggctggttctactgtatccccatcacctccacaactccactcacccctgacggctccatccacctcaccagttggaaggcttgtggtttcagagaggagcaatgctggtcagcgctgcccagactccagtgtttacagatcaccagcatttacaaccaatccaatggccagaagcctcctctaacaagcccagaaggagttctgaaggggcagatgggggtgtgagtagtcggggagtcgggattgccagcaccctcacccttccttgggggcaagtagaggtgagaacactttccccacctccctccacagacactcctgaggacgctgcatcccacgcactgcctggtgcgtccatagagagaggatcaggtctcagcatttcatctgtgaaagaggcatggccctgggttagaaaggagggcaggagacatggaggaactggggggcacccagatggtgcagatggtttgcacacctgagcctgtctgtggtgaccattccgctcctctcccactaccctccaatctatcattccctactctctaaggccaaaatatcctgagcaaggctggcaaccccaccccaccatcccaaatgcaagcagccaggcccaggagttcctctggcccccacaggcatggagctcccagctggtgggtacagcttgagaggggggcagctccctcaggctaagctactgcccttcactgggccagccctgcctccagccctcacctctctcaccccaactctcccccaagcccctttctactcaacgggtgtagccactggtgctttgaagccttttgtttttataagatggtttttgcaaggggaccaggttctcttttcactgggaccttgcaaggaggggagtgctctcctggtttctgtgcaggcgggttgattaaagatggtgttttcttctctatcttcctgtcctgcccattgggtctatagaactttctaagtgagaagtccctgcatgagggcaggcaggaatgatttgatgttgatgttatcaaatattcctggggtggccaggcacggtggctcatgcctgtaatcccaacacttttgaaggc

SEQ ID NO: 6165 - DNA, 1237 bp, Homo sapiens
caaatcacagggcctggtgagctcatggtacaggcagtaggggaaatggaaatctctaggcattttatccctttgcctgctctggccaccccttgccctagaaggacaaaaattctgagattttcaggataaggattggttcctaagcctgttttttgggaggaggtgggcatgttccacagccccagcctgaaccagagatgtgggttttcaattacacaattaaatgcacaattaggcataattaccagtgctcagagcccgagactgctcataataggcgtgtaatctactgcagcctctgtttatactactcagcgcgctccctaatgatgccaggatgccttcacactgcactgttgccatggagacaagcccgccaccaccatgcaaagctgacaaatggtgttctggtcttgggcctttggattgtttctgaggcttctaacagccagcactggagtggaggggctggccagggggacaggaaggtggggcaaccctccctggactctgacacaccccactggttcaggccagcgttggagccaccagggaggacaggggagaggagcatcagccacctctcacccctagagtcctcaagccatgagcaggatggcccggggccatgaaaggtcttgtggttatccattcatacatctcacgctatcatggaatcaaaggtctggacagggggtcctgcctacaccaggttcaaagataggcctggctctgctgtgaactggctctgtgaccttggttgggcaagtccttggccctcttgggggctgtgcttccccgtatataaaatggactgcagggtctctgcacatggcatagtctaatagagaagatttactgagcacttatgacccacctcattctgctgtaactgctttacctggagtggctcattcatcctcatggcaccctgtggggtgggcacagctactacctctatttcaccgaagcagaatctgaggctgagagcagtcacatccagcagtggcagagctgcgcaaacccaggtcttgcccttaaccccaatgccacatagcttcacatgtgccacctgaggtcatcctcacaacagccctagaggtggaactttgtcacacccatttccgtttcctagatgaggactctgaggctcagagaactgaagtcacttggccaaagtcacgcaacgaggcagcggcagagcacagtctggctggtgccaacagccagggtt

SEQ ID NO: 6166 - DNA, 1561 bp, Homo sapiens
tctttttttctctttttagagatgagatcttgctatgttagccaggttgatcttgaactcctggcctcaagcattcctcccacctcggcttcccaaagtactaggattacaggtgtgagccactgcacctggccaattatgtgctatgattgttaaaagcaaatatacacatacagtgttgatttttaaaattttcttttcaggagaagaagaaaaagaaacatagagataggaagtcatctgactctgacagctcagactctgagagtgatacaggcaagagggcaaggcacacatcaaaagacagcaaggcagcaaagaagaagaaaaagaagaagaagcacaagaagaagcacaaggagtgagagtataaagagtgtagggggtggttgagagtaagaaaccaggagccttgtgccttgagactcctggaaagactcaatagtgagaatatagcctcccaccccattaacttcgctcccatgggagatggcttcccctcatgcaacaggcaggtttgggagttagaggtcaaaagcagctgcctgaatgagttgttgtttccttatcactcctggtccctttgcaagtgaaccctgcagctcacccattcattcacccaacttccttcattcagcaggaggtcctattaccctctccagctgccactgccagagctggattcctgtaaaggagtccaggctagagccacagagactgttgtggaggtgagttcggctgtagttagagtgattggacccttcctattggtctgtcctgggccaactggtgggtgatctctgctgcatccaacatgggagcagagactggcagcaggaggggggaacatggtgagaagtggtgctcacttttcccattcctcctaacatagttctactatgctagaagtggcatccagcggccacagctagaaaacagtctgcagtgtgacttaacttgtgtattgcattccagcagaccactgaaccagacagcgaagccaagatcattgttctactttgtatttactactgtgtgaatcagttgattctacttcaggtccttgcttaaattcctgtcactaaatggaaatgtgtttggttttaaacttactgagttatttttcctataatccttcttcctgggtaacttacagacttaaagtcactgagcctgcattagctgacaaaaacatttaatatgttaccttagaccttggagagatgcccagcagaggtacagagccaaaggcactagcagatcactgccttcttgggagatcacttataagccctcccttttgtaatgatcagatgccctcttccctcagagttgattagagaagcagtaagaatttgtagtcataagtactagcctggtgcacaggtcagcagtcctcttggccagtggtcattttctcccaccaccatggtacaagcctgggttctgtgccctgaacctgaattctggaaagggagagactacagcatttcacagagaacagccagacccaagagctttcagtgtaggatgggcctgaagtgacagttcaatagccaaa

SEQ ID NO: 6167 - DNA, 1225 bp, Homo sapiens
ccgctagactaagcttgcaatctgagctccattcaccccctcctatttcttgagaccttgtcagttcccctgtgagcctcggactcctcacttgtaaaacgaggacagatgcccgtgccagaagtcaaccagagctttccccggcgtgggcaccagcccaagggcgttttgcttttctagtctcatctctgctctgacgctaagctcaaagagggactgggggacgggaagatatccaccatggcatgcgccctagctctcgggctggtgttggctgcttccttctcagattccagagtgcctagaggccaggaaagggagaaggtcctaccagcctggggtagggactcgggggccaggcactggcgctgacgcaggctagcagggcgccactggctggtccccacccacctcggtgggttgggggatgggcgcaccagcccctcctgggtgagccctagcctggggcttcctatttcgggagccgggggcgtgggccacgtctcctcatgtgatgcgagggctatttaaagcggcagcccgggcagggagccgccgtcggagcccttgcacgcctgctctcttgtagcttctctcagcctagcccagcatcactatggtggacgctttcctgggcacctggaagctagtggacagcaagaatttcgatgactacatgaagtcactcggtgagcaagccgcggggctcaggatgttggcttggggactggctggtggcgtgcctagccccacgcagcactcctgccgcatccctcctggttaagactggggaataggggagcgcggagatggcagcctggcctagagcaggtggggcctgttcagagggggctttggtggtccaaatctggttagagaccacggtagggaggtggtggaaggaggcagctgtgtgggaggctctttccaggaagagggatatgtgatttggaggtaggaggagggtttggataaagaacactgatcacaggaaagggagtgtagccaggggagaaaaagaacaggggcatgggtagtttagaaattggaggagactgaacccagaaagggaatggggcagccagggagtgtacaatgatgtaaacaagtaggaaatacctaggaggaaaaagattagtggggaaaaaactgtggatcagtgaatcagatatgagaaggacgtaagacaggaacctgcagtaagcagcaatccccatctctgctt

SEQ ID NO: 6168 - DNA, 1151 bp, Homo sapiens
tgtggagctctcctacatcatcaatgtgagtggagatccatgcagagaccttgggtgcacctcaacctgggtggccagaggcctggctggtgggaagcactctgtccctgatggtgggctgaaccctggacctgtgtgggagctgctgtggcccccatggcatgggcagtggtggggtgtggtgagcttccctccctagactgcactcatgtcttttgctccccaggggaccacggatccccattgcgccagctgggactactccagagcgtgagttgggtggctcctctgggtgaggaagggagcagccctagggccctttgccagaaaggggtctcctgcctaaaaggcaagagggatttttggtgccatcctagcctaaggggtcaagaacgtatcctgggactccctgctgttgcctcgtggatgtggccttactgtggatttagcctgtccttgggcagtggccaggactgggggcagggccacgtagctggcctggggctcactgaatctctcccctacccaagagatgccagctcaggagactgggacactgaaaattgccagaccctggagacccaggcagctcacacccgctgccagtgccagcacctgtccacctttgctgtactagcccagccgcccaaggacctggtgagtggaacagaggtgcctgggctgaataagggaggaggccctgggcttccagcagccatcagtgatggtgttggcaggcgcctgggtgatcctgaatgtgcatctgcaggtgcgcttgtgggattgtacgtggatgtctgtgcccctgggattgtgctcacagcaatgatatttgcctgggggtatgcggcagtggccagttgtgtgtgtgtgtgtgcacatgtgtgtgtctggttgtgtgtagaagagtgcaggtgactgagcataaatatgtgtccacatagatacccgggtctgttctgtgcatacatgagtacaacagcaagaaggtgttgcccttctgcctgtgggtatgccagtctatggtagatgaggggacagggcacccctgcagctcccccctcccaggaacccatctgactgtctgcccatcttccccagaccctggagctggcgggctccccctcggtccccctggtgatcggctgtgc

SEQ ID NO: 6169 - DNA, 3422 bp, Homo sapiens
gcctggcctcacctgggactcttaagtgatctattcagggacaaaatcaggatggtagtgcacagacaggatcttgacattgatctggaataacgaatcatgctattttgttatccagaattctttgacaatttttgtcttgccctttccctttcaacccttcctttaaaaaaagaaaacgaaagtagaaactattctgatctttattaaatggttaatagactataatgacagtcagcaagaaaaatttttctattccttctaggagggcttagaaagttcatgttgcaacttagctctttaagaattgttgtagtatgggaaatatgctggttttcagctgtgtggaattagaaaggctttaggatgtaaataatgcatttcagtgaatcagacagctctttttttacatgataaagtttgccattcttgtattttcagaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaaacaaaaaacaacaccaaaaaaacagcagtgatatatatatatatatatatatatatatatatatatatatatatatatatatatatatatatatataatataatatatatatatatatatatattttccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgctctttgtgcatttttttcctccatcctcaagagtttatgtctgtgcttataaagcggagtttaagctgggtgcagtggctcatgcctataatcccagcacttcggaaggccaaggcaggcggatcacttgagccccaggagttcaagaccagcctgggtaatgtgttgagtccatctctacaaaaaaaaaatgtttaataattagctgggcatggtggtgtgtgcttgcagtctcagctacttgggaggctgaggtgagaggaacacttgagcccaagaggttgaggctgtagtgagctgtgatcatgccactatactccagccttggtgacagacaccctgtcccaaaacaacaacaacaaaaccaaaatttcacttacatctgttcccctttctttgcctgctattttcaaggactgttttgggtcctgctagtttactgc

SEQ ID NO: 6170 - DNA, 1232 bp, Homo sapiens
catcagccaccacacctggctcaagtctctgattttttttttttttttttttttttgaggcagagttttgctcttgttgcccaggctggagtgcaatggtgccatcttggctcatcacaacctctacctcccgggttcaagcgattctcctgcctcagcttcctgagtagctgggattacaggcatgcaccaccacacctggctaattgtgtatttttagtagcgacggggtttctccatgttgatcaggctggtctcaaactcccgacctcaggtgatctgcctgcctcagcctcccaaagtgctaggattacaggcatcagccaccacacccggctcgagtctctgatttttaaaactcttcataatacccctttatccaattcttcatagatggtaataacgtataattggtgacatttcacatcgctttgggcttataaagaatgtattttgacttcaggcatttgtgtttactgtgccatcagcctctagttcattttacttattcttttcttctccaggtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggtaagattgtggcatggtc

SEQ ID NO: 6171 - DNA, 3624 bp, Homo sapiens
gtggtgacttccttccctttatcttttttcattcttcccggtcctctgccctgatctgtgtaactcttatcttgggtacttgagcagacggtatattccagaggtgggaggtgggaggggaagggagaaatccaaaacaaagtgttcttgctctgacagaatattaatcttgtacgcttggattgagttatttaatttttttttcttttgcacatttttcttgtattaagattgctcttcccaagagccacaagttcctggttttagtaaacccagctgcctgcattgcctgggactagaggctggggaggctaccatgaaacaaaggtccctccctccctctgactctttgcccagacctctttagtttgggggatcctcctcactctcctgaagtgtctcaagtataccagtgggagtgcaggggaggagcacaggccttcagatggggcttcccacgtgtagctactgatcccatatttcctactcaccttccaaatggtgcgacccaacttcatttgtttacttgaaaattccccctcgaggttgagagaacctctgaggtggctgtattttctcctaagcttgagatagggggctgtggtccttcctttctcctgaggagaaagtccttgctctggtgacctgtaagttgcagaggagggtggagtgagagtgtcatgtattgggatagtcagggatccctgcctttggcctttcttcttcttcttcttcctcttccatagttggatcatgtatattttacttctaaaggagagaatgtcaaaaagttctgtatttttttatattctatatattaggtaggtcaatcttaattggtctcaagaggaagaactgtctgtcatttcggtaagtaggatactgtgaggaagaccaaaaagagatatggatgcttcctcgctcaggaggcctgagcttggtccttttcctctctgcttggattctggaccaccacctgggaccaaccttcagctctggaaccttcataaagcaggtcagcgtggcctgattgtcccaggacctgaagggagcaaggatggcctcagggcctggtgaagtctgctactctgtccttactgctgaacatcctgcttgtatcaggaaactcagaagcagtttgccttgtcaaattcaatctcaatggccattgtccacataactgatcacccatggctgcctctcctattatctattatcactgaaacttagtagcctgctttttttttttttttttttagagctattgcgtatcttccctgtttgggatccttgtacctggtttgggttttcccttccttgtgacaattataatccagatgcctcttctttctgtttgaattacggtagtgcattgccttagtggcttgcctgtgcctctgggtggattacatatgatagtaaagcccacctgtttggatgggagtagaggaagttggtgtagaccagctgtggagctgaaggcacagtctgccccacccccacctccccactgtggttagtcagaggcatcctgctccaagctctgcttttccttcctctgaaacaatgccattcttgcttctattgctacacatctccttctggctcaggtgaaatccatgcccttctgcttatagacctaaagttcaggtacttattattggccattgatcttgaatttgccctctcctagtgctgcagtcccacttcaaagccattttctgaggaggatggtttaggtctggcaattgtccttgaaaaatcccacccatgttgtaccaccttggtgagtcatatgccactcatcagcttgggaatgatggctgccaactcccaatctcccaggaaggcagggggcagaatctttttttcacttggcctgctacctccattaaaaaaccattctcttacagtttaaaaaaaaaaaaaaaaaaaaagccttcccctacccaacctccgcccattgttctcttccaaagggcaatttagtaggatctactttgtacatctcaagtaagagttaagtccctgatacagggaccagtttcttagtgtaagacatacacatcctgcttgtccagctgttcctccaaaatctactttggcttcagctccgggtcctgtaccagatggaaaatgtttttggtgatctggctgctgcttaaagccagttttccctaagaactccaaaggctaaagtctactaggggcagagtgtgaggatagatttctaatcagagaaaagtggcctccaggagctttcatttatgtcttctccagaccaggttttcctgttatcttcctttaatcccctttcaaccaacaggtgaagttcttccagcccacagaggtagtaatatcatcttttctatctcctcctctcctttggccatgtaatgaagcaaaatattatttatttagcccaggcttgagagccactgtttgtggacagtcttcatctagattccataccctggcctaggcgaggtaaggctctctggttattgccaggatggagcccctctaccccagtctgctgtagggaataccctaattagttgaggcatgcttttggaatcctggcatgttggcatatggctggtctatcctttttaagatctctggttgggggtatctggatatggattaggagggacaaggagcctttttcttggctaatgttttccaatacttttttgaatggtgccagcccctccaggcatcccacccccaaatcatcatctttagtactaacagggtgtctggtcttagaagcctcccttcagatcccagctgaccctggtgactgcctggccttgatgttggctgcagccttctgatagaaccacatggattccacccacagctggccaggcttgttacatgggtcagggaatacaaatggcccccccccagggagcaggtgttggcctcagttttcagggacccttggtgttgctccttacctagagcccattaatctaccccatcaactctctgccatgaaagccatcttccaggagccctgttttttggagctgaactgcacagattatagctgctattgtacttaaataagggagaggaaaagaaggttctcaggcacagactttctatttttctcaagccaaaccagtttaaaatgtctagcagaatgaactgtatttccatttcttcatgtctacctgccttccccccacaccctaaagttgtacttgtttctagcaaactagaaggaaaagataggaaagcctggcactactaacctcacctctcatacacctctttgaaggccccagctcttttgttcaggcctctcttctcccctagactcactcagcttggtatccatcatcttgagcattcttcagtagattcatctagggttcagattccagactctcagctgaagacagggagccaatttcccccaggtccctgcaggtaatccagggaccccatagggagaacaggctgactggggcattaggaatgtttgtacctctctgcttccctggcagcctggggaagggtgcagggctcagtgcgctaaaccatggtaaacatcttcaatagaactaccctagaatttagtgagtgtgagactgagatattgctcagaat

SEQ ID NO: 6172 - DNA, 1881 bp, Homo sapiens
ttgaactattgactgggccccagaaatccataaaatggctgcagacagttgtttctgtgtcctgttctacccccactccagtacataactactatgtactgtgtagagccattctatatgctgaatgttctgctgttgcaaacttgccagggtattagccagtgtttgtgccaagcagttttctgggacaacagaatgactcagaccaagatggataggatggttagggctttgcttcttgctgtttttctttgaagctagttcattgtcctgcaggtcccttcatcttccatacctagcccactcttttagcccttaccttaaatctctcagataagttggttcacaaagaatgttaagtactgaatcatgtgtgactgagaccagagatggcaaatgaatggcacaccatttctccttctcctgccccagggcaggtaccactgatctgcatcagagttgcctgctattctctggtgtatccttcacatctaggtgccctcaagcagctgtgtgagtgttgagatctctgccatctctggctgagatactgctgtcctgtgaagtgtttcccatgacctttttcttcccctttgaatccctctgtctggagtagtccttgcctcttcctgctccagtagggccttttccctaccccagcccctgtgccaggctaagctggtacaagagctgccaacctcacagagtgtttgctaggcgagagaggtgcagggaagaggcagaggtatgcaccttcccccttgaagagaggggaaaggcctacagtggcccacataattgcctgactcacacttcagctacctcttaatgcctgtggagggactggagctgctggatcccagtgtggtggtgtaggaggccacagtgagcaggtggccccagctgggtttcccaggtcaggaatgtgggccccaggcaaggtgcagcctttgctcacagctccatccatgtctagaccttcaggccagtctgcagatgaggttccctacctttttcttctcttcattgaccaaatcaaccaatcactacagctgctctgcttctgctttccaaagtagcccaggtcctgggccagatgcaggggaggtgcctatccatgagtgaaggccagtgtcttcctcacctgggtgggtcccacacttgtgacctcagttttaggaccaagatctgtgttggtttcttagattgctagcttttcctccaggggaccacagcaggtgaagctcaagagcgcatggctctgctaatagtaaattgttttcagggccttgtccagctgagagcttcatgtccaccagattctgagaggtgtcagcagcactttttttttttatttgttgtttgttttccatgaggttatcggaccatgggctgagctcaggcactttctgtaggagactgttatttctgtaaagatggttatttaaccctcctccaccccatcacggtggccctgagggctgacccggaggccagtggagctgcctggtgtccacgggggagggccaaggcctgctgagctgattctccagctgctgccccagcctttccgccttgcacagcacagaggtggtcaccccagggacagccaggcacctgctcctcttgcccttcctgggggaagggagctgccttctgtccctgtaactgctttccttatggcccagcccggccactcagacttgtttgaagctgcactggcagcttttttgtctcctttgggtattcacaacagccagggacttgattttgatgtattttaaaccacattaaataaagagtctgttgccttacttgtttctctcctgacctgtgtattcctttgtttctggatctgatccattcagccccttccatcat

SEQ ID NO: 6173 - DNA, 1378 bp, Homo sapiens
tcccatcctgccctttcctctgcagctgttttgcttccttgtggccatcagagttcccttcccctggacagtctggagaaagacagaggctggggtttgggattgaagaccagaccccatctgagcccttcctccagccctgtaccagctcctactggcatggctgagctcagaccctcctgatttctgcctattatcccaggagcagttgctggcatggtgctcaccgtgataggaatttcactctgcatcacaagctcagtgagtaagacccaggggcaacagtctaccctttgagtgggccgaacccacttccagctctgctgcctccaggaagcccctgggccatgaagtgctggcagtgagcggatggacctagcacttcccctctctggccttagcttcctcctctcttatggggataacagctacctcatggatcacaataagagaacaagagtgaaagagttttgtaaccttcaagtgctgttcagctgcggggatttagcacaggagactctacgctcaccctcagcaacctttctgccccagcagctctcttcctgctaacatctcaggctcccagcccagccaccattactgtggcctgatctggactatcatggtggcaggttccatggactgcagaactccagctgcatggaaagggccagctgcagactttgagccagaaatgcaaacgggaggcctctgggactcagtcagagcgctttggctgaatgaggggtggaaccgagggaagaaggtgcgtcggagtggcagatgcaggaaatgagctgtctattagccttgcctgccccacccatgaggtaggcagaaatcctcactgccagcccctcttaaacaggtagagagctgtgagccccagccccacctgactccagcacacctggcgagtagtagctgtcaataaatctatggtaaacagacaagaggttagtaagtattcttttattgtgacaaaccctctcccaggcttagtcagctactcctttctctggccagagaatcccataaggaaatagcccccacagccagggctgctctgctcagaggaagggaaggctgggctgtgggtttaggagcaggagaacggggagggctgaggaggccgcagtgtaccctgtgagcccagcggaggtgctggctcctgaggaacaagctgctggaggctaaggacaaaaggtggccagagtagtggtccccagttgccctctggagctgctggctctcaagatggcagagctggggctgaggctgagatagcagccccagccccaggctggttttccagggacaaggcctcttccactatctgtgctgccctctgcaggaggtggaaggccatacagaatgg

SEQ ID NO: 6174 - DNA, 1197 bp, Homo sapiens
tttcaccatgttggacaggcttgtcttgaactcctgacctcaggtgatccgcctgcctcggcctcccaaagtgctaggattacaggcatgagtcaccacacccggcctggccattttcaagatgagaaaactgaagttcagaggagagaagcactgtatttgagatcatatagtgagacagtggcagagcaggcaccagaacccagacttccttactaccagctgctcccacttggataagacatcagagatactgtttttctggactggagctcaacttggccttttattctttggagccgttgggagtcccaggagagctggagctaacaaatgaggatgcctttacaagccgcctgactcctctgttgcttcccttcaggaagggaggagaatccaggagttggtctttttaccagctccctgctgtttcccaagaaataaacagaagagggcagaatcagccttgctacaggctgctgagggttcctggggcaaaataggaagccattgctcttactgggatgtgtactatcctgtggtttgacttttccagatcgtcaatgtatggtactctgtgaatggtgagaggctgggcacctacatgggccataccggagctgtgtggtgtgtggacgctgactgtatccttattttgggtctgagtccgtgttgctagggtctgtcagcgatggagaggctgagttgggagttgggagttgggggtgctgttgagggcctagagaacgatacctcctactccctggtctcttcactgactgaggaaacattcaggacaaattccagttctggataaggaggtaagaggggtagaaaggctctttggggctgaacagggagatgattcacttggcatcccaagaggacaagggctcgggtgaacttcgtcatatttcttaacaactcttcaggggacaccaagcatgtcctcactggctcagctgacaacagctgtcgtctctgggactgtgaaacaggtaagctgggttcattcacctttttagcaaatattgaggacctacagtgtacctgtttgagtaaacaggtcctaggaaaatagagatgaaatccatagatagtttccagtctagggaataagagacaagaaagatagatgagaaaatacacgccatggtagaggaagcatagattaagttttctttttttttttttttt

SEQ ID NO: 6175 - DNA, 1177 bp, Homo sapiens
cagaggacggggaatagattttaaacgtccttcagtgtgaggaggtaaagagttttgactttcctccaggcagtagggaatctttaaagggttatcaatggccagattttccttccaacagcttttgcagtttatgtttggagagtgaacctgaactagccaataggcataggatgtacattactggacagagtcaagggatatttaggggtgactgataggatagagggggtgaggaaaacacaaagtccatgctgtctcagctttcatttgggtgcttgggtttctggggagctgagattagtagggattgggcccattcagtgtcactcttcttccttccctagtctggagaggtgttggtgaatgttaaggagcactcccggcagatcaacgacatccagttatccagggacatgaccatgtttgtgaccgcgtccaaggacaacacagccaaggtgagcctgggcagcggtctggcagggctgctccctccctccggctgcacagctcaccctgcccgacttcccccaggaaagctctttacagatttcccccctgccttctctctccagctttttgactccacaactcttgaacatcagaagactttccggacagaacgtcctgtcaactcagctgccctctcccccaactatgaccatgtaagagaaccccacctgccttcctgctgaagcctcaggaagcttccaagttctagatgcttgtccagaagttgggctacaacattgtgggggaaatgatgtcaggcagagaggagatgcccagaggagtgacaaagctggaaggattgaatagccccagggcagccagcaggaggtggcagaagtgtctgatcatcccctacctttggtatcctcccattgagccgtgtgagatgttaaaaatgtatatggcagcagaaaaacacaaaatggacttggtgtccattggtcccatctagagtttcttcttccattcaggtggtcctgggcggtggtcaggaagccatggatgtaaccacaacctccaccaggattggcaagtttgaggccaggtaaagaagaagagagctcttccaaattaaaatctcatgtggtgtaccttttttgtttgtttttgtttttgagatggagtctcgctctgtcgcctaggctggagcgcagtggcgtgatct

SEQ ID NO: 6176 - DNA, 1190 bp, Homo sapiens
ggaaggagctgcctgtggccatctccctggcattggagcaccagcccctttgtcccaccactctgaggaaaggcacagggacagctggtccagcttacaaaggcctctttcagggaccagtctgtccagctctgcagttctaggcagagctaggagccccagcccccagtagtcacctaggatcctgtggaagtcactgtctgcacttttgccctgaggctctgggctgggtcatctcatgccagtctctgctctctccacagggtcaaggaggaggtcaagttggcctgaatggacctctccagctctggcttcctgctgagtccctcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaaccataaagggtgccaggtctgggtgaaagggatacttttatgcaaccataagacaaactcctgaaatgccaagtgcctgcttagtagctttggaaaggtgcccttattgaacattctagaaggggtggctgggtcttcaaggatctcctgtttttttcaggctcctaaagtaacatcagccatttttagattggttctgttttcgtaccttcccactggcctcaagtgagccaagaaacactgcctgccctctgtctgtcttctcctaattctgcaggtggaggttgctagtctagtttcctttttgagatactattttcatttttgtgagcctctttgtaataaaatggtacatttctatatcctcctgagcttgtttcctatgtgtccctgggttggtttcaactctacttccctgccgttctggtgtccatgagtattggggcaaccccctgaacaagaaaaccccataaacttacctgcctgccttaactcctcccttgaggtttgaggtaaactactttccaccaatcttctcaccctacccccagaagaccactcattaaagcaccactaaagggacgacatttattccttttccaaatgttacagtaaaaccaggtggaagagaatggttttagcagttagaaaaaaaaaaaaagtacaaatctggggtttg

SEQ ID NO: 6177 - DNA, 1519 bp, Homo sapiens
atcgagccagcaccccctagccagggtgctgaggccaagggggaggtcccccccaaggagacccccaagaagaagaagaaattctctttcaagaagcctttcaaattgagcggcctgtccttcaagagaaatcggaaggagggtgggggtgattcttctgcctcctcacccacagaggaagagcaggagcagggggagatcggtgcctgcagcgacgagggcactgctcaggaagggaaggccgcagccacccctgagagccaggaaccccaggccaagggggcagaggctagtgcagcctcagaagaagaggcagggccccaggctacagagccatccactccctcggggccggagagtggccctacaccagccagcgctgagcagaatgagtagctaggtaggggcaggtgggtgatctctaagctgcaaaaactgtgctgtccttgtgaggtcactgcctggacctggtgccctggctgccttcctgtgcccagaaaggaaggggctattgcctcctcccagccacgttccctttcctcctctccctcctgtggattctcccatcagccatctggttctcctcttaaggccagttgaagatggtcccttacagcttcccaagttaggttagtgatgtgaaatgctcctgtccctggccctacctccttccctgtccccacccctgcataaggcagttgttggttttcttccccaattcttttccaagtaggttttgtttaccctactccccaaatccctgagccagaagtggggtgcttatactcccaaaccttgagtgtccagccttcccctgttgtttttagtctcttgtgctgtgcctagtggcacctgggctggggaggacactgccccgtctaggtttttataaatgtcttactcaagttcaaacctccagcctgtgaatcaactgtgtctcttttttgacttggtaagcaagtattaggctttggggtggggggaggtctgtaatgtgaaacaacttcttgtctttttttctcccactgttgtaaataacttttaatggccaaaccccagatttgtactttttttttttttctaactgctaaaaccattctcttccacctggttttactgtaacatttggaaaaggaataaatgtcgtccctttagtggtgctttaatgagtggtcttctgggggtagggtgagaagattggtggaaagtagtttacctcaaacctcaagggaggagttaaggcaggcaggtaagtttatggggttttcttgttcagggggttgccccaatactcatggacaccagaacggcagggaagtagagttgaaaccaacccagggacacataggaaacaagctcaggaggatatagaaatgtaccattttattacaaagaggctcacaaaaatgaaaatagtatctcaaaaaggaaactagactagcaacctccacctgcagaattaggagaagacagacagagggcaggcagtgtttcttggctcacttgaggccagtgggaa

SEQ ID NO: 6178 - DNA, 1275 bp, Homo sapiens
gagccctccgctccccggctggccatggcaggcaggcagggacgtgggtgggacctctgaccgctctccaggccggagcgggtgccgagcccagcgcaggggccctgcagcttctatgaccacatttctagagtataattcaggaccagccatctgacgagcctggtcgtgtgagcccttcgaagggttcaagcgggagactgccagcggctgcaggaccaaggcgttgggggccgctccaggctgcgggggcgcccaccggagaggtggagcggagaggatggaatgactgcccgtctccttcctccaggccccccgccccgccccgcccagctcgcgggaggactggcctcgctcctgcccacaccggactctacctgcccctgggattcgggtggggtggggggtacccgaccgccagcgtcgcctgctgcgcaagtggggcctgcgagccaaccccgcctccgcccctcgattgggcgcgcatttaaatgtccggccccgccccgagctccgggcgcttatatataggcagctcggcgggcggcgggcggcattctggcgcggagcggagcggcggcgggcgcagctagcgggtcggccgcggagcggaggtgcagctcggcttcccccggcacccctccccctcgggcgccagccccacccctccgccggccgggccgaccccgccgtactatcccctgcggcgcgagcccggggcggctccaagcgccccccagcagacccccatcatgggcagccagagctccaaggctccccggggcgacgtgaccgccgaggaggcagcaggcgcttcccccgcgaaggccaacggccaggtgggtacgcttggcccggccggccccagcccctcctctcgcacctcgccccttctagggcccggggccggggccggggccgcgcgctttgtccggcccgggacacgcggcgccccctcccccgcccggtccctttgttctcggcgccgcagcccccgcgggcgaagcgaggggaggggcggggagggggcgccggccgggccctgccgccttctttgttcgcggccccggtccccggcgctgccccccggccgccccgagtgccgcgcggggaacaaaggcgctgctgggccacgccaagggggcgcccaggggccgcggagctggggcccggcggggagcgcactccacccgccgacccgacctcggtggcccacggtctttttttttttaagggggagccgagatgcgggagagcctggggtgggtgggggcc

SEQ ID NO: 6179 - DNA, 1250 bp, Homo sapiens
gccactgccacctctgcttttggccacagtgccactcaggcagtggcctccattcacccaaagactaagtaacttgcccttgattacactggtcttttgtgtccagggccaagtatctgctcaggcctcctgagttctctgcttctcagagccatggcattatctgctcagcaggaggcaagttctccttaaaggactgaggctgacttggttcctgtaggcagccatcaccttgtggtgtctggtgttggttgggggaagtgtttcctttaggtctgaggtaatcagagcatcaggcccacccctcaggcagagggcagctctgcccctcagacacattccttaagactaggggttcactctcagtgggacctcagagtatggcctggggtaggggatgggaggtggctctgctcagcaagtggaggttaggtctgggcctgactcaggagtaactatgtgtttgtgatttccattaccccctcccatttgcagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgacccacctccttcctttcctccagcccacgctggtctgtccccatgccttcccagggcttcttcatgtcggatgcacccaagtccttagcccagctgtgccacctgcaggag

SEQ ID NO: 6180 - DNA, 1115 bp, Homo sapiens
tcttttttatggctgtgtagtattctatggtgtatgtgtgtcacattttctttatccagtctaccattgatgggcatgtggattgattctatgtctttgctattgtgaatagtgctgcagtgaacatacccatggatgtgtctttatgtgatttaacccattttataaatgaaaaactgatgtccagacaggccagacaatttctatacacccaggtggaaacaaagccaggattagagttccatgtcccaactccattgtgcatgtgttgcctctcatttttcttggatccctgtatattctcctaatttgataactaattgtttcatgtgagtttttcattttcaaaatactaaaatttttactttctgctgattgttgctagagttaatgattatgatttcaatatcctattttccttttttttttttttttctctaaccccaactttagggaacagaagtcaaagcaataacatattcagcaatgcaggtctataatgaagagaacccggaagtttttgtgatcattgacatttaagacaccaaaaaataaaagactcctacgaagaactgtttttgttttcctcttccttttgagaagacactatgaattaaattctacagcttttttttgatatatggaaatttgtagaacagaaatattttagttaaagtgtgactttcagaaagggaaaatcagggcacagccttggtctgtgttccccaaatattcacactttaaagaattcttcaaccccccaagggacagttatggtcctttgattctctgctgtggcagtaggtgtgcctcatgcccttccagtgcaatgcaagccctccagcctcaccccagagaggatcactgatgtcagcagcagcctgaggctgaatccaggttgaaagaagaataacttgaaaaaatatatttccacacacagaattttgtttttcttccaagttggttaagacatatattttgtttcttttttttttttttttttgagacggagtctcgctctgtagcccaggctgaagcgcagtggtgtgagctcggcttactgcaagctccacctcccgggttcacgccattctcctacctcagcctcccgagta

SEQ ID NO: 6181 - DNA, 1134 bp, Homo sapiens
atttttcttcattttgcctccatgaaaaaataatgcttttttacatagaacaaaatactggtgctgtttaagcattatctatttgatcataacggttcctatatcatttataaatgttaagagctttagacatcttgaccaaaattccattatgctcagtaggcccagagagccagtggactgggtagtcttgatgtgtctgtcactttgcagatccttctggagagtgcaacccagacttgcgtctccgtggacatcagaaggaaggctatgggctttcttggaacccaaatctcagtgggcacttacttagtgcttcagatgaccatgtgtgtatccttcccattttgaagcaaatctgggctagttaccagttggtttcttttttggggtgtgtggggaggtgagaatcttccttttatataatggttaattttacatttaagaccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatgtgagtagaatccattcagagtttctaaatatcttgtctaagttttatgtttagtcaccatttcaaggtttttttcctttgtttttttttcactgaagttgggatactcgttcaaacaatacttccaaaccaagccactcagttgatgctcacactgctgaagtgaactgcctttctttcaatccttatagtgagttcattcttgccacaggatcagctgacaaggtcagtttcgtttattttaatagaaaacataatttctctaggtttttttgaattgcagagatattttacttacagtattttttttttcttaaaaaattgattactcttgcttttctttttgtacatagactgttgccttgtgggatctgagaaatctgaaacttaagttgcattcctttgagtcacataaggatgaaatattccaggtaagagaaactaatgctactattttgtttgttttaagaaaaacctgctgggcgcggtcgctcacgcctgtaatcccagcactttgggaggctgaa

SEQ ID NO: 6182 - DNA, 1155 bp, Homo sapiens
tcccaaatctggaaagtcagggcggcgtcggcgggagcggcggagcactgtgctgggactcccgcagcatgtgcagaaggagcttggtgaggcctgggttaggagggcagtggtggggtgggtggggagccttggtcatcccctctctgctgaccccacctcctccctgtcccttccaggcctgaggaatgagcgtgaggcaccaggcacgccccgggctcctggtgcacgggatgccgtacgcatccccacagtggacggccgcccccgaggcacctcagggatgggggcccgggtgtccctgcaggcgctggaggcggaggcggaggctggcgctgagacagaggccatgctgcagcgccacattgaccgtgtctaccgggatgacacctttgttggccggtccacgggtacccgggccccaccattgacccggcccatgtccctagcagtgcctggattgacaggaggggcagggcctgcagagcccctgagcccggccatgtccatctccccccaggccacctacctgtcgaagttgattccacatgctgtgctgccgcctacagtggacgtggtggccctaggccgctgcagcctgcgcacactaagccgctgcagcctgcactcggccagcccagcctcagtccgctcgctggggcgcttctcctccgtctccagcccacagccccgcagccgccacccatcctcctccagtgacacctggagccactctcaatcctccgacaccattgtgtctgacggttccaccctctcctctaagggtggctctgagggccagccggagagctctacggctagcaatagcgtggtaccccctccccagggaggcagtgggaggggctctcccagtgggggcagcactgctgaggcctcagacacactcagcattcggagcagtgggcagttgtctggccggagtgtgtccctgcgtaagctgaagcggcctccaccccctccccgccggacccactccctccatcagcggggcttagcagtgcctgatgggccattagggttgccccctaagcctgagcgtaagcagcagccccagctgcctcggccacccaccactggtggctcagaaggggcgggggcagcaccctgtccacccaacccagccaacagctgggt

SEQ ID NO: 6183 - DNA, 1175 bp, Homo sapiens
ctgtggccagccctgagcctgcaggcccttcaggctccccagagcttgtcagctccccggctgcttcgtcctcctcagctactgctttgcagattcagcccccgggtagcccagaccctcctccagctccgccagccccagctcctgctagttccgccccagggcatgtggccaagctccctcagaaggaaccggtgggctgtagcaagggtggtgggcctcccagggaggacgtaggtgcgcccctggtcacgccctcgctcctgcagatggtgcggctgcgctccgtgggtgctccaggaggggctcccaccccagcactggggccatcggccccccagaaaccactgcgaagggccctgtcagggcgggccagcccagtgcctgccccctcctcagggctccatgctgcggtccgactcaaggcctgcagcctggccgccagtgaaggcctctcaagtgctcagcccaacggaccgcctgaggcagagccacggcctccccagtcccctgcctcaacggccagtttcatcttctccaagggctctaggaagctgcagctggagcggcccgtgtcccctgagacccaggctgacctccagcggaatctggtggcagaactccggagcatctcagagcagcggccaccccaggccccaaagaagtcacctaaggctcccccacctgtggcccgcaagccgtctgtgggagtccccccacccgcctcccccagttaccctcgagctgagccccttactgctcctcccaccaatgggctccctcacacccaggacaggactaagagggagctggcggagaatggaggtgtcctgcagctggtgggcccagaggagaagatgggcctcccgggctcaggtacagtgggcagtgctagggtgaggtcccattgctgatgatgggaagtaggaatctgaagtcccgccatgggggatttgttcttggatctttaacttttctggtctgagaatgcctgggaagggcaagctgtcacccttgctggggcccagaggagaatggtgtgtgagtgtcaggcctactgtgtttgaattccaactttgcctctttccctacccttcctagctacattgtaaagtgtggggcagtgacacctacattatagtgtctgaacatgtgtagggtgtccagcccagtgc

SEQ ID NO: 6184 - DNA, 1871 bp, Homo sapiens
gcttgggaccagtctgtgccctcctgcccagtccagtttactcctcttggttcctgaaggtggccaagtcattgtgttcccacaggcttctctaggctgggggcaggtgtggggctgtggaattccaaagcacaaaaggtgcagaggggattggccttcctgtgcctcaactcaccaaccaccctcctgccttccagttctgccaggtgctccatgctggggacaagtaggagactgccagggcccaaagaaatgggtgagcagtagagtcatctcggggcacttggcagtgtcaagcacctgccccttgcctccttgaccacactggggtgggtgggcccccagcacttcagaggcaggagcctttgggctgagcaagcactgaggaggtggatggaagggagcatctggagggggggagcttccttgagcagtgggcccaggcctggccctccacacttcattctctgacctttctctctcctcatttcggtgcatgtcctttctgcagctgcctttcagcacaggtggttccactgggggcagctaacgctgagtgacaaggatgggaagccacaggtgcattttactcaagtcttctctagtcaatgaggggcacccagtgcttctagggcaggctgggtggtggtcccctaggtatcagcctctcttactgtactctccgggaatgttaacctttctattttcagcctgtgccacctgtctaggcaagctggcttccccattggcccctgtgggtccacagcagcgtggctgccccccagggccaccgcttctttcttgatcctctttccttaacagtgacttgggcttgagtctggcaaggaaccttgcttttagcttcaccaccaaggagagaggttgacatgacctccccgccccctcaccaaggctgggaacagaggggatgtggtgagagccaggttcctctggccctctccagggtgttttccactagtcactactgtcttctccttgtagctaatcaatcaatattcttcccttgcctgtgggcagtggagagtgctgctgggtgtacgctgcacctgcccactgagttggggaaagaggataatcagtgagcactgttctgctcagagctcctgatctaccccaccccctaggatccaggactgggtcaaagctgcatgaaaccaggccctggcagcaacctgggaatggctggaggtgggagagaacctgacttctctttccctctccctcctccaacattactggaactctatcctgttaggatcttctgagcttgtttccctgctgggtgggacagaggacaaaggagaagggagggtctagaagaggcagcccttctttgtcctctggggtaaatgagcttgacctagagtaaatggagagaccaaaagcctctgatttttaatttccataaaatgttagaagtatatatatacatatatatatttctttaaatttttgagtctttgatatgtctaaaaatccattccctctgccctgaagcctgagtgagacacatgaagaaaactgtgtttcatttaaagatgttaattaaatgattgaaacttggctgtggctactgcttcttaatgtgggggggacagggcagtggtctgggcccacatttagaagggaaaatgttttgcctgctgcacacattggacccaagtatgggcctcttctgcctagtactgccaaagggactgttaaggtgtcttgtccatcttctaccccccaccccccattacagggtaaaggaaccccagactaggtgaggggccagcagctgcctcacacttgtgttctctcctgagatggtccagctcacatccagacacccttgttcagacatttta

SEQ ID NO: 6185 - DNA, 1835 bp, Homo sapiens
aacttacttgagtcaaaagatgaatgtgaaagcttttgacaaacatttcttagaaaagctgagccagcttaccttaccctactggtatataagagagttttcaggctgggcgcagtggctcacgcctgtaatcccaacactttgggaggccgaggcaggcggatcacttgaggtcaggagttcaagaccagcctgaccaacatggagaaaccccgtgtctactaaaagtacaaaattagtcgggcgtggtggtgcatgcctgtagtcccagctactcggaaggctcaggcaggagaatcgcttgaacctgggaggcagaggttgcggtgagccaagatcacgccattgcactccagcctgggcaacaagagcaaaactctgccccccctccaaaaaagggggggttttcttgcagtcccaccaccatcattaaaatctctcttatctgtcttgtccaggctgacttcaaaatttctgaggagtgcatcgcacagtggaagcaaaccaacttcatgaccaagctgggctccatttcctgtaaatcgctgaaaggggggaacattagctagccagcccagcatcttccccccttcttccaccactgagtcatctgctgtctcttcagtctgctccatccatcacccatttacccatctctcaggacacggaagcagcgggtttggactctttattcggtgcagaactcggcaaggggcagcttaccctccccagaacccaggatcatcctgtctggctgcagtgagagaccaacccctaacaagggctgggccacagcagggagtccagccctaccttcttcccttggcagctggagaaatctggtttcaatataactcatttaaaaatttatgccacagtccttataattggaaaaatactggtgcccaggttttcttggagttatccaagcagctgcgcccctagctgggatctggtacctggactaggctaattacagcttctccccaacaggaaactgtgggatttgaaaaggaaagggaagggaaaacagagaacctagtggtctaccaagtggttggcaactttcccaatgtctgcttactctgaggcttggcactgggggccagggcctgccccagggctcctggaatttcccttgatccagctaggctgggacactccctaaatcagctgcgtgttgttagcatcaggcagaatgaatggcagagagtgattctgtcttcatagagggtggggtacttctccataaggcatctcagtcaaatccccatcactgtcataaattcaaataaaatgtctgaacaagggtgtctggatgtgagctggaccatctcaggagagaacacaagtgtgaggcagctgctggcccctcacctagtctggggttcctttaccctgtaatggggggtggggggtagaagatggacaagacaccttaacagtccctttggcagtactaggcagaagaggcccatacttgggtccaatgtgtgcagcaggcaaaacattttcccttctaaatgtgggcccagaccactgccctgtcccccccacattaagaagcagtagccacagccaagtttcaatcatttaattaacatctttaaatgaaacacagttttcttcatgtgtctcactcaggcttcagggcagagggaatggatttttagacatatcaaagactcaaaaatttaaagaaatatatatatgtatatatatacttctaacattttatggaaattaaaaatcagaggcttttggtctctccatttactctaggtcaagctcatttaccccagaggacaaagaagggctgcctcttctagaccctc

SEQ ID NO: 6186 - DNA, 1142 bp, Homo sapiens
ggtctgatagactcacctgatccctatcggcttgcctggactagctacaggccttatcttggatgggccactttgcccccttcagaaagtggtggagggaagacttcctttttcccagagacagaaggttatgcacccagtggcctgggaccattgttctgggctttttttcccttcgacatggatttgcttctcactgtgtaccccaaccaccaaaaccaccctgagatcaatgctggtgctcctgcatcagatggcttagagatccttccacctcttaacacaagcatctaggtccactttactcaaatctggcctcagttgagagcagagtataccatcagagcccattctcctgtctgctgtctgggacgtggaaagaaagttagctctagggggtctttccaggggcctctgtaaggagtggatgctcctttccggaatccaagagttcaccaggctgcttctctaatggacgatgatcctcttcctcctgacgtctctccctggcagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatgtgagtgaggacttggagtggggcacaggacctggggaggccaggaagagtagggaatcagcccatatgatgtccttccacacaccaggtggaagctctgagaacacgtgcctcttccttgctgatgccaaaagttgatgcatgaaggacttatcgtacaagtactgttaatgaagcattttacctacagttaattttgttaaaatagaaatggagggctcaaaccagtacatacccaagtcttactactagtaaggagtggagcagggattcaaatcccagttttgatgtctataaagtcctcgctacgttattttatacttcctcccctagaaacacagattttggtatcttgacacacaattttggtatagcctgggttaatgtaaccctggtgatatgcagggatgtagcaagataagaggacctcctggg

SEQ ID NO: 6187 - DNA, 1740 bp, Homo sapiens
gaacagttctcttggtaatagacatttaggttgcctccaggatttggctactttgaacatccatgtatatatatatgaagttctagaagtgaaattgctgggtcaaatggtgtagtcaaattactcttcacaaaatatcgtactgacttaacgcttttactgatagtgtgtgaatgctcgtttctccacatcctcaccaatccagattatcatggcatcttaattatcaccattttgataggcaaaagtatctcattgttctaacgtgtatttccatgtttctggtaaggttaaatatcttaaaattatttcttatgctacaagtcacagtgcaaagattttgaaatactagaacattacccacatatagtggactggagttggtataaggttattttctcttcctcagtgaaattgtctcttatttctccagaaatgatgtgctcacgggtgccctctgaacagtcttctggtacctctctcttgcctaaagacggtgccccattttcttgggattccttggatgaggatggattggatgactccttgctggagctgtcagagggagaagaagatgatggtgatgtaaattacacagaggaagagattgatgcactgttgaaggaagatgacccatcatatgagcagtcttctggggaagatgatggtgggcatgttgagaagggagaaagagggagtcaaattctacttgatactccccgagagaaaaattcatcgtacagcctgggaccagtagctgagactcctgacctcttcaaactacctcagctaagtacatcaagtggtcatggaccagctcatactaaaccattaaacagacgctctgtactagaaaagaatcttataaaagtaactgttgcaccatttaatccaacagtttgtgatgctctgcttgataaggacgagactgattcgtccaaagatactgaaaaactctcttcccttggagaagagatgagagaagatggtcttagcccaaatgaaagcaaactttgtactgaatctgaagggatcagccccaataactctgcctggaatgggccccagctctcttcttcaaacaataactttcaacagactgtctctgataaaaatatgcctgacagtgagaaccctacgtctgtattctctcggatctcagaccattcagagactcctaatatggagttatcctgcagaaatggtggttcacacaagtcaagttgtgaaatgagatctctggttgtttccacctcatcaaacaaagtaagtatattttattcaaggtgaagagaaaaatgaaattatttttattcagatgtatagcagagtttccatatacctgctatctccacacatacacaacttcccctgctgtgggcatcctacaccacagtggtacatttgttataatctggcagagctttgtattcagacaaattggggtttgaatcctgactagcactgtgaccctgggctaattatttagcctctatgtttccccacatttcttatctaaattggagtaaataatacttcatagtataataaggattaatgaaataatgtatttatatcacctggcacgtaatattaaattaccctctgttgaataattactaagatggtaattctgttatttttcttgtctttgggcttcagcctatgtctcaatctttattgccatgctatatattaagatacagcactagctctgaatcagccatgaaagagctgaaa

SEQ ID NO: 6188 - DNA, 1515 bp, Homo sapiens
aggcatgcgccaccatgcctggctaatttcatattttttagtagagacaggatttctccatgttggtcaggctggtcttgaactcctgacctcaggtgatctgcccacctcggcctcctaaagtgctgggattacaggcatgagccactgcacctggccggttattctctctttacagatagctatagacatcattttaggaagtgttgcagtctggcatttgtgctattgttcattctctgtgaaggctgttcatagttgctatagcctgtgtttagttttgtgatttcatcaatcccatctttctgtgtgagtaatgcattctaaacatcctaccccactttagaaacggacgtggggaacgcttggtcatttaagccaacaataaatttaggtgaatgtccctaagtgtttactgtttttatccagtcaaggatttgcttttccttgaacatttgttttaaattctggggccaaaatgcaaaggagaagttctattcaaaggcagtagttgaaatctattattttagttagcctacttggcatttactacatcggtcacttctccaggctgccctaaattaggttgatggagtgagacatgccaaacatccacctttgggaccatagcatagttaaaattaaatgtagttggaatagctagcattgcagctacagtagggaactgtagtctagttccctacagaaaacccaaggagtgaagggacaggattttgcctaggcaaaaatctaagactcgtgccctcctggtacatggggttttaagactgaatgtgtaataggagcactgcctttgccaaatcaaatgagtgacaggttaactagaaaatgtgacaatcacatttcctcttagctcaaataattctgtttttccaaagctttagcagcttaattaaatctgttggactgggggaggagagagctgttctctagtggttaacatggtattctttaagaagaaaaaacaaagccaaagaaaactcattatctggcatgttcgccttaaagatggtactgggtagaatctggagttttcatctcttttcaaagctgcatatctcttatatttggtattggcctctaagtctaatattgcagttggaattcttgctgtattattttttaagcaagtgttaggtgcatttaactgctttcttcatccatgacgacattcccaccatgggggtcttgacaaagcagagtaaaaatatgctgtttacattgtttacttacaagtaaggagcctgaaataacctgtagtttcgaatgcaggccctgatttactggcgttgtcagtttcaattatgaaactgaagtttggtgcctcctctttatcatgttttttcccttgtagcagttgtgtttaatgtcattaaaaagaaataaaagttctttgtcagtgacatatgtactgtggcggtctgtcgtaggcttcgatggagggttatttgccttcttcctttgcgtaggtaggttagtggggtggggaggggg

SEQ ID NO: 6189 - DNA, 1186 bp, Homo sapiens
gaaagtatcatgggaagggattgtgggctatgttaacagcaaatcacaatgatacatgttgaacctgaaaaataaatttcccaaactaaagtttttaaaaatgtaaagctaattccaggctgcaggctattctttctgtaggattcttcttttaaatctaccagcctatcgactggtagaaatttcatttttcttggaaacatctttctccctaaggaaatctccttgctagaatgtggttcaagtgctgtgtaagatgccagttgttgggataggcagctcaataagagacaggattcattttatgaaaattcctgaggtctagacatagccaaccttccagtaaagtgggttgtacaatttggagtgttcagtgaagagttcttgactgctgcctcatttcttatatatactcctaggaacaattaaatcaaactggatttaactaggggtattttttctacccattcttcccccactcatagcagatgacatcaagccatgcccacgatgcagtgcatacattatcaagatgaatgatggaagctgtaatcacatgacctgtgcagtgtgtggctgtgaattctgttggctttgtatgaaagagatctcagacttgcattacctcaggtaagatgggaaatgcatccattcctttcgtagtctcattctcttactgatttagggaaaaggatgtcaaaaagacacatccgttctctcattacaggtttaaggaagctgtgaaaacttcttctgacatgctcctctaatcatgttttcaccagctactattctgtttctacctttctttgcttgccatattacaggtagtctggacttgctttttcccttttgctgtcttgcctccatacttgttcatgttctttcctttgcctagaatgctttctgcctaccttccagtatcctccttttatctcaacttgttcagttcttatcttttaagagccacttaaatgcctttcatccatgttgcctctcctttttccgcctcattctttgactttcttttatcttttgtcataaatatcgtcagtactttacacttcacgtacctatcttatcttactaaactgtaagtatcttgaggctagagttgtgacctttttacagttttttgcatttagtgagttcccaaggaattcattaagtgaattctttttttttt

SEQ ID NO: 6190 - DNA, 1222 bp, Homo sapiens
gaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccaaagggctgagcctcctggcctgcctgcccgcccaccctgggagtcccagtggtgaggctcagagaactgctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctgtctctttggtgcctttctcccctaggaatgcctgtctctgggcccaaatggctacttttcacccatacagacaggtgggtccctgggctggggaagggaccttaagtggatggcatatcctccacacttttctggagctgggtcatttgagggtgccctcagctgcagttcacacggtagataccagctttcttcacacggtgtcccttggagtgagagggtccagaagccctttctgctctgcgcccccctacccgccattcccacttgggagatgatgactgttgggctagcagcctctggacacctggggcagaacccagactctcccatcttccagcacacacctctcgatagagctgc

SEQ ID NO: 6191 - DNA, 1236 bp, Homo sapiens
gaaggaacccaaatgtccatcaacagatgaatggataaacaaaatgtggtacatatgtacaatggaatattattcagccttaaaaaagaaggaaactctgacccatactgcaacatggatgaaccttgaggatgttatgctaagtgaaataagccagtcacaaaaaaaaaaaaaaaaaaaaaaaacaaccagatactatgtgattctatttataaaagctaccttgagtcatcaaattcatacagaaagtagaatggtggttgccagggactagggggaggaaaggatggggagttactgtttaattagtataaagtttcagttttataagatgaaaagtttctggaggcctggaagccctacgcgttctactggttttaaaacaaagagctcaattgacaccaggtatgacttgtcagtctctacattctctcctgatggaagagttttttgagttgaatatgctgtgaaggctgtggaaaatagtacagccactggactcagatgtaaagatggtggtggctttggggtagaaaagggagtcttcctaaactttatgaagaaggctccaacaaaagactttttaatattgattggcatgttggaatggtggtagcaggtttgttgacagatgccccttctttggcagatataacaagagaagacgcttccaactttagatctagctttggctataccattccacaaaaacatcttgcagacacagttgccatgcatatacactctgcagtgctgttagaccttttggctgcagttttacagtagggtcttacagcgtgaacaacagggcacaattctgcaagatgtttcgtatggttattggggctgtacccttggcaaagccaggcacgctgcaaagatagaaaatagaaaagcttcaggtgaaagaaatgacctgccatgttattgttaagaagttgcaaaaatatttacatagtatatgatgaagttaagaataaaccttttaaattagaactcagcagggttggtgaattaactaaaggaagaagacatgaaattattccaaaagatataagggaagaagaagagaaacatgccaaggaatctttgaaggaagaagatgaatcagatgatgacaatatataacatttactccagcatctattctattttaaatttctgctacagtcccaggttaacatttagccccctgtggattatacacactcactaaccaattttcattaaatgttt

SEQ ID NO: 6192 - DNA, 1100 bp, Homo sapiens
gcagtgctcagaaaggagagaaccatctcaaggctcagcccccctgaggaggagggccagggttgaaacagagggagcaggcagaatgtcccagctccaccagtcttcactctgcagaacctcaagaccagagcctcaggcccggggaggaatgagtggctccctggacctgcccttatccactggtattggtaagagctgggttctggacttaattacctatgctcaaatcccagccctgcacctaatagttgtgtaaccttgtatataatgccactaaacctcagctccctccctctacaaaatggggacagtagtagaacccagctcctctagtgatggtaaggatgaaatgtgatgacatatttctacaaagtgctcagagcaagtctgtgataaatgtaggaaatgattgttcttgtttccctgcagtagcagctgacgcgtgggtccaccatgaactggagtatctttgagggactcctgagtggggtcaacaagtactccacagcctttgggcgcatctggctgtctctggtcttcatcttccgcgtgctggtgtacctggtgacggccgagcgtgtgtggagtgatgaccacaaggacttcgactgcaatactcgccagcccggctgctccaacgtctgctttgatgagttcttccctgtgtcccatgtgcgcctctgggccctgcagcttatcctggtgacatgcccctcactgctcgtggtcatgcacgtggcctaccgggaggttcaggagaagaggcaccgagaagcccatggggagaacagtgggcgcctctacctgaaccccggcaagaagcggggtgggctctggtggacatatgtctgcagcctagtgttcaaggcgagcgtggacatcgcctttctctatgtgttccactcattctaccccaaatatatcctccctcctgtggtcaagtgccacgcagatccatgtcccaatatagtggactgcttcatctccaagccctcagagaagaacattttcaccctcttcatggtggccacagctgccatctgcatcctgctcaacctcgtggagctcatctacctggtgagcaagagatgccacga

SEQ ID NO: 6193 - DNA, 1641 bp, Homo sapiens
ggtggacctacctgttcagcctcatcttcaagctcatcattgagttcctcttcctctacctgctgcacactctctggcatggcttcaatatgccgcgcctggtgcagtgtgccaacgtggccccctgccccaacatcgtggactgctacattgcccgacctaccgagaagaaaatcttcacctacttcatggtgggcgcctccgccgtctgcatcgtactcaccatctgtgagctctgctacctcatctgccacagggtcctgcgaggcctgcacaaggacaagcctcgagggggttgcagcccctcgtcctccgccagccgagcttccacctgccgctgccaccacaagctggtggaggctggggaggtggatccagacccaggcaataacaagctgcaggcttcagcacccaacctgacccccatctgaccacagggcaggggtggggcaacatgcgggctgccaatgggacatgcagggcggtgtggcaggtggagaggtcctacaggggctgagtgaccccactctgagttcactaagttatgcaactttcgttttggcagatattttttgacactgggaactgggctgtctagccgggtataggtaacccacaggcccagtgccagccctcaaaggacatagactttgaaacaagcgaattaactatctacgctgcctgcaaggggccacttagggcactgctagcagggcttcaaccaggaagggatcaacccaggaagggatgatcaggagaggcttccctgaggacataatgtgtaagagaggtgagaagtgctcccaagcagacacaacagcagcacagaggtctggaggccacacaaaaagtgatgctcgccctgggctagcctcagcagacctaaggcatctctactccctccagaggagccgcccagattcctgcagtggagaggaggtcttccagcagcagcaggtctggagggctgagaatgaacctgactagaggttctggagatacccagaggtcccccaggtcatcacttggctcagtggaagccctctttccccaaatcctactccctcagcctcaggcagtggtgctcccatcttcctccccacaactgtgctcaggctggtgccagcctttcagaccctgctcccagggacttgggtggatgcgctgatagaacatcctcaagacagtttccttgaaatcaataaatactgtgttttatacaggttggctctgtctctggttctcccacactcccacccactgacagaaccctgaaggtagggaaaggtaagccctcagaaagggaaagagttccatggctcggggtggagctagggtgggggctgtggctgtggctgcagctggggcttgagctggagctcggttaggctggggctgatgttgacagccgggagctgggtttgtaccagaggaggaggctggggtggaacctactgatacatatgttgggattctagctgtggccacaagagtgcgctgtgctccctctgcaacggtgcttccagccttcgtaattagacttcaccctgagtacacacacaatcactgccactctcactatagacaaaccacactccctcctctgtcacccagtcactgccatctcaacacacatcccca

SEQ ID NO: 6194 - DNA, 1505 bp, Homo sapiens
ctgttgagaacggcgccaccagggggcgctcgaacgcgccgcgctttggtggaaaatgtggggatttgaccttgtcggaacaggagcacctggggcttcaggtcacgggatccgtggcggattctgagcgccatcgcgttcggagccacgcggtcgtcagcactctgggcgcgggggtgcgggggcggacacctgggtgttgggatggttcggcgccccagctcagcgacgccctctgccccgcaggaggagaagaaggtccctccgccgataccaaagaagcccctgcggggccggggcgtgccggtgaaggagcgctccctggactccgtggaccggcagcggcaggaagcgcgcaagcggctcctggcggccaagcgcgccgcttccttccgccacagctcggccaccgagagcgccgacagcatcgagatctacatccccgaggcccagaccaggctgtgaccggtccggcccgcccagcccggcccgggcccgcggttctccacccgtactgtacacccagcgtcgaggtcactgtgaacgcgggccgccccgtgcgcccgccccaccggcaccggacgccccggcccccgggcccgtcacactctcgtgggttttttaccttcctgatcccacgcgaaggcgcccgggctgggcagggggccgtgcctctccgccctgcgcccctcacctggatcccctgcccacctggtccgacgctttgtccccacctcctccccatgggcaccatctctgccattctttcccccacgggccaggccgggccgggtccctcatctgggctctgcgtccccccctcccccaccccgcggggctgggcttcgtggggatcaagcttcgtggctttttatgaagaatcccgaaccctgcctaggagcccgccccaccctcccaggggctccatcctcagccctctgcccactgggcccagggaccacagtggctggaccaacccaggaccagggcgcctgggcctctcccctttcccagcggctggggaggggagatgggggcttcccctcaccacacctgtggctgttcccacatccccttgaatatcccaggaaaaataaaacggcagaactgcactcgagccagctgctctctccagaagaggccacctccgtcccgtgtgtgggaggacgggggtgaagggagaagggaccgggagcccactctcttggtttggagatagcaggggttgcctgagctccttccagggatgggccagctggtggaaaggagattcggccccctgatgcccacagtaagggcctggaccctcctggaggggcccaggtggggtgaagagggggagggtgccaagctctccgttcttcctatttcggtgtatcccgttctgcctcccagtccgcagggttcccccagagagggaagtccggagctcgccgggcacgcagcatgtgctcaataaaccgggagtgtggttattgttaggtattgacaaataattggtttcc

SEQ ID NO: 6195 - DNA, 1170 bp, Homo sapiens
ttgctgaccaacagcatatggacgtgggccctgctgccagggccccatacctgctgggctccagggaggccttctccaccgagccccgcttctgtgccccgagagctggcctgggacacatttctcctgaagggcccctgagcctgagtgaggggccgtcggtaggccctgagggagggccagcgggggccggggttggggggggtagcagcaccttccccaggatgtaccctggccagggccccttcgacacctgtgaagactgtgtgggccacccacagggcaagggtgccccccgcctgcctcctacactcctggatcagtttgaaaagcagttgccagttcaacaagatggcttccacacactaccataccagcgagggccagcaggggcagggcccgggccagcgccagggacgggcactgccccagagccccgcagtgagagccctagccgcatccggcacctggttcattctgtgcagaagctctttgccaagtcccactctctggaggcgccggggaagcgggactataatgggcccaaggctgagggaagaggtggctctggaggagacagctaccccggcccgggctctggaggcccccacacctcccatcaccaccatcaccaccaccatcaccaccaccaccagtcccggcacggcaagaggagcaagagcaaggaccgcaagggggatgggcggcaccaggccaagtccacaggctggtggagttccgatgacaacttggacagtgatagcggcttcctggcgggtgggaggccccctggggagcctggtggtcccttctgcctggagggtccagatgggtcctaccgggacttgagcttcaaggggcgctcgggcgggtcggaaggccgctgccttgcctgcactggcatgtccatgtcactggatggacagtcggtcaagcgaagtgcctggcataccatgatggtcagccagggccgggatggatacccgggggccgggccaggcaaggggctcctgggtccggagaccaaggccaaagccaggacttatcactatctgcaggtgaggcttttttggggttggggaacagagtccttagccttcaccagtcttgtcaactagggagcagtggaaagggttgggtgggagccagctgtccctgtgatggagggcc

SEQ ID NO: 6196 - DNA, 1641 bp, Homo sapiens
ttacataccaaaaggtccttcaaacatttaatgctgaatctagattgcaaataaataagttatacgtaattgttaacgtttccccctagtggagctcatactgtaactcagccatttattttactatgttattagagtagatatatttgatattttaattaatttttgaaaactgttaaatgttcttttctcattttctcccaaagctttctaagagttcacctagtgaacccagtaatgctgttgctagtagtagtacggaacagccaagcgtttcaccatcttcatcagtattcagtcagcatgcaattggttccagtacagaagtacaaaaagacaatatgaaatctatgaaaataagtgatgaactatgtcacccaaaatgtacatccaaagtacaaaaagttaaaggtaaatcacgaagtattaaaaaatcttgttgtgcagattttgagtgtttggaaaacagtaaaaaagatgtggcattctgttattcatgccagttgttctgccaaaaatattttagctgtggaagagagtcatttgcaacccacggaacttctaattggaaaaaaaccctggaaaaattcagaaagcatgaaaaaagtgaaatgcatttgaagtcattggaattttggagagaataccaattttgtgatggagctgtcagtgacgatttatctattcattcgaaacagattgagggaaataaaaagtacctaaagcttataattgaaaatattttatttcttggaaagcagtgtttacccttaagaggaaacgaccagtcagtttcatctgtgaataaaggcaattttttagaattgttagaaatgagagcaaaagataaaggagaagaaacatttcgacttatgaattcacaagttgacttctataacagtacacaaattcaaagtgatattatcgaaataataaagactgaaatgttgcaggatattgtgaatgagatcaatgactcctcagcattttcaatcatatgtgatgagacaatcaatagtgccatgaaagaacagctttcaatttgtgtaagatacccacaaaaatcatcaaaggctatcttaattaaggaaagattcttgggttttgttgatactgaggagatgactgggacccacttacataggactatcaaaacttatctgcagcaaattggagttgatatggataaaatacatggccaggcctatgatagcaccactaatttgaagataaaatttaataaaatagcagcagaattcaagaaagaagaaccaagagctttatacatacattgttatgcacactttttggatttatcaataattaggttttgtaaagaagtaaaagaactccgaagtgctctaaaaactctcagttctttgttcaacactatttgtatgtctggggaaatgttggcaaattttcgaaacatttataggctaagtcaaaacaaaacatgcaagaaacatatatcacaatcatgttggacagtccatgatcgtacattactatctgtgattgacagtcttccagagattattgaaacattggaagttatagcaagccattcttcaaatacaagtttcgccgatgaattgagtcatttgctgacattggtttccaaatttgaatttgtctttt

SEQ ID NO: 6197 - DNA, 1162 bp, Homo sapiens
cagaattcagtgctgttgcagttctcagataaaaagtgcaaacttgattctttggtatatctgactcagttgtgtggtttcctttagttgcattgtaactgaagataacatggaacacatcagtggtgtgggggagagggaactaaactatacttgggaactagggtgcttttagcaccttgacatggaccgtatagcatgtgataattagtctctattgtagcaaactgacctgcccatagatcggcaatatcagtaatttcattatgcaatcttggtaattctacaagttgagttgaactaaaagtacaggtttttttgtaatgcgatttaaaatttttaaaaacatgggcttcatgaaaacaccattgttactaacttgggcttagatgggaatctaatgtgaatagttcaagttatgggacttgtctaaatgtgtctatactctaaacctgggggaaggtggtgtggaacattgacttgactacagtcgaatacatgttgggaatcattcccaatcataagacatcgtcgtttctgtaggatgactgcatatgttcagagtagctttttgaatttggttcccttagctttagggatgtgatgttatagtccaaaatgtttacaagaaaacctaagtcttcaaaagcacaacttttgttgcttaggactttgcatcaactgttgttccagacctcacttcaacttcttggtctctgaactggttttagctagcatgcatgagagacagttttcatgtataatgtttctgctctgtaactggaaagtggtttactttgcataaatgctgatgaaaacttcatgactatgagacttttcttctgtgtatcaagaaaaagcttgctcgttggcaagcaattcacaaggtggggacagacttgtactttaacatgtagtccattcaagcaaacaactttggactctactgatagatgaaagagcaaatgatgactagtttagcctctgcatatcaacaatataatgcagatcaagtataatgctcaatattagtgacatgagtatcactaaattacatagaaccctgatggggtttcctgtgtcgtaatccattaaatcggtggccagtgcttgctgccgtggtttagtgattgggtgttagaaataaaaactcaggtctatt

SEQ ID NO: 6198 - DNA, 2075 bp, Homo sapiens
tgcggggcctgtgggtggacagggtcctagaggaatggggcctggaactccagcaggatatggtagagggagagaagagtacgaaggcccaaacaaaaaaccccgattttagatgtgatatttaggctttcattccagtttgttttgtttttttgtttagataccaatcttttaaattcttgcattttagtaagaaagctatctttttatggatgttagcagtttattgacctaatatttgtaaatggtctgtttgggcaggtaaaattatgtaatgcagtgtttggaacaggagaatttttttttcctttttatttctttattttttcttttttactgtataatgtccctcaagtttatggcagtgtaccttgtgccactgaatttccaaagtgtaccaatttttttttttttactgtgcttcaaataaatagaaaaatagttataatattgatcttcaactttgccattcatgcttctatgcatattaggctacgtattccacattgaaagcatgagagtgtctaggcctttgaatggcatatgccatttctgggaaatgcatctggaggctaagtattgctttctacaaataattgccccctttgttttaaaaagaagaaatgcatattgaagtagtttgatgatttgtttggcatataggaagcacgctggtgctaagtattttttaaatggttatgtaagcaaagctgaactgtaaatcttcaggaatatgtattaagattgtggaatgggtgtaagacaattggtagggggtgaaagtgggtttgattaaatggatcttttatggccctatgatctatcctttacttgaaagcttttgaaaagtggaaaggtcattttgttgcatttccccatttcttgtttttaaaagaccaacaaatctcaagccctataaatggcttgtattgaacttttacatttgaattaaagatgttaaacatgaagtcttttcatgtattcaagtgatttataaagatggggtgtagtctaaaaaacaaaacttgaaagtaagaaggtttagtaactgggccgggcgcggtggctcacgcctgtaatcccagcactttgggaggctgaggtgggcaaatcatgagatcaggagttcaagaccagcctggccaacatggtgaaaccccgtctctactaaaaatacaaaaaattagctgggcgtggtggcaggcgcctgtaatcccagctactcgggaggctgagccaggagaattgcttgaacctggagatggaggttgcagtgagctgagactgccactgcactccagcctggacaacagagcgagactctgtctcaaaaaaaaaaaaaggtttagtactgaagtaggtttagttatatatacatttgtactctgtaacttttacatctccttgtgctacttctgttgggcaaaatctataggactataaaaatctattggttctcttctaagagctagtggtgattgttaacaaatagggttgcagataatcattcttattgtaaatttaacttgttttcacatagtttcgttttcatgtagcactaaatctggagaaagttgctcatgctacacagtacaaatatcccttcctcccaccataaaggcttggaatgtttccatggtgttgtcagttaattgtcaacttcattgaacccccttccattagaacaagagactttgactattaaagtagattgtttattgttgcctgttagtataatgggagcctgatttcccagtgtaaatatgttagaggaacagcttcctaacagtaggtaaagtaattgaatggtttggctttgttctgagttacgttccattcaaatctgtacattgtagaattcttactatggaatgtgtcttcctccttttcacctcttttcttggtgctaattggcaaaagaaaaattctaagtcaaacctttattaacatgctgaagtttagtattgtgcctgtgtacaaaaggagacctattgttggaacaatctgagcactttctgcataggaaacaggataatgctgaaagtaaacactagtgtataaaagcatctcaccaa

SEQ ID NO: 6199 - DNA, 1225 bp, Homo sapiens
taattaacataattatgaaagccccaactttttcttttttttaagttcttagaggtagaacacagaacaatgagccaaaaaccctgtaatttataagattttgaaaaacaaaggataaaagtttagtcatgttgagtagctcaatagtattttgtttaaaagaatgttgaaattgtgtataggaacagttaaaccctgatgcccttttagttttttatttggagtaatactcttagtaactggtctattataaatggaatgagaaaaagtgtaggctgctgtgtttgcatacctgaggggtctgctatttaggcacatatgtttctattgaaaacttctatctccagaattacctaaaactagatgggaatagtgaagtcactcactgctttattgcagttactttagcttcgtgtttcactgttcgggaagtgtctaaaacatggaattacagcaaagtgtctgcacttttcaaagacctaagggaaaagatggactgatgaaggtgggtggggtttgttcatttagtttgcaacaatatagaatagtactgagaacgtaattgtctctggttatatagtgatggctcggaaggtagtgtgcctgtgagaatttggcaacataagtttttttgatcaagttactgtgccggttaagtgactaaatctatagtcttatgctttttctttttgtagtctggtagcattttattaaaactttcaaccttttaagatttctgcaacttagcagatgtgtcttaagatcttgaaaagcacaaggtttcttaagcagcacatgccactaactggtgagtaggtctttgtcacttcattgagtgaattgaatctctggttgggcttgttaggcttacttggaaattaaatttccgttcagacgttgaaagtgagagtttgcaagtttttcagtgggttaatctgatgtgaaatttcttagaactcattttggaatggattttcacatctgcactaattcttaaattttttagcactacagggaagatctgttctttgaaacaggtgtatgagaatggctcaagtgggaacataccacaaggcatgtattaccgtaaactaattttcaaattacccttttttcctttctatgttcccggtacctgtggatcgactcattggtgattgtatcgacgaacgttgactacggaaccttctaaaatatttacttaacacacatggacatcaactac

SEQ ID NO: 6200 - DNA, 1977 bp, Homo sapiens
ccccagctaattttttaattttttttgtatttgtggagatggagtcttcctatattgcctaggctggtgtcaaactcctggcctcctaaagtactgagattacaggcatgaactaccaaccctggccttaatccttgacttatgcactaacatttatattctgacatttagggaaaagatgtacttagtttttcaggtcagtcaggcaaaatacaaaggttaaatatgtcagtgttggtttaacacttaaaatcgaatacagtgtaagattatccttaataaagcctacattatttgccagaatgtctttagtactatgcccctaggctcactctaagcctttgtgttttttagtgctaacctagttcttaggtcaactgctaggtttcttcacattgaattctaaaagatgtggataacacttcagttatgtacctgatgggtatttctaggcaagaggaggaacgacgtagaagagaggaagagatgatgattcgtcaacgtgagatggaagaacaaatgaggcgccaaagagaggaaagttacagccgaatgggctacatggatccagtaagtcagcctttactgccttccaattggagttgtctatagaacttgcaggtacctagaaggaattacaggaaattttaatatcaaattacagttattttctgctttttttctaacaaagtatattatgtttgatttccttgtatgggtcagaggatttaattgaataggaagtttttttgtgttttgtttcttggtttttttgttttgttttgtttttttgtttgtttggttttttttttggagagagttttgctcttgtcacccaggctggagtgcagtggcttgatcttggctcactgcagcatctgccttctgggttcaagtgattctcctgcctcagcctcttgagtaggtgggattacaagtgcctgccatcaggctcggctaatttttgtatttttagtagaaatggcgtttcgccttgttggccaggctggtcttgaactcctgacctcaggtgatctgcctgcctcggccttccaaagtgctgtgattacaggcgtgagccactgctcccggccttgaataggaagttttgtaggtctttggataattgagtctaacttagttttcagaatattgatttcaaaaataattcacatgatgaacttttgaactttaccatgttttttatttaactcttgaaaatttctcagttcttaagaatgcttgctgtgggtatagtgcaggtatattgaaaggaatttttttcttgcagcgggaaagagacatgcgaatgggtggcggaggagcaatgaacatgggaggtaagtgtgaaatttaaattaatgatataagtagagagtagtatcctggtggagttgtaaccactatttttgttttctagatccctatggttcaggaggccagaaatttccacctctaggaggtggtggtggcataggttatgaagctaatcctggcgttccaccagcaaccatgagtggttccatgatgggaagtgacatggtaatgtatcctgtgggacgtagtaccaaggaaattctcattttcacaacttaggtgtgtttgttttgttttgttttgtttttttaagtaggtgactggacctcttttagtttcccctaccaatttcatacataaatatgtaatattgaggaatactttggcaacatagaagaactcggtgtgtggtaacctaaacagataacggttgccaacaaggagtcaatgctgttagtattatgtggaattacctttggcaataagtagatttaggtgcttttgaactctagtgcatggcaaatccaaattctagatgctagataatgtatctgattattctacatccaagtgagaataatcaaatggcaaactcattctttaagctggtatttgccataagtaggaatcagacttgtagtttgaagctttaggcacgtt

SEQ ID NO: 6201 - DNA, 1189 bp, Homo sapiens
gtttaaagatctgaaattacctctgacatggctctacttctgtcttaggcactaacgtactcagtaggaaccatccctataacaggcctcactttcaatttaagagcagcatgtttttggctttagcttaagagcaaaagctgttaatttttctgttcagttttgatgggaagttttacatagttctcggtgttagtaagttcttatgaagcgttagctgtgtttactgttattaaaatatatatgatcatctcttttgtgacatgaatgattaaaaaaataagtagttgtttatagtgagaggatgtgatttatctcttagtttttggtttggggctttggtctgagaactactttggttcatcctaaattttattttactctatttggcaatgtttttgtttatattgtgcacttgtcatttgggttgaaaattacagctccttggggaatagggagggataccaaaagaatgtatgatagaagatatgatggtaatgttactttttccttttttgcttttccagtttgaacaaaaaagtggtgcagtttttgatgaaattgtagagaactgtaagtaccatttgagaaaaaacaatcatgtctttagatagaaaatgaatgttaatctagatgtggtatttaactattacagtgtttagttagggctgatttatgtgatggttcaatctgatttagtctagatctcatcacgtactgttctttcagcaggttaatctgaattgtaagaatcttattctttttttcaataaatattttattctcatagttatcatattaaaatatagccatacttcgtgtctatatggaagattatacttaccactattaagggtttctacttgggttaaggtcttttattttcttttaaaattctttttgtgttatcgtatttttagaaataatttgttttttatgattataaaagtaatacattcaattttacaatacagaaatgaataaaatagaaagtaaaagtctttgtcattaccattctccaaagataaccagttttaaaagtttaacatatatatctttccagacttttttctatgagtgtatatagctatacatggtgtatggagatttatatatgtgtgtaggaatcatagatactgttcttgctttttttcattcaactgcgtagacatctttctgtgtcaatgga

SEQ ID NO: 6202 - DNA, 1150 bp, Homo sapiens
aaattgatactttttgttgttttgtttttccagaatttattcaacaaaccaactggaatgaattcttcagtagtgcccttgtctcagggccaagtaattgtaagcatccccacaggttccacagtgtcagccggaggaggtagcacatctgctgtttctcccacctccatcagtagctctgctgcagctggtctccagcgtctcgctgcccagtcccagcatgttgggtttgcacgaagtgttgtgaaactcaaatgtcaacactgtaaccgtctttttgccacaaaaccagaacttcttgactataaggtaaagtatagcatgttcatgataagattttgagtatacgtgggtctatttgtaaaattatttttaactttgcatctctcaaaatcataccatttgttttgaaagtaagggagataaggagttccataagacaaaccaaatgtttaattagtacttaatgattatttctttgcagggcaaaatgtttcagttctgtggcaagaattgttctgatgaatataagaaaataaataatgtaatggcaatgtgtgaatattgtaaaattgagaaaattgtaaaggagactgttcggttctcaggtgctgacaagtcattctgtagtgaaggtaaagacagaagattatcttacctactgagcatgttggttgttttaaagcagttgatgatgatttaagctttcactgtctaagttaatctgttttattgtttatgtataacgtaaatgccttttcgattcatttacacttagttcattcttttttgatctagttttcttatattatgtagctgttaaaatgaagtgaaagatttgcaaagtataatgcagaagaagatgatgtgaaaaacatttaacatccttaggttccccattattaggttgatcgggacctcaaagagcttctagttcgtgtacttatttctaaatgggatgccttaaattatggtaacattctaagtttatacttttattgtcttaaacagccattatatttctgaatataaatggcttgaatatgcaaattaatatgtggaagattgttttccttagataactcttctatatgtttataatgttttattttactctaaagctgtattagccttctagagcaagggcttt

SEQ ID NO: 6203 - DNA, 1197 bp, Homo sapiens
aagtcaaatgctgtgcaagaggctgattcagaattgaagcagttctcaaaaggggaaactgaacaggacctggaagcagattttccatcaggtttgtgtacagtaacctgtccactgaaagctttttattttaaaagatcggtacaactctgaattgacactattaagcagtgccaattgttattgataataacagtgtaatgtgttagaggtcataatctagagcacaaatagaccctggctttgtaggtgttaattcgtaccatattgttcttataagtggttaatgtggttaaaattttttttaacctttcccgtagtagctatataagaggttttcctgattgttaatgaagttttcatttatgcactatatccttggtttaagtctataagtggaatccttattttatcacaaacaaactaatgaatatagtgatgattacctgatatttctttactagtctaagtctttatttaaatttgtgagttatttacctcatgttgtcctttctgctgattattatagactcctttgacccacttaataaaggacagggaatccaggcacgttcccgaacaagacgacgacacagagatggcttcccccaacccagacgaagagtaagctgcagcttaacttttctagacttttctttccttcattctacaagcattatttagttcctgctgctttcaaaactctgtaacagccagagtcaggtagttccacatgttgttttgcaacttttgttttttgaattcaagaaccatatattttatttacatttctttcagtaggaactttttttgtttctatagttaagggttttcttttatattgctttgtttactttaaaaaactttttatagttattttttatgctttatctgtttgaacagcctctaaatttagctctttttacatgttataatactgagtactttgggaggccaaggcaggcggatcacaaggtcaggagatcgagaccatcctggctaacatggtgaaaccccgtctctactaaaaatacaacaaaattagccaggtgtggtggtgggcgcctgtagtcccagctactcgggaggctgaggcaggagaatggcctgaacccaggaggtggagcttgcagtgagctgagatcaggccactacactccagcctgggttacagagcaagactgtctcaaaaaaaaa

SEQ ID NO: 6204 - DNA, 1256 bp, Homo sapiens
aaatgttttgtgattgcatgtgtcctttcttctttgacccatagagctgtttaatttatgattttggaggatttttttggacatctatgcatcattggtttctattttaatttcattgtagttagataatttgttgaggcttgttttatagcacagaatatgatctgtttacatgtttcattaaatagacctgagtggtaatagtagttattcatacctcatcaggtgagtctatatctggaacatagtaaatacccaaatgttagtgattattacagtgtgctcttctgcatttaaactttttctttcttccttcctcatatggattggattaaataatctctaaagccctttcttgctctaagaactctgaatctttaggatataaaactaaattctttattctacaaatgtataccctttccagctttgagaaccctgactcttaaaaatccaaaactaaattttatgttctgtaaatttttggaattcttacagggacggaagaagtctatagtggctgtggagcccaggagtcttattcaaggagcctttcaaggctgctcagtgtccgggatgacactgaaatacatgtatggggtaaatgcttggaagaactgggttcagtggaaaaatgccaaggaagagcagggggatctaaaatgtggaggtaagtgcacagcatgaattgtatcttgatttaggtagggggaaatatacagataatctactgaaaagggatacattttaggtcaaaaaccccataaaactttggtttgggctttacttaattttttccgcacttttattttatttaaacttttcttttatgtttctctccttgtcaggggttgaacaggcctcatctagcccacgttctgaccccttaggaagtactcaagaccatgcactctctcaagaatcctcagagccaggctgtagaggtaaaatttgtttctctccatttggtatgaattatttatattattattgcggatttaaatttgtaaattgaatatttaaaattatttaaaatttagagtattaaggttagaaagagaaattaatcttatcccgttttaaggaggttgttataagggtaaggttatgtcttctgctcttgagtttattatgcaaatatacagaattttgttttatttttgacactgtgcaagtgcctcaaaatatgtcttcttgagccctgcgtctgtatagtaatccatgtggagcccagttttttttttgttttttttttt

SEQ ID NO: 6205 - DNA, 1099 bp, Homo sapiens
gttctctacagctccttagtttctacagcaacagcgttgttcagagcctatatggcctacacatcccaaaatatttactttctggccctttataaagacagcttaacccctaatctaaaatatcaatagattaaaacggtttcaggagactccacgaacggtgtctacttgagtggaatcatctgcctttttctttgtggtgcgttttctggttttctgcataaggaagaggggaaagaggaatagtcagtttttctctttatatctccctgtcttagaatttgagagattacttagtctactttagcaggagctcagtactgtttcttgtaccccttcttctgtctaggttacatgttctctcgcattgaggaagagcatttgtgggagtgcaaacagctgggcgcttactcaccaatcgtccttttaaacaccctccttttcttcaataccaaatacttccaactaaagaatgttactgagcacttgaagctttcctttgcccatgtgatgagacggaccaggactctgaagtacagtaccaagatgacatatctgaggttcttcccacctttacagaagcaggagtcagaaccaggtacgggatactgtttgtcagatttctctttgaagtcttagtagtagtactaaaatagagagttactgcagaaaggtaattataaatgctagacgtgaaagagtgtacctttaacatttgaatatttttctctattgtcagagagtggtcaaaggctggcctcaaagtgagaggaatcacgtgcttcaatatactttcattggcttttaaattagaaattttgatttaattgggcagagctcaaatagcctgcattttaaaacttctcaggaaattaaaaaatacaaacagggttgagaatcactaatttactagccccagatgagtcaatcactagttaaacgaaacctgcagaacttttagtccattgtttctaaatctttttttgaccagagcccctctttttagttaacattgtgaaattctgaaggaacttaaaagctgacctacaatatactgcttttgtacacaatagaataatagcagtgacaattttattag

SEQ ID NO: 6206 - DNA, 2846 bp, Homo sapiens
ggccatagtgtcacatgtgagttgacttttttgttgctcttaataatgtttgaagtactaaagtttatgatttacactttgtcttatattaactttatactcacttccaatccattgtgatttcagttgattcctgggaggaaatattcctgtaaactatttatctctgtgggtaccttgctttccccattgtgagtcacagtggagaaaggttgagagccatattaggttggtgcaaaaataattgcagtttttgcccttacttttaattacttttaatggcaaaaacctcagtttacttaagaatagtacatatttcctatactctctgatttctaattttcttttttctctttttttttttcccctgtggatagttctgaaagtgtgaagcaaaggaatgatgtgttttaccttcaacctgagcgctcctgtgtcccgaatagccccatgtggtactccacattcccgatagaccctggaaccctggacaccatgttaacacgtattctcatggtgagggaggtacatgaagaacttgccaaagccaaatctgaagactctgatgttgaattatcagattaaaacggaagtgaggttcttattttcatacatattggtatgcaccaaactgtgaatgcatccagctgttggaaaatgatgtataagtctaagtcctcttgacttgaccataagatcatggaaaacagatgacttgtgaaccccacagtgtggatgtgcaaatgaaaattgaaggaaagaatatgaactgagaaatgttctttggcagtgatatagttcttagacatcttcagaatgactaatttctccgagtggtgcataatcttattttgtttgggagtaacaaatcgtggaatatttttaaggaaaactgttgtataaaactttaccatagtaaccttagaccttagagaggtagctttggagtgaaactttggctgcaataggctactttggcaagccctccgtaaaagtcagaggagagatcagtacagagctaagagtgacatcaaatgaggactgtgggacccagatttgaagacccaataaaaatactcaactttttaaaaaagatagtgaagtggtcttgattgattttgattttcactgccaagccaatcatgtgaaggacagaagcttttgccatgggcccctcacatcagggaaaatgaccttcactgctgttaacagtaatgtgtccctttcattttctggatcaagccttctcagcggtgggtctggatgtgggtaaactaaggtaaaggggatgatattccacaaactaattatgcacacagaaaatctgtggagcctatcagaccccaagtgtcttgaaatgtttgtagaaacccactaaaatgccccttctctgggtgtgggcccttattgcagctgtctcacagcctgagctgtggtacagagaaatgggggttctccttttattttcattttttttccccaatggcagcttttctcccgttgttttaccttcctatttcccaaacagttcctcttattttgtcttttgcaccagtttctggaggcccttgtcatttcaaaaaggatagtctcttttcttactctggcaaacctgtgagtgattccacaaagatacagtattacttagctatctgaattatgatagaaaaggtcctagttaggttcctatataaagcatttggaagatgaccttgttgcccttgaaacttgaaaatagggattctggggtgaggatacaaagacattgtcttgcatatccataagcaggtcttagagcattattccaaactctagctgtttcagtagttctatgaggattgcaagtcataggtgtgtgtggcatatcagtccatctccctcatctccattctcagtttcttccccacaaaatttggaatcaaagcttttatgacgtttgccaattgcagaacttcttcagctaaggttaatttgacgctatgataaaactgagagatgtcaaaaagcctcttagaaattttaatcttgaaagacttttcagggtatctcattttttaggtgggggtggcaggtgtatttcttttttaacaaataaaaggcatttaagtaaaactaaaatgaaaaaagtaggccttctgacattgtgtacttggtggttctgtccctctgcctgtaacaaatctcatttttgttaccaagaactgtatgaaagaagtaaatccaccccgattctgtatgattaattccatctgtgtttgtcatttctgactggaaaacttcttactccataccttgttcgatatggaggacaaataattggattgtctgataagtctgccaataaactatccagaaatagcaagtgtaatagtccccactatacgaattttatggtttgtataaacactaacattttccccttctgtagttgtatgaaaaaacaaatattgttagcatagtagataaattgttatgaaataccagaaaaaaaaatctgtatcttttactgagaacacccaatacccagataaatgactgtatcaggatttcatttgcatgttagtccacagagttgcccagaaccctaaatttattcataagagaaaatattgattaattattggtcattcctcataagtgtagctgttgatgtgtgcgtctgattattgcttttttaattttatgaaaattgtgtaaaattacattttttttccaggggagaaaaaaacatcaaacaaaaacatctaaatcatcctttttgttctttttcagtttttaaccacttttaggttttccccttacagaaaccacagaaatattcccttagaataaaatagtatatttgt

SEQ ID NO: 6207 - DNA, 1905 bp, Homo sapiens
atttacaacatcaacaactcatggaatacttgggtgaggtttcctttttttttttttttttaagatgggagtctcactctgttgcccagcttggagtgcagtggcgtgatctcggctcaccacaatctctgcctcccaggttcaagcgattctcctccttcagcctcccgagtagctgggattacaggcatgtgccaatacgcccagctaatttttgtatttttagtagagacggggtttcaccatgttggccaggctggtcttgaactcctgacctcaaatgatccatccacctcggccccacaaagtgctggtcacatgcatgagtcactgcacctggccttgggttaggtttcacttcctccattagacatttgacattttattgtagcagctttctgggttaatatctctttgtgattgatagaagtggttggaagaggaagagtagggaaaagtgtgacattacagattaaacagtgaaaatcagtaccataatgactcctttacacccatgagatacgtaccatgatgaccagggctcggtgaaagaaagatttctttttttttttttgagatagtctcactttgttgcccagtctggagtgcagtggcgcaatctcggctcacggcaacctctgcctcccgggttcaagtgattctcctgtctcagcctcccaagtagctgggactacaggtgcatgccaccacacctggctaatttttgtatttttagtggagacagggagtcaccatgttggccaggctggtctcgatctcctgacctcaagtgatccagctgcctcagcctcccaaagtgctgagattacaggcgtgagccactgtgcccagccaaaagaacgatttcttagatggaggacctaggaaccaacagatgggctgctgtattactcttacccctttcattttcctgtatgcttcttcccaaggcagcatcaaattttgaattaatttttgctgcttaataaggacttaaactggtacccaagtcagaaagactctgcctctaattttctggggcttggggatgaagataaagtgttacacccagtgtttgtccaccacagtctgtggggcagagagacccttcctgggactgaattctcaatttgaagcactgttgttcaaagatctcccttctgggtctgacaagaagaaacataacccttatttattgcattcttctggcttacatacattgccctcactaatcaatggacatttcagcatttcattactaattttgagagaaggccaccatggaatttaataaaaatattattgaagagaattgccatcattctccattttccctgaactaccacaagcttctcagaattttagacaaatgtttttcccctcagaactgagcatcagtgctgctttggaaaaacattccatgtgaatactgtggtttcagtgtcaggacctgtacttgggcagttggaagagagtgtgccagttttttactgggagatgggaacaccaatttaattgatgcaattaggttgtaggttttttacagtttttcttttcttttctttttctttttcttttcttttcttttctttttttttttttgagacataggctggctctgtcacctaggctggaatacaatggcatgatctcggcttactgcaacctccgcctcctaggttcaagcaattctgcctcggcctcccaaatagcagggattacaggcacctgccaccactcccagctaattttttgtatttttattagagatgaggtttcgccatgttggccaggctggtcttgaactcctgacctgaggtgatccacccgtctcggcctcccaaagtgctgggattataggcatgagccaccgcacccggccggttttctacagttttctaatac

SEQ ID NO: 6208 - DNA, 1155 bp, Homo sapiens
aacaactgggattataggcacatgccaccatacccagctaattacaaacattttatttttttgtagaagatacggtctcactctgttgcctagtctagccttgagctcctaggcccaagtgatcctcctgccttggctgcccaagtactgggattacaggtgtgagccaccatacttagccctattcctgattgttgatagaccctggagtcaagcttttctccctttagcctccccctcttctcagaaggcactcacaccactctttcaggtccattacagccttggtgatctgaggaccagcagtgtcacttaggagcatgctagaaatgcagaatttcaggcttcgctctagacctgctgaatcagaagctacattttaataaaatctccaggtgattcataggaatattaaagtttgagaagcactgtcatagagtagatgttaggagtgagtataatagatgggacattgcctggactttgaattacttccaaaacttgaagtggtggtagtctctcagcttccacaggccactcctatcccccacagggaagtggtggaatacatggtccagcatttcaagcctcagatctttggtgatcgcaagcctgtgtatgatggaaagaagaacatttacactgtcacagcactgcccattggcaacgaacgggtaaggttgggagtcaggctaggcctgtgtcaggggtctggggtagaaccaagctcatgtaagcctctttggagatccagagatccttttcatcttttgtgctgagaaagtatgttttagggtgaggggtgggtaggtgctgatgtttatttagtctatcatgtgcctgtccgtgtcctaaacagattgagattagacttaaaatagacctaagggcttcctgctaggctgagaggtagttgagaggaacagaagcactgagccaaggtggctagaacctaaggggctagacttactctggattttcattatgagcccctatcaacttgaaaaacatgttctcagcaaatccatggagttgggggtcattctcgcagagcaatggcaatccttcatccctttctttcaccctcctgaaggtcgactttgaggtgacaatccctggggaagggaaggatcgaatctttaaggtctccatcaa

SEQ ID NO: 6209 - DNA, 4525 bp, Homo sapiens
gccctgaccccactggaccaaaaggggcagcactggtgcccaccatacacacaggtgtctcatgtgactcacagtgctaaagactcatgcttgacagcttggtaaggtcaactctgtagccctgcagacaaaagctggttaggtttgggtttgatactttagatgggaaagtgaggggcttgagaaagtgggtgggaggagggaaggattttttaggagccttaatcagaaaaggactagatttgtttaagaagaaaaatgaaaccagacccagatcaatattttaggatactagatgttttaatgggttcagaatccagtttgtaggaagattttttaatggttttggttgctcctcccccagctgccaccccccaccttacccttattcctctctgtccacattttctgccccaccttacttctcctccctgacagacatccagcccctagtaatacttaaggcactatggcacttagctttgaagtgacacgaccctgtcttccttccgcccgctggtgggtaaccagtgccttccctgtaacggtaatgctgcagaactgcaaccttttgtacctttctttggggaatggggtgggggtgggagaggaggtagatggggaagaaataccccagacccaacaaacctccagccagaaagccagctattttgcatttgaaggaattgacttcctcattcattgagctttttaaaagatcacaacctcaagatggttaaaatccattgacatttgcactttcaaacatgacaagtctcggagctgctgagatgacaggcccctggcctttccacttatgcctccttttctccttattcctcctacctcccgccccgcccaggtctggagttactttcatagcatttttcactcttggcttcttttctcccttgatggtcaagtctcttatgtttcaatatttcttaactggggtgtcttataacaaaaaactcttaggtctaaaatgagaaaaaagagagaaaacaaaatgttatttttataccataacttgagtgtattgccaaaatttggaaatccttcccatgcctgatgagtttatatcccagaaacattgagccatcagaatgaactgtgtacctgatttgttctctgacctggctaggtagggagggggtggttatcgccccaagatggggtccaggctccatccttcctctgtgcagataatacctttttcttgctatagcctccctcctctgcactgtcctgcactctttcttgcaagtgcatctttttccttcccctggactgtcctctgaccctttggctcatcctagattgcagtgtgtcctgtggacaggctggggaattttgctgctccctattgcttctgtttacaaaaatgaatttttcctggtttcccactagggcatgtgggtgggtggcatggacttttttttttttttttttttgtcttgagacatggggtttggctgtcttgcaggactggagaaggtggtggttctagcttggtctctgttggccttgaagcaagcatcccccctgccctttttccttgactgttcatttttttcctgccccactgcttgggatggggagttgcaacttcagtgtggaatttcctctttgaggagcctgggcttggatctatcctgatctggtgatgaagccatgattactttagacctagcccaggcttggaggccagctggaggaagaagggtctaaatcctggcctgtagagttagaactaccatttcctccccttagctgcccttgtatgacccggatttgctatgcaaaacaatctatcccaggttctgttctggttggctacattgttcagcaactcacaaaacgtagcacaaacattcattatggagaaagcatcaggactgttgagtaactcctcctttacttttttcctgctggctacagcatggggtgccctataggcacaagcccagctgaagaacagaatggagggctctgggaggaggcagctcactggagagcctacattccttacacaagtgcctaaagagagtgatgctaacactccatctgccctgtccattgccttcatatacagtctacttcgtgttctgtcaccctttggggaggggagttctcctgggacagtgggctctgcatgttctccacttggatacattttggggctaggatcagggcactattcctggagggtccagtcattcaccagcatttgcaaatgtccatagggagcaggtggcagcctctactcccagcaacaagtttgtgttctctccttttctctctttgcctcactctctccagttggttttcagctggggcttgaaatgcatttttagccctttgacgtggcttatgccattcaagaaataaaaagcaagagaatcagctttgggcaatgacaagaaatgagttcttactctgatttttttgtaaaaagataatttttgagacttgaaaaataccccgaccttgagattattcctgtttgaaaggtggtgcatgcagatggagaagtggtgttggcagcaagctttggctcatgtggatttggtttaagtggtgcttcttacccaagcttcaaggaagtgcttgggggacccccagcctcatcctcttagttgggtctcttgttccctttgtaccactgttttgccttccttttcctcttctctctttgcctggcttcctttcccttttcttctattcactctgcttgcttgctggccggcctgcctgcctgcctgcctgcctgcctgcctgtctgcctatgtgatgatgaaatctctgcatggctgcaatgatcccactgttagctggcagggtcaggcttagctccttgactgcagaagaccaagaacctgttccccaagcccagagatgtccacctgggctggactgccctcaagcttatactagagaagagcaactgacctgcccaacttgtgtgaagtcaggagggtttctggcattttccacacctgtccactccttggagctggtttctctcattgctttttctaaatctggttctttttctctttacctggggcctggcttttctgagattgtcttagggttgagctatttgggtatcctgggtttgagtgttaggggatggacataaaggaaaaagagtgatgagaagagaatggagagaatttgaataaaaggtgggaaaggagagcactgttctttgattgtttatccagtccaacctgatccattagggatcgaggtgctacactggcctccagggataagcctggggctactgttgctgggaacttaggcttaacataaagccgaagaaggtacctagaaatttgaaacttccctaaaaagctcctaatgcccacctgctagatagcttctctgtggcctcctatttagctaagcagcagtgtttttggatactttttttttctgtttgtgaataaggccagcactcaagatgggcagccaagggtgcactgactattagctggcccataggatatctgtaaggctggtgggacagttttggacctggaatcatgtgtaactaacaaggttggacgtttcttccccatcagggtagaaaaatcatctcaaactagccaaaaggcagttttggaaactacattgggggacgttatttttatttatatatggggcctaggccaatccaggatggtagctggaataccttccttcttaaaatctgatcatggcagggatatgcagggcactttttactatttggccttctaagcagattgggaaggaggtattttctggttttcgctttcctccgacttaataggacttgccttctccctgggcagggagagaggctgggttggtgctctcccttactctactcatactgacttagagcctctggctgctgtttgggcatccaagaaagggaggggaaggaatgagctaaaaacaaaacagaatgaggtgggaaagggagattttcttctttacagaggaaaataggaaaccctccaagaattgtgcaagtaaagacatttgttgaatgcactgagtcccttggtgtagtagcaataaggaaaaatgaaattactttcctgtgcacacagtccagcctaattggtatgtgatgttgcacttagcagccatgtggtgggcatgtgtgactactctggttttcactttagtttctaaactttttatccctctcaagtccagcatggatggggaaatgtctctggatccccacagctgtgtacttgtttgcatttgtttccctttgagatttgtgtttgtgtcctgctttgagctgtaccttgtccagtccattgtgaaattatcccagcagctgtaatgtacagttccttctgaagcaagcaacatcagcagcagcagcagcagcagcacaattctgtgttttataaagacaacagtggcttctatttctaaagtgcggtctttctctttttttttcctaccagcaaaacaaacttttgggactgattacatctctaatagattttag

SEQ ID NO: 6210 - DNA, 1493 bp, Homo sapiens
aagtgatttttcagaattatgtgtgcaaaaaattaatgtgcattcatatattcttgtaaaaggtgtctgtgtatttttaaaatatatacatccatacttcatatgcatatatatctagatctggattgataatagatatatatgtgtctgttatatattttagagttcattccattggggaattttctttcccttttattctacccccactaccgcctttatttctctatttcccttgccttcatcacctacatttttttcccagtcctaccagtgacattcaaatgttgatgtatctggttcgtttgaatataaaatatggcaaactagaattctacttttattttgcataccctactcctgactcctatctcatacacaattctgagttctcaactcttgatattgctgtcttaagaaacaaaattttatatatatatgtatacatacatacacagacacagacacacacatatatatacataaaataactttctgtgagagtgcgtctctcccctcccactcagaacatacatttaccatttgcgcaatttgtatataagcagtagcaacctgaactattctttttcttttttctttttcttttctttcttttttttttttaatgagacagagcctcgctctgtcaccaggctggagtgcagtggcgagatctcggctcactgcaacttccgcctctcgggttcaagcaattctcctgcctcagcctcccgagtagctgggtttacaggcatgtgccaccacacccagctaatttttgtatttttagtagagacggggtttcaccgtgttggccaggatggtctcgatctcttgaccttgtgatccacccgcctcgacctcccaaagtgctgggattacaggcatgagccaccgcacccggcctactattctttttctttagtgagtttgttaaagctgctataaatataaaacctgtcagaagttgtaactttctctctggtaagtgatgtgtattctgaagccttctgtttctatgggttatacatggaaattctttaaaggttttataaagggtaaatattttaaaagattagagctctgtagggttgagacctctgaaattgagtagagagaagagtttgttgagggatttttttgttttgttttttgatagtttacttgctgcctctcataccttaatgtgattttcatatattttttatatatatatatgtatgtgtgtgtatataaacacatatgtatgtgtttggaagtatagcttccttttcttttatatttattagaatagtgctttaataattatagaattgtattggcagcatcttttatagaaatataatcatgtttattttaagaactgacaacttgtttttgctatcttttagtgcaataagcagttttaaaggaaagttgtgtctgcatctttaccatggatagtaggaggaacaggcacctccatagtttaaaagggcaaagaatacagcctt

SEQ ID NO: 6211 - DNA, 1104 bp, Homo sapiens
aaaatatcagtctggcaactagataattgattttcatatgaagaagagttgggagtttaatgtatattcttgatggttaatgtgtctacataaagtgctgatacatgtattatatcacagtatcaggttactggcatggaggaccatacacttacaatattgtagctgctatatttatttaagtagattctgacagttactgcactaaacagtaaggagataagcaggattcaaggctagtgttagacccttttttttcctaagagtaaggacacggaatatcaaagtaacaaagggtgctgccattttagtttcaatttaatatcaggatattctttgttttagaaatgtagattttgacttttacagtttgaaaaagggtacctcagcctcttcagtactggttttttggcacatttcaacagaaatattagattccctttctttttcttaatagtgatcttctaacaagtttcttggaaaaactatcattctaagggaaatccctgtttataacctattaatatatttctattcctagaagagagtctagcagggattctagtaggaattactgagtgttttggaaggcacttgatagaggcatctctgctttccagcacagggattctcagccttctaaagatctagaccagtttccaagctagcttctccacagcccaccactgcctagtgtttgcttgtgtattctctaatggattttaggaggataggccttctgacagagtcatgaaagactgaaggcatgtctagggaaataaaacctgacttgcccttcagcaggaatgactggcagcggatctctgtgttcaaggaaagggtgagcgctaagcatgccagtgatggatccgaagtatttagatggattgcagaccaggaattagagaccgtttgtgactcaaggaacttgatggatctgtttagagccctacatgaatttgccaagggcagtgatttttatgaaattcaagaagcaaacgacttcgatacagctagaatatgttgcagtcttcctatttcaaacttgattttaatatttttaccaagaagtttaactgacaactctgcaaaattttcattcag

SEQ ID NO: 6212 - DNA, 1182 bp, Homo sapiens
acagccctgtcagagagttgctaacgttactccctgtctgcttaaggagttgaatctgggagcaggaagcttagcggtcccctaggtaactctcccagtcacgcagccagtgtgtggtggagccaggatttgagcccaggtggtctaactgtagagcctgagatcttagtcacagcctgcttgaagccgagagtgctgacttgtgtcaaatggtaggaggcctggggaagcatgcagcccctctaacctggcttccccacagggaatggcattgctgcctttgagtcggtacccaccgccatctactgcttcctacgctgcatggagccagaccctgagatcccttctgccttcaatagcctccaaaggactctcatttattccatctcacttggtggggacacagacaccattgccaccatggctggggccattgctggtgcctactatgggatggatcaggtgccagagagctggcagcaaagctgtgaaggctacgaggagacagacatcctggcccaaagcctgcaccgtgtcttccagaagagttgatgagggctacagctgttggggctctgccaggtcccctgggaccaactacagctccaatcagaaaccctgcgcttccttgagtgtggcttcccacttttcctgcattgtggagctgactgagtacaccggtgaggctggggtctctgcaggggaggtcactggaacagcgagcaagggactggtgcctcgctggtgctgggtctctggtttgctgcagagccgtaggacactcctggctcctcagtaggacagacagacgcaggcgggtttattttggaggggtacttgtggcattttcctgtattgtcttggacatgggatgtggggaggtggaaatgatgagcagtagcatcatttctccctgttgggttttagccagtttgccagcaagcgcatcctagcagggtccccgagcagcaggttgtgtggatgaagggacaggcacttgcatccagctgatctaggtcacacctggctcttggctgccatgtggcttattaacagcttccagtggaagtcgcaataaacagtttttggtaaatctcaccactgtttcttgtttctcctgccctgaatggattctcccctgccagcctgatctctgaagactagtgcctttgtctgtgctgc

SEQ ID NO: 6213 - DNA, 1115 bp, Homo sapiens
tcggtctgtgatctcgttgcactgctccaagtctggctgtgtccaggcggtccatgttgaaaatggaggatggctgctgacttctgactggctgagcagtgggttccttcaggttccttgccaaccctcctcccctgcccacaacttctccaaacaaagcaggctgtttgctcacttcttcaaaaggaggaatgataacccaaatctgcccaagtgacacttgagaaggttttggctggggttcctggtggatttcttactacctaacgcccaagaaaaccaactaaggactctcaaaccatacctggtgggggttcttcgctcaacctcttcttccctaggtcaaagccactatcatctgatgtgttagggatgggttctgattggcagaaattaatcagctcccaatgggagcccacggaactaagtagggtcccaagaaaaaaaacgggagctatttcacagagctgagcttctgccaaatttcattcctcaaacctttcaggaggggtggttggcgtttctaaaatgtttatgggatttgagttgcaggtgtccacttaactgactagctttgataaacaatgtcagattttaactatgaaaacgacattaccttgtgcatttttatattgattcctattttttttttaagattaaagtttaaatgttttccactagtcatttcacttctaacttggtataggaagcttagctctctacatacctatcatgtgccctgtatcacagaagattcaggaaaaatgcacttgggaatcaaagaaaatggaacttctttttgaaaagacaagcaaccatgttaactgtattgacacatcctcaataaaacctgttgtataaaacagcactgtgctgaaactgatactgacacagaggtatctcaagcctctgggttctgtaaggtgtccaggaagctctctggggcttgtgtgcctgctcttaaggatcatgcactcctcaccagctccctaacctggatttctgtcaccaccacatcacaaatgcctgatgctcgtaagctgctgaggccatgcgccaggcaaatgccaggaggcattttaagaaaccaaaggcaggtagtggctggagctggg

SEQ ID NO: 6214 - DNA, 1244 bp, Homo sapiens
ctctgcatccacagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacaggtagatctcctgattcctggacccagctccattcctcccagcagccttccctgtactcctcagccctgccttctcttctggctctgccaggcaccctctcctgctccaccctgaagacccccagctatctgggcttgagtgctgtttgccctgactgtttcccttcctgtttttccccagaagtcctttaagagggtttgccttggatccgggcacagttgtgagggctcctctgcatcacctaccaggatgtctggaggagaaaaagacagaacaaagatggaagtggcctgggcccctgggggtgggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtacagtggatgtgaatactgtaaatagcttgtgctcagactcctctgcgtggagagggtgggtgcaggaggcagaccctccccccaaagccccctggggagatcttcctctctctatttaactgtaactgagggggatcccaggtctggggatgggggacaccttgggccacaggatactggttgcttcaggggtacccatgccccctgccctcgcctggaatcagtgttactgcatctgattaaatgtctccagaaataaagaataattctgccaatcctgcctgttcttggagctggtggcggaggtgggagcagatggcctcctgagttctaagaactgaagaagcctcgggctggtggtattagtcctgaactcctgccctatggtcttccagtttagtcatgaattcattcatttatttattcaacaaatactgttgcatctactctgtgtcaggcagtaggctatgcactggggatgcaatagtcagaaaggatgtaatctctgtccttgtgcagtttatagtct

SEQ ID NO: 6215 - DNA, 1202 bp, Homo sapiens
aacagatttttcttgaataaaaatgcttgtgtcaaaaattcaaacatttgtctctttcctttccattccagttctaggtctcgttccagatcatattctccagctcataacagagaaagaaaccacccaagagtatatcagaatcgggatttccgaggtcacaacagaggctatagaaggccctattatttccgtgggcgtaacagaggcttttatccatggggccaatataaccgaggaggctatggaaactaccgctcaaattggcagaattaccggcaagcatacagtcctcgtcgaggccgttcaagatcccggtccccaaagagaaggtccccttcaccaaggtccaggagccattctagaaactctgataagtcgtcttctgaccggtcaaggcgctcctcatcctcccgttcttcctccaaccatagccgagttgaatcttctaagcgcaagtctgcaaaggagaaaaagtcctcttctaaggatagccggccatctcaggctgccggggataaccagggagatgaggccaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggcaagtatctcatttcccctgcctggttgtgtttttatctcactagctggcagtttaattgtaatgtgatctaagttagagctctgattaatggtaaaaggtaatccctatttcctagacttttcgttagtaaacattaaaagcatcacccaaggaaacctttaggttaactctagctttcctaccttcctgaatttgtattgcagcataaactttctttagactact

SEQ ID NO: 6216 - DNA, 1169 bp, Homo sapiens
tttcagaaattattacgaagtaaccgcctagaaagtcctttggtaatacaggaatccataagacatgtttttttcagagaatcaaaaaccaaaaacggtaaggcactattttagagcatgctgttaagaagcctcttgtgtctctctcttgtgtttttataaataggtatctagaagagcagaagacagagaatggaaaagataaggaacagaaacaaacaaataccgataaagaaaaaataaaagagaaagggagcttctctgacacaggcttgggtgatggaaaaatgaaatctgattcttttgctcccaaaactgattctgagaagccttttcggggcagtcagtctcccaaaaggtataagctccgagatgactttgagaagaagatggctgacttccacaaggaggagatggatgatcaagataaggacaaagctaagggaagaaaggaatctgagtttgatgatgaacccaaatttatgtctaaagtcataggtgcaaacaaaaaccaggaggaggagaagtcaggcaaatgggagggcctggtatatgcacctccagggaaggaaaagcagagaaaaacagaggagctggaggaggagtctttcccagagagatccaaaaaggaagatcggggcaagagaagcgaaggtgggcacaggggctttgtgcctgagaagaatttccgagtgactgcttataaagcagtccaggagaaaagctcatcacctcccccaagaaagacctctgagagccgagacaagctgggagcgaaaggagattttcccacaggaaagtcttccttttccattactcgagaggcacaggtcaatgtccggatggactcttttgatgaggacctcgcacggtgagatatgctccttcttgatcctcagtgctttagtggcctaagtggtgtcgcctagcctttctccctggggacattctgctgtattcccccttctgtcttaagcttcagtggtgatactttcatgtccacctgtgttcactggagagtatgtgtcacagagtgattgtgtgcttttgaaggggggcagtatccctggggtgatgaagtatctcttcagtccttagtgactggctcactctctgttcatcactgcacccccaagtccaatgctgtttcttgtatttaagatagcttt

SEQ ID NO: 6217 - DNA, 1127 bp, Homo sapiens
acagtgtttatttagagaaccctgtaagacaggtagcattcctgtaagaaataaaagtaatagaacgcactaacagatgataatatacaaagctatttatctggcccagtaccagatactttggagctctcaatatagtgttaatttccttctcccttattaattcatgcctgtatcttagactgagctcctggaggccatggactgtgttttgttcctgcttctatgtatgtcatatgtttatcacagactcagacatagatgtgtcactgaacatgactgacagaattgagaggaagtatcttgggtgggtaggttgggggtgagctggctttataaggttactcatcatcagtttcttccatcacaggcatacttttgattgccctgtgcttatccatgaggccccagccaagcagtgtcccttagaaagatgattgatcaccctggctcttctcttttcacaggaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttgtaagaccttcccctctccccctttctctgagacccttgctcctaccagctttgatcacgtttcatcagaataccagttttgttgcctttgacataagtaatccaatccaaagaccctggaatctttggttctccttcccacatttcctggcctttccattttttgttacttttctgttcataatcacttagctagaaagcctcttatggcttctggtctcagaacttcccccacttaaccttgactactgctgtttatagggaggcccttggggcaggtttgtcctctgtgtaggctgcagacttgagatgagcagaaagggaatggctggaaaccagctgaccagcatatgactggaagacagctgtctattccacaccagaaaaatgtttgaacaaaaagcaggggggtttgttccccattcctggcatgatcctttgttctttttccctcatttatt

SEQ ID NO: 6218 - DNA, 2251 bp, Homo sapiens
gtcttacttcagtgctcagtgacgtttttattttctttaaactattaagggttcttgctcagtgaatcatcatcattgtcaatcatcgttacaatgcccaagctgttaccttaaaattcctaaatcacccaactgatattctcatggatctgaaccactggcatttttggagtgggggacagggagaagtgcagaaaaggatcaaaaggctgggttagggcacaggttcttttgggaaaggcacatttgggtgcgtgcagagaagagagctctggccacatcttgttcactctggcactgatggcaattttctttcccctcagcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctgtttttctcatttgttggtgtgtggggtgggggcaggggtagggcgggagagcgatgcttggatttttgtttcctattagaaaccaacagttttgttctaatttcatttcatttggagctaagatgactaatttgatgattttcgatctcttttcccctgtcctgattttaaaagccccctcctttttttttttttttttctttttttaggcatatgtagtaatattagaaacatttaatttgggaaactttgattcttgaaagagaaaacaaaagcatgtgaataaactttgaagtgttcacctcagtttgggaccaaactgcttggatctttgtaaaaaccggttttgtatgtcaaggaggagtttaaggcctttccgaccaccttgtgttccccttttctgcgcagccatgtatcacgtggagttgctccttaccacacctcacgtgcccctgagccctatttcctgatttcttctgggctggacttccccgttctccaccagcagctccagtatcccaaactttctagtcctgctgatcctcccagcaacggggtggaaactggagggcagtgtctggtctgttttctaagaaacttatgaattctattatctttacaaatatgagaaaattttttcaatattttttattaatctttttataaaatgaaaagaaactcctatgatcgattaaggaaggtggttatggctgggtggttcaggggtttttttgggtttctttttttttttctttgtctttttaaccttaagctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgcgttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaacgggttctgttcattgtcatcctgagtgtgtgtgtgtgttgagggtggtagataacttcccacggcagtttcagaaaacctgaaagacaaagggcctgtggggccttgcgcaggctgctggagtcccagacagacacagtccttcctgggaggagcattgtgtaccttggacaccccaggagaaacagattttttccactggtgtcataggcaaggactttggcttccttcatcatggtggtggggcagggatcaagggatgtggttagtaggctcagccttctacctgaaagagcctatcccacatggactggccatagggtgggccctaaccttcagactcctgccggctggggactcaactgt

SEQ ID NO: 6219 - DNA, 2336 bp, Homo sapiens
gctgggtacccaagcggcagttcggcagcgcaccaccggtgcgacggctgggccacgacgcacagcccatgacctccttggacacggccatcctggcgcagcgctacctgcggaaataacagcctcagccggggccaccagcactgctgccacttcttccagccccagccaaaggcgtggctgtcagggctgggccctgtagtgctggactctcccgggccacaatagggacagggcagggacagggacagcccaggtcacacgtggggtcagcagaggtaccacgaagctaccttttgggatgattgctcgattgtttggtttttaaatctgagaagcctagataactaatctgcttttaatcacgatgttttaatctacctctgtctctttaaccatgctgtctctggactgagcaagagggaggagggagcctgctcaccccactccagggccttccccagcggccaccaactgacctggggcgctgctccccacagtccaaataagctgaaagtgcagctcgctgcaggccccagagcgagcttcccctcctccctgctctcccaggcccctgccacagcctctttccgtccctctctttctgatccaggcccctcagtccaagctttggaaaaccttcacctcatcttaaaccgaactcaaatatatttatttttttaccataccaacttctctcccatctctaggtggctcagtccatggccactccctgcccccagcctggctggacagcaaggaatccacagcccacacgtgagctccctcctcacccccaggcagggaagcccctcctgccagtccctgtcccctttcagcccaccagtccctctctgctgccggtgatgggaggcctttctagacctggctctttctctcccgtctcagtggcttctctgaggtgctgtacacgcgcgttaacctgttcccttctctatccttccccgtggtactgagctcacgtggactcccagtgcgaaggggcccatgggttgggctgcaggcctggccgtgagcgggggctgcctgcacgctcccctagcctactcttgtgtttaggggatggtgggaacatatcccagtgcccttgcctcataatagatgtggtgactctcccggtagaccctagcaagggtcctccatggtggtgagggactcaggagaattgtagggattgggggaccctgcctgcctggcttgagaacagccctgctgcccttttgagccgagattttgaagtggatgcccgtcttgccagaaatgctgttctcaccagaatgccccctccccttgcccttactggacttggccctgcctgatgccaagcaaagacccttccccagaggcctaccccccatatgtcctcagagaggctgagtgtcccctccaggcagtcatgggccctgaggcccctcctgcctggccctgctccccagtggggaggtgactgtgtttcccagagtgtgagccgctctcctccccctaaaaagctgactcactgtgagtgaccttgggcaagttcccaaacctccttgtgcctcagtttccccatctggaaaaaatggggccacctcttgccagcagtagcagggctgcccacgcccctttctccccatgccccatccagcacttgggcgactcatgcctctgcctcagtgggcctgtgggagcctactggagcccagcacttactccccctgagcagcgagcctgcgtctgtctcagctgtccagcgctgagggccagggtcttgtgctgtggggctgggggatgccctcttttctatatttatttcatagaaagtctcctgcgggagcggaaatgcagtccggcctagggctcccagcccttgactgtcctcctgtgagggcctgaagctgggccagggcccgtcgcagcggagccccctctcagcagcccaccgggtccctccaggctgctgcccgtgcgtggtctttctcctccttttcaaagcaatagccgccgggtctgcaaagccctgtcagacagactgggcccttccaaggtcaagccatgtgtctgatgacattcctggtgaagcaaaggagaggaggatgggtcagccctcactgggtgtcacacactgagagaagtcctattgtaaagaaacggaaaaagtcacaaaaaagtttgtataaagacatatttttgtactacatggggactcttcctgcatgtcagcaataaaacttcctgatctggaaccactgtggcctgcgtctcctgccttcttgccttccctgcctacatctcggcctctccagccccgacccagccccatccctctccatccc

SEQ ID NO: 6220 - DNA, 2210 bp, Homo sapiens
tgagcccaactctgtgggcaggtctctggattagacacatctgaaagttgcaggtcaagtggacacatctggaagtggcccggctgctggctgccatggaagggccgtgccctctgtccccatggcagtttaaatcaggccttcccttcagtcctggatttgccctggagtaaaaatttcagagctgaggtcatacgtgagtcacaaaacttttaggtagaaggttaatgttctgtacaatatatatatgaatgtaaaatatatatatatactgtatatatatatatatatgcacagtgtatatatgacctgtagcccatgtgtatacaaccctttcctgcacgtctgcacacggagtgtacagaacccagccagcacgggtgaggaccagatgagagatgggggctgcagcagcaaagtctgggacggaggtctcagagagccccttggggtggcgaaggccctccacacatcagagctccagaccctgaagaagagggcagagctacatggtgctgccaggtgagtcctgcaccgccagggcctcctgtgggaggggcaggaatggccaacggacctcatctccatccgagcctgtctgaggcaggacagctgggtgtgtctgagaagcaatgtcatgctagtactcagcccctgtgccaatattacattctagttctggggcaattcatcaggagcagaagggctgggaaagagcaggccactccccaggcctgttctcacacctgcctgcagaatcacaggtaggtttcaggctccatctaggataccctagaaggcggggctattctaggtagcaaaagcctctgcctctgattctcacccacatgcagaagcagtcacaacttgcacacaacacagctcacaactagggaaagcacttgttaaagagaatgcccccagggcatggccagcatgccgatacagtgttcccatgcccctgttactgatcctgtcctcctgccttctagaacagtggacctcacatcacctcccagattgtctccattttatggattgaaactctgaggcctccagacatgaagaagcagccatagattcagtcaaatgccagccaagggtttgccttgcctcagacaacctccccagccccatttgacccagagaccagctgtcagggagcgacctcagagccagaggggtgaaagatgagaggcaagaaggtagctcctatcctagcacagcccaggctccatctgtctgcctttctctcccctgcggcatcctggcagggcagttggcagagtgccccctccccaggaggctgcagatctctgtccctggctcacccagatcggtctgttctctgcagttccattcctttagcctctttcgcaggtctgagcatctctggagcatgcaggggaggagatatctgaggtgggcttccgtgcagtcagcagcctgccccagcttcagcctcaggcgtcaggctggtctgcactgaactctgggtctgcctctggggccctgaccaagcacgcctgactccagccccatgaggagcatcctgtcttggttccgtagggatcatgggtcctcttaccactgtgcgccaagcccccagcccacctctgcctgggccgacttcctggttgggcctcccatggtaggggcctcagttcccaggctctgggctgagcccccagggagcaccatgggcctctgagaccctagacctgtcccaccacccagaccagagtgcctggacgccccccactcccactcaacatggttcccacacactggtctctgggccattcaggggatgccctttgtggacatgcagaatttctatgaatatagttttttgtaaacattttgtaacaatttgggtttcatagtaactgtgttacttgccaatcattctaggctgatgtaaataaatttccaaacaaatctgattattttcctttttaagacactgtgatatatcaaagtgcacagtttgctgtatgaagtaatatggttttaaattttaaataaaatgtttctagaaaacagggctcccttgaggcgtgttttctgtttctcttctctccttagaatgagaaggtgctgggcgacgaacttttgtcatcttcccccagggatgactgtgtcccaggcaagagaccctggtgcccagcaggcgggtggctccagccaggctcctggttcagacattg

SEQ ID NO: 6221 - DNA, 1957 bp, Homo sapiens
gtgtgtgcacatgtacactgaatggcataggatggagatcaggatcttacctgcagctagccaaatatgcgtaaaaggagaagccatgtcaccaaggggtccatgtctgagtgcatgtgaacacatgtgtacaggcatgtgtgcacagtggggagcggggggaaggccaggaccagagagtcgtgtgacatgggtcaatgcatgctgtagacaagaagccacgtggagttgaagtttccgagtgtgtgggacacacacatatgttccaggtcacagtggaagcaaagacagacaatcaggaaggccgggcaccagggtctgtttgcacttctgtcatgggagagatcatttgtcacagagaggttccaaggttgcatgggcacacttgccaggagacgggggcacaacccttcaggggctcatgctgctgatgcctttgctgtggacatcatgtcctgtttgaagggaaaactcttttttgtaattcccaggtaacaggattctaatgaaggtatttgccaatttgctgtcagcaaacacaatcattaagcgccgtcttactttgtccagtatagtttcagagcacgtgcctcattcttgctcttgtctcacacatgtgttgtgtgtgtgatgctacatgagcatgttcttcagaggctatgcatatatgtggattgtgacaggaggaagaagaagtggtgagaatttttataaaacgaacaaagaatagtggataaatagaggcagaattcaattcgagaaaccccccaaaatgtaccgactggtctttagactcctgtgtggaagcaggagggcatgctgcctcatctcctctcccaggcaaaccttgcgtcctgatgttcaggtgttgtcggtgtggctgatatttggcttctggccaatatcctgcatttgtcctagagaccagcctagtgttcaaagtgcagtggggaccacagctgcccaagcatgagctctgtctctcccggggcactgaaaatgatgctacatctgtgaggtgggacggagtggggaggtgttttcagtgaggcagatcttgtgtttttttaagtttaggtctgtcctgccagtgggcatggagctgagctggggcaggtgcatgcgtgtgtgtgtatgtgtgtgtatgcatgtgtagtgtgtgtgcacacacgcaggcactgagaggtgatgggaagcatgaaagcttgcttggatggagcagaagaaggaacctgcctgagcagatgctggactgtccctgcgtggtgccacatgccagccctgaacagaagaatgtccccactgcatccccaaatgcaagtgcctcctctccacctgctcaagctggccaagttgaggggcagtggtaagaagacaccaaccccaccgcccctgccgaggccctgggactaaggacagtgagccctcccaatcactctccccttgtcctgctgctggtttctctgctctggacagaagaaaatcctgaaagcgttgtcaatgttcaagtggccccatgctgcaagagtctctcgcgaggggtgacgcccccttggccagtgtgctggactttgagtgtctgaggggtaagagggccaccccctcctcacagccgagactctatctaacctggaagcacactctggctccacccccaacccctgccatgccctaggccctggaagatgggaatcctggcccaggccagggtaaagggccaaacaggttagaagttgctcccctccaccaggcgtgcactcaccaagaacgatcaaaagctccctttctgcctacttttccaggggtactgggtgtggggggtgggtcacagctcctgcttcatcactcagcatgaagttggtccctccctgagccactcccagctacatgcacaaacatctgaaagtaggctggcctctctggctcacatctggagtggtcctgtgtggatacccat

SEQ ID NO: 6222 - DNA, 1327 bp, Homo sapiens
ccagcaggctctcaggccagctgcttgggcttcatcctcctcagatcttctgtgggtttctaaagctgccagccgagatagccaaggccaaaggaagcacatgcctctctcaggccaaactcacctgcccctcaactctcctccagagtcagaagtttctgccgcagccctgcagagggcacagaaaatggaagacagctcttatattgccatttcttccacaagagcccaggcctcctacagcttgaccgtgaggccagagacacaagccttcggcgccttaaggatgttctagcatggctgccaatgggagctcatggtgagggatacccatcccatatgcctgggcagaaggaagacttcatccctctggggctgttcacgtggtcctaatcttctgaacttggcgctgcccctggcagcccctgttctggcagagttgaagacagagctacacaggggaaaagaggagtttggggtatgggagagaagagaatgcacaaacagaggccgccattttggattcttatggacaatgacccagtggttcctaatcctctaggaggtctctaagaatataagtgggggagtggccacagaaaattcttctccactttctagccagaggagagaggaccccctgaatttctcacaaaggatgcccaaagatgcagccggtatttgaagcccagcagaggaaaagcagattccatggaagtcccaccggctcttgtgccaatggatctcactttcctggttagcaagctgttgtctaaaccctgttcacatttggaaacctgggctctttgccatcttctcatcaacaactccccattcctggctggttgaccttggcctcactctgtctttttgaaagaagagttggttgaagtgaaagtcaagttgtccctcctcaaaaaaggagttagtgtcctactacacagactaactttgggctaggtgagggaaaccagaagagaccaaaagaacttctggtctcctggacttaccaaacctagagatgctccccaggaaaagaaagtttccagggacataatatcatagctggcagaggccccaagggtggggaggaagaagctgcctcctggagaattaaccaaagaccccacacagagacatgaggccatcctggccccttgtctgttgtccagagcagctatggcattgtggggcttggggaagacagcagagaagtagcagcaggttgggtaccagccagggggtggacctatgagttccagcttgctgtgatgaatgctctagaggtctgtgactttaagagtcttggaaaagaatgagacatgaa

SEQ ID NO: 6223 - DNA, 1109 bp, Homo sapiens
cagcaggttaggctctggctaactagtttcccctgaggacaaaccttgttaaaaacagaatgctctggcatattttgaaatgattccttttccccttccactgccagaagcacatggggatttttctccaatattcacttaagaacctggtagaattccaggagtaaaactcacaaaagcgtgggggcccagtgaaggcctcccctgaggtttttgtctctcagacttatccacactgagcctccagcaactagtcaattacactttcggttttcctacctgcacaccgattcccatggaggtttctgctccattaatttgtaattctctctatttacctatctctccaattctgggggcagtggtttgccctgtgacctcacttctcttacagatctaagaagagttgttgatttttcagtttgttcagccttaactggttgttaggacagaatggcaactttcaagcttgtcatatgccagaccagagactggaaaccactactttttagaattttcaaaacaattaaaacaatccaaatacccatcagctggtggatagaaaaataaaatgtggtacgtctatacaaagtaatattatttagcaataaagaggaataaagtactgatacatgacactaatatggatgaaccgcaaaagcacacgaaatacaaaaagccagatgaaaagaccacctattgcatgattccatttatatgaaatgttcagaaaagacaaaaagtaaattagtggctgcctgggagtgggaatgaaaactataattgactgtaaatgggcacggggattcttactgggtgatgggaaggttctaaaacaggattgtgcttatggtcatagaactcagtaaatttactaaaaatcattgtacactttaaaacaggtgaatcttgtagaatgtaataatacctcaacaaaatcaattatcaaaaataataaaggtttaattggaaaaaatatagaaaggcattaagaatgaaacaagaaatgtcttctattcttatgttaaagacataagttcctcttcttcttcctcttctaaagggaattgtactgcacctctgccagaaaccctcactgttcacttaaa

SEQ ID NO: 6224 - DNA, 1175 bp, Homo sapiens
ctgactctttgggcctaggcagagtggggtccttaggggctccaaggaggttccagaccactgaagttctgcaggaaattcccaggcctcccaggccctgtggattctccttcagaaatcacagcctcattgggatgcggagcacgtggcggagcccatgccaaagatggatcaggagcctccgcgtgtggcctggctgggatgattactgccgctaagtaaattgccagtgcctcctcaagccccctcctgcctggctccgtgattcatttccattcagagaagtttaataattagcaaaggggatttctaacaacagatggtgccaggccctggggagtggttctgccgcagaagcacttcacagagaggtaagctggagaagtttccctgttccctccaaaagggtgtctccaggcctctgtgactattggtgggcccgtttatataatgtggctgcaagaagagcagaagaaaaggaaggtgtcaggtgggggaatgtggatgctgatgactgtgctggagaggagatggcaggcagcagtcttcttcactctgctatccacctagaagtctttgagcattgaggatcagagctgccgaaggccacccagaagcctccctgggattggggcaaggttctaggagctgccaagaacttctaagaggcttctgatatccaagtataacctttccccactgtccctctctggaagtggagcaatttgcgcatctctcatccttcttaaggcacagaggggaggacttagactctggattctcttgattttagaggcccaactctaagtgtgttaagtaaaaagggaattagcaggccctcagaattggcagtctaggggtagactggttcagatgtggctagacctgggtaatcaagccatgccatcccttgactttgcttctgtgaggcctagctgcagcctcattcaattctacggcaaaggcagccttccatttgtatgggaaggatgtttcccctccaagctcttgaataaagccctcccagttggcctggacttggtcatgtggctatcctggagtcagaaggatgatgaggctgctttgccattttagacacttgcccatctctatgtcttggagaaggtgctctatgactgacagccctaccagaaccaggaggtgaaggaggttct

SEQ ID NO: 6225 - DNA, 1164 bp, Homo sapiens
cttcttcgtattaagccccaggattaattagcgtgtcagcccaggtcatttatatccaagagccctgccccatttgattctcagcccatggactggggtgttgtgcctgcgccaaacgtgactgccagagctgtgccagtttgggcggaggatgggaggactctgaggcctctggagactcctggggagctgagtttctgtccttctgagcccctgcttgaaccccagctggagccagggagctacagtggacatggacagaaagagcgagcgagcgagagagagagaatctcatgctaaaatccaaacacaccaccttggctgggcccagtgccctctcccttttcccatcccccccatccctgggatctcagggttctggctggggctttaagaatttaggccctctggagtgtgctaggtgcttctgattctcaagactggcacctgagccggctgagcttggagctgaatgcttctccagcagccaggcatcgccgagcaccagcccggagagggctttcttgcaggtgccagaggggctctctgggctgaggagcatcgtacccaccccctctctttgtgcctcttttgggggctgaaatttcctcttagacaaggagatggatagctcagcagtgtgacagagtgttcaaacaatccgtcttgaatagatgaattgcattgctctgtctttttgtaattgtgtctatcagaaggagaggtcaaggcattgattgcttggatggtttgcaagtaacaaaagagagtgagggagagagcaagggagagagaatgattggattgtagtctgcgagaaaaaatgatcattgattattttatgtgaatatgtggaagatgtattctatgtatgattatcaaatgttgtgcattgaaggttttcaagccatattgtttggcattttattattattatcgtcgttattattgtttgggtgaatcccagtcttaacttacggaaggcagtttaatgcatagattctctcagccaaacgggcttcagtgacctcccgtggggacctgaatttccaggttacctgaccccaaatctgtagtggaggggctgctggacttggagccaggaggtctgggttttctgctgcatctgccaccagtttgttgggccatttccatcaaatcaca

SEQ ID NO: 6226 - DNA, 1160 bp, Homo sapiens
agggccatagaaataggagtggatctcttgggaatatctctgctgattgccgtcatttcattagaaacacaattatttcgtaaggctgggctaacggtgttggaaatagccaagtgcagcgctggagtgacagggaccacatcccatttgatactaattggtttgatgatggtaattgttgtattgcagacagttgtgactatctcctaatttaatataatcaataaggtaacaacagctcaatgcaaatgagatgtggggacccatggggccatttgtaagttatgttcttaatgcattttcctaattagctgtagcagattcccccctcccccaccttctctggagtgtgagagaagtgatcatctgagatgccatgcttcgctttctccaaactttcactttcagagaggctcagggagagctcatcctggagctcccaggaaccccaaaggctttcttaggaccagctgaaatggagtcagggagtcaacagttcaataggatacttcccttcagattcatgacaccccccagcttgaacctatgtagtttctctgcttcttccatctgattggaaggttctccaagacaggggttgtacttcttcccatcagactggccactttgtcactcagggatccatgtctgtttcactgaataaaggctccaaatgccgctgctggtgttttattcatgacaagccctcatggatgtgcgtgtgtgcatgtatgtgtattgcagtgtagcccagacagtgtgtcaggaatgcagcatgccagcagggatgtaacttaggtagtggttaaaagagactctgggccgggcatggtagcctacacctgtaatcccagtgctttgggaggccgaagtgggaggatcatttgagcatagcagtttgagaccagcctgggaaacataatgggactccatctctacaaaaaattaaaaagttagctgggcatggtggcatgcacctgtggtcccagctactcaggctgaggtgggcctgggaggttgaggctgtagtaagccatgattgcaccactacactttgacctgggcaacagagtgagaccctgtctaaaaaaaaaaaaaaaaaaaaaaaaaaagagtggttccagactgcctgggttcaattctcagctctaccttttact

SEQ ID NO: 6227 - DNA, 1224 bp, Homo sapiens
gcagagagaatatccagtgtaaatgtcagaataaccagagggagggacgtacacatgagattagataaataggcaggcaggggccagatcacagaatcctgtagggatggcaaaaagtttgaatcaatctctgtctctgtctgtttctcccttctcccttcccctacctctcattctaagagtgatgataagccactggagttgtaaggaagagaatgacacctcctaacggatatttggctgctgtgtggtcggcaacttttggaaggacttagaagacaaattcagaagacaaacttaagcttgtgccactggcctgggaagaagcttctttattcggaggtggacccaactgggagctctggccgcgcgttcaggttaactaggcggttgctatgaacgggcagcttggcggttgctagggctggagcgggctggggctccacgcagggcgacgcctaggcggctggagcgggggcggagccaggagggtgacggcgcgcgccgcgcgttcacaggaagtcgctctgaggccgagagggacgcgagcggaagtgacgtacgtcgtgcacacgtggtccggcgtggttcaggcgggtgtcttcggccgggcttgggaacataaaagtttgtttcaccacgtaagccggacctcgcactccggtcccggtctcgtcgccaagatggtgaagcccaagtacaaaggacggagcaccatcaacccgtccaaggccagcacaaacccaggtacaggcggcagggctgatcgagggtggagcttggaggaagtatagggaagggctccgaggagcactggaggggaaggagggttactcgagtggcattgcttagaatgactacgagcggggtggctgttggggatgaaaagggaaaaaggaaagcaatatttgtggtggtttcttctcaggggggaactgaggagggctcagtgcacgcctggcaggccaaagtgtagtcaactggtctgaagtcaaggaaagtgaacactcaggctgacagccttgggtcctctccagttgagagatgcagagaaagtcagattaaaaatggtgtaggttgacccttcgggccttttacacgtgatcatacttgcctgccaccttagctttgacctttaaaatgagaaagggcttatagttttggcccttggaattattctatctggtaaagtgcttagagaaccctacaaagaagtcagtatga

SEQ ID NO: 6228 - DNA, 1724 bp, Homo sapiens
gaacccgggaggcggagcttgcagtgagccgagatcacgccactgcactccagcctgggcgacagagcgagactccgtctcaaaaaaaaaaaagttactaaacaaggctgggcgtggtggctcacacctgtaatcccagcactttgggaggccaaggaaggtggatcacctgaggtcaggagttcgagaccagcctggccaacatggtgaaaccccatccctactaaaaatacaaaaattagctgggcgtgggtgcctgtaatcccagctacttctgaggctgaggcaggagaaccgcttgaacctgggaggcggaggttgcagtgagccaatgtggcaccactggactccagcctgggcaagagcaagactgtctcaaaacaaaaacaacaaacaaacaaacaaaaagaaaacacaaaaaacattactaaacaagatttctagagggaattaacaaaccagtgcttatttaccaataaactaatacgctaattgcaggaaccctgattaaagcaggcccctgttaacacaagattcttaggatatacttggaaacaggtgcattggaaaccactgtactgagaagtttatgggctcaagactgaattggaagctaggcgtggtcgctcatgcctgtaatcccagcactctgggaggctgaggtggaaggatgagttcaggagttcgagaccagcctgggcaacacagagagacgtgtctttaaaaaagtaaaaaatgggctgagtgccttggctcatgcctgtaatcccagcactttgggaagccaaggcgggtggatcacttcaggccaggagttcaagaacagcctgaccaacatggcaaaactccatctctactaaaaataccaaaaaaattagcagggtgtggtggtgcacacctgtagtcccagctactcaggaggctgatgtgtgagaatcacttgaacctgggaggcggagtttgcagcgagccaagatcgtgccactgcactccagtgtgggcaacagagattctgtctcaaaaaaaaaaaaaaaagactgaatcagaattttgggaactagggtacaagagggaaggggaggaaggaggaaatagaccccagtggtcacctcaaggacacccagccccagttaggtaactgatattaagccccaccagagagatgagcaggcctggccacctggctttggggcttagctggggaaaccaaggcaggcagggacagctgaaagggttggatgttgacctgtagtaatttacagaaggtagcaacactggcttcatttaacacacacacaatctgaaaaatactaaacatgggaaggccagggggcagaggcagccattctcacacactgctaacagcagtgtaacttgactcagttcttttgaaggctaatccatactgagagccataaatacttcctacactttgacctactctcctaaggaaataattcaaaagaagaaaaacaaaccatttacaaatatgtttaatagcagcatttctttaaagaaaaacaaagttcaaatgcccaataataattatgtttaacacttggtacacatataaatagacaaaaggctgcggagaacactggatttaaataaaggtgttatgggtataattaactataatttattttatgaataaataagaaaaaagtccctggctataaaggatagtggaggtttatttcccaatattcttccatttggactga

SEQ ID NO: 6229 - DNA, 1219 bp, Homo sapiens
atgctcttccttctccctcttctcaggagttccaggatctctggcctcagttgtccttggttattgatgggggacaaattggggatggccagagccccgagtgtcgccttggctcaactgtggttgatttgtctgtgcccggaaagtttggcatcattcgtccaggctggtaagtctctttcctgtggtgtggggaaataatttgagggaggttggagagatgcaaaaaagctttgacaagataaagatggtgcctcctatgttgccctgaaggagtgtgggccaggtttggagaagtggtagttgcagtgggactaagtttcctggctttcttaggattcaaaaggtttcatcaagggttgatgaacagggcttaacaaggctagccagtttcgatgtccctgctcaccagcctctggtgggctcgggacttctgagaagtcagactggtaactgtcctgtttcctcctcagtgccctggaaagtactacagccatcctccaacagaagtacggactgctcccctcacatgcgtcctacctgtgaaactctgggaagcaggaaggcccaagacctggtgctggatactatgtgtctgtccactgacgactgtcaaggcctcatttgcagaggccaccggagctagggcactagcctgacttttaaggcagtgtgtctttctgagcactgtagaccaagcccttggagctgctggtttagccttgcacctggggaaaggatgtatttatttgtattttcatatatcagccaaaagctgaatggaaaagttaagaacattcctaggtggccttattctaataagtttcttctgtctgttttgtttttcaattgaaaagtaattaaataacagatttagaatctagtgagagcctcctctctggtgggtggtggcatttaaggttcaaaccagccagaagtgctggtgctgtttaaaaagtctcaggtggctgcgtgtggtggctcatgcctgtaatcccaacattctgggaggcccaggcgggagaactgcttgagcccaggagttcagaatcagcctgggcaacatagcaatactccgtctcataaaaattaataaataaaaagtctcaggtgaccaaaggctcctgaagctagaaccaggtttggataaagattgaagagccacaggccactcttccctctgagccattgggcctagtggtgtcatgtattgtaattg

SEQ ID NO: 6230 - DNA, 1151 bp, Homo sapiens
tcctgtgagcaaagccgacaagcagagactccttcagaccctcagacagaaacattaagtgccatggatgtgtcagagtttctatccctccagagcctggacaccccgtccaatctgattcccattgaagcactactgcagggggaggaggagatgggcctcaccagcagcttctccaagtgaagggcccatgtgtgctcacctctgggaaaagcgggtgagcaggaggcatgaggtacaatgcctgccatcatgggtcagaaatttgaaggatgaagaaatctactgtttgaaatcctcacctttcagacgtattttctttattcacatcccaggagcatccattttaaggaactattctttggaaaaaaacaaaaaacaaaaaaaacaacaaaaaaagctaagttataagtgaactgtttggctgcactgtatgtcacttttgcttgttgtcatgtgaacttggaaactaaggttactcgtgtgcataaaaattctaaatgaaagggtgtggtttccatcaatctgatgctgcccatcgcttgcactggggtctttgtggatcgggcaggagttttcagtgtgttgggtgttgctccttcctatgtgtcttttgaatctgaggctgacatttgcttggaaggccagacccttgctccatcagagagggcagtggcaaaggccagtgaggcagctgtgagttggacagggttcaggtgagatggtgttgtcatttgtgcttagtgttggtggtgctcagggtggataacacgggtcgttctgcagcccgcttcagcacaaataggcagcttaaggcctggctcacaggctgtggggttgatctggctctgcagaggccctaggcagcttgttgactgctgtctgttgatgacgtgtgtgcaaagcaggctctagcaacatgatcactgtccttgccttcctggttctttctctcggttggttgccagggcttgcagatcgcagtgaattttccttggggaacatcgctgttttgtcctagagtgaacttgtggcttatggccagtgctgtttggtggtctgccttctttttaatggtattttcttcctcagagcagaagggctgcattttgcttatcagaagaaggtgcagatttaagggaattcatatg

SEQ ID NO: 6231 - DNA, 1165 bp, Homo sapiens
acaatgctagtcccggaagttgtgtcagtgaacaggataaacgtagtccttgctctcatggagcttacagtccagccgggaagtagctattcacccatttaattggacaaatatttatttagtgcctgttgtttttcagataactgttgtgcctagccatgaaacataatgatgtaaatggtttaatcaggtaattattgcatcttaattttatcatgtgctttacaggaagctctgaaaacctataattaggatgcctattctagtctgggatagaagtaagggtcagtcaggaagagttcctagaggaagggtcatttagtggaggcttgaattgtgcaaatgaaaaaacatgaatgggagtagagtttggcagggcagggagacaggagggggtagttaattatttattgcagttacttataaagttaacaaaagctgtagcatcttaagagtgaaattctgctcttatcattcagcattgttgtaagctttatgattgatacatgcagactcctttatcccagcatccacaatcccatttctccttagtggtgagtgatcattttcaattctctatctggcagcacaaaggaggtttttagtcttgatgggaagtcagaatatatgcatgagacaataattaacagtataaactaagtgtcaaatgagtggtatagtaagtattactggcatttagagaagggcactgtcatgtagacatggaatgatggtgaaggagcgtgtagttcctgaggctcgcgttaaaggaagagaaggactcagaaaagcggagaaggaaggaactaggcatttccagtggagaagaaggagagaacgaagtcagggaagtaggaattcagtcttgcaaatgggtaagagtgtactgttgcttataggcctagacagagtcttctgtttggctgcttactgagtaatgtgatagaagacagaagcagccctggaaagatctttgaatgttaggctaaggaattgggactttatcatttgagcagagagatggaatgtgtggaaaactgttttagacttaatctggcaacaaatgactgcaaaactaggtcctgagacgtgagaagaatgcctggattagtgattcaataaggaattcagtttaacaaatatttatggagcttcttctgtgtgg

SEQ ID NO: 6232 - DNA, 1565 bp, Homo sapiens
gtgagccaccacgcccggccttttttttttttttttcttttttgagatggagtttcactcttgttgcccaggctggagtgcgttggcgtggtcttggctcactgcaacctctgcctccttggttcaagcaattctcctgcctcagcctctcgagtagctgggattataggcgtccgccaccatgcctggctaatttttttgtgtgtttttagtatagacacggtttcaccatgttggccaggctggtctcgaatgcctggcctcaggtgatccacctgccttggcctcccaaagtgctgggattacaggcatgaaccaccacgcctggcctaaaatgtttttaaataactgtacttgtactcactcaccctacctccagggcatagtcagtctgggctgagatccccatgatcagatatttgatggaaagtcctgaaaggccaatgagttggatggcaagaatgcaggcagaagctgctggataaaataggctacagccacctcagatgctttcagtgctctgtctgaggatgtgtatatgcatatgcaaactcgacccccgttcctgcccagataatggctcaataactctgaggctggttgctcagcctctgagggcaatacaggcatttaaaaaattaaaatgaccaggcacagtggctcacgcctgtaatctcggcactttgggagactgaggtgggagcatcacttgagaccaggagtttgggaccaggctgggcaacacagggagaccccctctctacaaaaacatttttaaaaaattagctgggtgtggtgatgcatgcctgtggtcccagttacttgggaggctgacgtgggtggctcacttgagcacaggagtttgaggctgcagtgacctatgaccacatcactgtacgccagcccgggtgagagagggagaccccgtctctaaaaataaaatgtaaaatcactgaaaaaatgagtgttcggtgaaacaagtgggattttctgggccagcaagtcttccaaactgtatatgatgcatcctgtctccatgtgtaatatattttaatgataaatgtatttttaacagtggcggttgtgtatgtttttatgtcttaagagatggcagttcgctgcagctggattttgtggctcaagccttggggccaaagagacatattcctggcagtctggtgggtaccagtcactattcacatacttccagcaagaaatggttatggcactgacctgaaccccttgacccctggtctggtctttggagttgtcccactctgaatattcgagagaagcagcttatggttaaaacaggcagtggcagctgggaggatctaacagctagatcctccaggcatttggaaaggacaggggcataacgaaggcagaatcgcttcctgggtacgaatgcccactacttctgggcactgtgaaatgggtttaagacgcgggccagcaggacaatgtgaacggtgaaaggaagggagtggccggtaggtggcgctaactggcccgggcatgagtcccgccgtagccgcgtcctcttgcaggggaagaaagttggg

SEQ ID NO: 6233 - DNA, 1140 bp, Homo sapiens
taagtgcagcagctgcaagcgccccatcgtaggtgggacaagggtcaaagaacggagtgggtagggtgcaggcaagggagtgggatgtggtattgggtgaggttgagggccggaccatccccacatctgcatagctaacttccagcctccctccaggactcggtggaggcaagtatgtgtcctttgaagaccgacactggcaccacaactgcttctcctgcgcccgctgctctacctccctggtgggccagggcttcgtaccggatggagaccaagtgctctgccagggctgtagccaggcagggccctaagccagggctcctggacccaggctttcccataccacgggcccaggactgtggctccttttctaaaccacctctgggactcagctccccccgccaaaaaaaatgggtctccttctgggctccaggattgtctccccactccagcatccccaaactggtactccctgacccagggccccaaacctgggctcttacagagcctccatgagtcaagccccctccccacacctggactccagaattcaccctctcccctgcagtctgggttcccagactgagtcctctccccaaatcagggctctagacccgagccctccaaacctggactctgggacttaggcccccttaaatctagacttctctttataggtttcaggtctcctatgggtgcctgggaagtccttgaaagtggactgttctcaggcttgacctgccccaccccatccccgcggttgaggctgtgggggcagcagatcaggagcccactgataaggggccctagggtacagggtgctgcccagcaggtcgccaccgagtgtcttctcattttatttcagctccattttgcccatagatgggcagaggggtgagattggctcatcccccttccagattctgcaataaagcggtgtgaggaagcaggggcctccgtgtgtgtgtgtgtgtgtgtgtgtgtgtgtgtgtgtgtgtgttcagggtataatggggaaggaagggtttttgcagactgggaggctcagaatctctgctagacctcatccttgcagggtggggtggaggggggccgggccatggggtgggaagtctctccccatgaaggggatccccgcca

SEQ ID NO: 6234 - DNA, 1212 bp, Homo sapiens
ctatgttctgagtaccagatgtctgggttctttcttctgcattagataaatgatcatgctcagtgtaacaaagggaattaaaagttttcccacagtccccttctaggggagaaactcattgtgtcactgaaatgtttagcttactttaatcttgatatcagcctctacagaccttttattctaagctatcgagcttcttgattgcatttggttgaccacgagtgaccctaaggcattgggggactgtccactgggagttggagtgagcacgtggtgctgcaacaggcattgttttacatactttgtctctagtattctgacaccaagtgtcaactgtggtactttctttgcctaggatatgaattcataattgttgcttttgttgatggttgataccctttccattgatttaaacctaacacattatttctattccacatgcccagtagacatatattccaaagccactggaccacttgagtacataagtgccactgtttaatgcaatatgtatattcaggtctgtaaagctaacagtgtgacttggagtgcttcctgcaggtgattctgacttgagtatttacatggaccatggtgatatccaaaagaaaaatgctttttatatttatagattatttcattgaactatatatgaaatgggtatcaataaatgtatttactccaaaatcagcgtttctccttgcctgaggtatggagggtggtggcggaacgttgggttgtcccactttgccgttttctcatccatttctttttcttttgctgcttcctgtggttaatgtttcttatgtgtcagagcttcaggttctatcccgatgtgggaatttcatggccttgtgtctaggtatctcccctggcccatttctgctctagggtagtaaatctaagctcaggtgaaaatgtttttggttgggtgtttcatatacacaaatctcacacatggtggggagtatcctggtcctggcatcattaatgtgttaatccaacctaagaaggagtgaggagatgagtgaagtaaaacacacttaaacaattgtaccgattccagcttgttttctgtttcctccagttgctgacatactcattgactcactcttaaatgtcagttaaataattgtttgtctatacaaacaggttgggtctaaactaatcagagaaaaatagacattagtttatcagtgggaggaagacaga

SEQ ID NO: 6235 - DNA, 2425 bp, Homo sapiens
tgacctcaagagatggctgctgtacactttttgcaactggtttgatgtcacatttcagctccaactttgcatcctgagaacacttaaacgtttctgcaggtccattttatacaacttgaaagaccgtaaaactttctggttgccacaagcatatctttcttttctgctcatccaataaacagctgtgccctactgtgatagattttccaaacaaaaatacctggagcagcagtttagcaaaatatgccttcagtggcattcaacaaatggagtttccccaagcacagttctgtaagaagtgcgtgtgagagtgtgtgtatatgtgtgtatgtgtattttaagttattatttgtattgtgcaaaaatttttttttgatcttggggattctggctgtgaatttggtgcacgacaattatggtaaaaaaacatttgcttggtctaaagaagatcattaatgttttgtgaccatacaagttgtaacagtggattgtttttatgtgtaggtattgttaaatacagggactgtttccaggcacagaatatgaatcgtaagttaggatggacattagatgtgattatgatgataaagcgaaggtctgcggtcctatatctacagacacgtggtgagaaattagaacaaactggagacgggccattgacacatggactctgcctgggcatgttaggttaattctttgactccaagccttaaaatactcacatggagtcagcgctcacctcattcacacaattatcatagagctccctggacactgaacctctaaagggaaaaggtctaccctggagccaggagcatcagggttggcttgggagcatgagaggtgagcccagggctaggcctgggccaggccccggcagcactgctacttgggaggagccacttcacctttgtattagttattaaaaaatataatttgggctgggcgcagtggctcacgcctgtaatcccagcactttgggagtccgaggcatgcggatcacttgaggtcaggagttcgagaccaccctggccaatatggtgaaaccccatctctactaaaaatacaacaaagttagccgggcgtggtggcaggcgtctgtaatcccagctgcttgggaggctgaggcaggagaatcacttgaaccctggaggtggcggttgcagtgagcacagatcatgccactgcactccagcctgggcaacaaaacgagacttcgtctcaaaaaaaaaaaaaaaacatagaatttggatcctttggtcgggttctcccaaattcttttgaggtgtccatggtcaactgcttcagctttgttttggcaaccccctgcccgaagtcgcatataggctgttcttcaccttgtttccaaggctgaggaacagaaagtagcctctgttttgaggaggtggaagttaagtatacatttattttttactgtgacttgttcaggaccacattttacaaaatgccttgtttccttcattgtttctggaaaggaaagttctattaatattgttttactttgaatatagaatagtttttttaattagggcttattttgaaaaattctgagtttaattcaaatgtatgccaataccttccaaagtaaggtaatattcagagacagttgttgtgatcagatggcttagagaaatttctggaatattcacattcgaagattccttattaatgaatgtctttgacttaaatctaaccaaaaactgcaacattattctttgtacattttcattatatagtgttaacaagcttagttgcaaacaaataaaatacttaagctatttgtttaccttgccttcttaatactgtgataatgtttattaattcaaataacttatgtgagagctgctataaccatttccccagttcaacattgcattgaaaatttatggacctttaaaaaaaaaagcccaacagtgatttttttttaataattaaagaatgattttactttgtatttgaagggtgatttgtttcatctcttcttttttcagggtagtcacttgttcctaaaagaggaacatagcagtggctgtaatgggaatggctctgcagtgggctagtcacaccaaaataaagaaagggcagctgtgggagccatcagaagctgtggaggctggactggtaatggggaatgctgccccactgaagtcttgttttagagatcagtgtgatgtgctcacttaactataaagtgtcagtccccattccaactaagtggctcctggctgggaagtagagtaggtttctctaaggaaaatgacacctgctcaccacccgccccactataccacattgttgttaggctatcatataatgataaggtagccctctgaggccacaaggtaagaccaaaccaccagggctgggttttgggatcccctctaaagagaccacacatgtttgt

SEQ ID NO: 6236 - DNA, 1208 bp, Homo sapiens
ggcctgctggaggtaggggtctgtttttttcctcccacataaagatttgccttggagctcggatttcagccctgaaggctctcttgcgagacacttctgcaagttaatgcctaatctgcgccttgggtgtatggggagaaagttttgacagacaagagggcctgtggactgcatttccctaactgctgtaggtgcccctgaatggaagccagggatgcgtggccttgggaggcccttgccttgatctttaacatccggttctgggagtttgctttggctggcagttatgctttccacagacggggagattttcccagaaacgacacaggcagcacttttccccattttattcagctcgggcccttgtgactaggcccttagtttctttttatctgaaggagaggaaacttcagcccctatgactgagtccagcgtacttgtttacagcacctatccagtgaagggaaactaatgaagaagctgtaaaacgccccccctctcccccctcccccccactttttttttcttgtggcattggaactctgcttgggaatgcagcaggaaaaaagtagagatgaaatgcgaaaaaagacctactagggtttttgcttgttccctctgcatcagctcctgtaaactgtccagcttttcctgcctgcagcaagttttctgtcaaccccctgtggtctttctttttaagaaatgtggttcatttcagagcacaaagaggttagattgtgctgctgaacttcattgaaaaaatgctgctcagtgaatggttgcattaagtttcctttgcaggcttttgagtaacactgctctcttcagagagaggagatacattaggaccgtcccgggctgtgacagcttcaaaccagcagaattaagacccaaaataggtgaagaaatctcagcacctcactggatggtagtactggtgacctccagcggaaaggaagttggactcctagcaaatgaggctgggaaagaagggggcagtagggcttgttccaggagagacctcttttgttcagttttttttttttagctgtctcactcagtttggctttcctctgaagggccttgatcaggtgtataggaacttaatccttcccagacacaggtctctttcttgaggggaggaatgagttaaaaatggttgcccaaagtaaattacctcgagttgtatacggtggtcgtgcagtctg

SEQ ID NO: 6237 - DNA, 1208 bp, Homo sapiens
ttcagctgcccagacacccccacgtctttactgggcacattccagcagtcctaaagtcctgaccctcaggagtgaaattctggtctggtgtctcactcctggaattccttcatgaggcatggctatggcatgaatcaggtgtcagattggaaagccaagagatcaggtggcttgtgatcataatataaaaaatttctaactggtaaaatggttttggagacttaatgcgtattgaaagtttctttctgctttattgtcagccttagccgcctcttgatggtctctttagttcctttcctggattgtctaggagcatgctggaggcagtcagaacataaggagttaaattgcagtgaacttatggagaatgattaaacagtgattaagtgatattttaacttctgtttacaggggagaaatggatgtcatcaggaaaagggtttgtttgcagttttgactgaagtcatcttatcttagccagggctgcctgcccttattcaatttcatttttagctgcaaggtgaactcccccacacacttattttctgatgtccatctttgtctttgctcatattccaccccttcctttctttccccagaccccgtgttgctctaggaaaacttgctccactcagaacagagttggggtgggacttagctgcccttctgcatcttctgtttctggaagtctttgggatgaaccatacatgggagagtcaggatactggaatgccattgaactagtggaaaaagcactagataggcaattgaagaggcctgggtttgaattccagctctgctacttattagctatgtgatcttggacaaattacttaatctctgtaagtcttagtttcctgttctgtaaaatggaggtgataatttctacctgaaagaataggaattagagaggattagagttatatatgtaaagagcattgcctgacacacacacagtaggcattcaattatgtgtgatcaaagaggtcagagttgatggtagaatttagactgtctcggttagccttttgcctgtttttcccagtgctaattgtatagtttatatattatagtttaaagttatgctgccaggcgcggtggctcatgtctgtaatcccagccctttgggaggccgaggcaggtggatcacttgaggtcaggagttcgagaccagcctggccaacatggtgaaaccccgtctctactaa

SEQ ID NO: 6238 - DNA, 1147 bp, Homo sapiens
ataacactttctaaacacttttccttctatgatctcatttttatttttatttttatttttatttttttgagacaaggtcttgctctgtcacccaggctgggacgcagtggtgtgatctcggctcactgcaacctccgcctcctgagttcaagcaattctcctacctcagcctcctgagtagctgggactacaggcatgtgccaccacacccggctaatttttgtatttttagtagagacggggtttcaccatgttgtctaggctggctcatttttatttttatcatatctttgtcaaatggataaggaagattttatttttaaaaactatactatagatttaaatcctttccttttttctcttcttccatttcagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgtggccatcagctcctctgaagatgaaggcaatctccgatttgtgtatgaactactgtcttgggtagaagagatgcaggtgggtgcatatccaaaagcttatgcagtacactgatgtttactggatctggaagcttatctaagaggaccaaattgctttgtgttccctgtgcagattcccttaattattattattcttttatttgagtgatggggtcttgctatgttgcccaggctggactggaactcctgggctgaagtgatcctcctgcctcagtctcttgagtagctgggacaataggtatatgccaccatacctggcttgactttcttaattattgatgctgcctgagacccaagcccccttctccttaaatcttgcatggatgaggttggcacaaattctcacagtcccgtactgaatagcatacagttttctcatttgaaaccctttggaatcttttccctcagctaactgtactctgagtgagagcttggtgaaaattgcaatgtctttacatctgttacctttttttttaattaaaaaaattttttgtgggtacatagaaggtac

SEQ ID NO: 6239 - DNA, 1164 bp, Homo sapiens
caataaacaggctgtgtgagaactgaaattaggctataacagagatataaagaaagtgctctgaaagcatagtaaggatcagtatccagcttcacagaagagctatttaaattgagtcctgcagttaatagaatttagagtcagtggaggacattgtaggctgaatagtctaagcaaagccaaccagtcattgatacccatgtcctggtgtgtcatgtactggtgtgggtactgacgtgcaggaactgtccactccagccaagttatctcttgtctctggtccaatgcttattctgtgttcccccattttactcacatctgggtcaggtcccatgtcctttgtgaatcattttccaataattccagtgtttgtgcccttctctgcaatcctctggcatgcactgtttatacatctcattttgccaccaattctatattgtaggttcctttaaaatagggaacacagcttttatttatgctatccgctccccactgccaagagtgcttatgctgtaaaattgaattccattttcaggagttgacaatggaactggaggagaaacaggatgtgtttcgttctctacaagatacagcagaactactttcacttgagaaccacccagccaagcagacagtggaggtgtgtgacttgagaatgtgtgaaggtcaaatgctgagaggttgttgttataaaagtattcaaattagagactttgttccactgaaagacttggaggaagtgtcagggaacatttgtcttgggtcttctctcttttcattcctgactgttcctatgtccctcaaaagcctgcaaacatttttgttagtctaaggaaactactaagagaaacaatagaaggggcattggctcacagctttcagaggaaaagtgacttggaccatatttcttcaaataactatccagacagatcctgacttgactcttgttggtgtggtgcctttgccaaaagaagagaaacagtggaagaattccagaggaatttatttatgcctgggttttgctgcctagatcatttacttacaactgagtgtggaagagaccttttctatgtaaccccctctaacaaaaccattttggattaaaggaacacctcttactcgtgggaagcattgagcagatgccagtcaagtatctccacatct

SEQ ID NO: 6240 - DNA, 1238 bp, Homo sapiens
ccttaccccaggcttacattccattggcaagattttttcagaaggagcttttttcattactgtgagacttttccccacccaaatggagtaaagtggactcaggaataccattttagagttcgagacctgaggttcttacaagctagaagcagcaatttgaatggtaaaggaaattcctaattagaataagtaacatctttggtcttcttggcaagggtagaaggttgcaggctttttctcactctgtaagacaatcatgtcttttgcataagaatatgtagtaggtgaatacttgtgaacaattattaagagttatgtccagtggggcacaaagggtggttctggggtgctggtaatgttctgcttcttaatctgaatgctgactaaatggaggaattcaaattataaaaatcaacatgtttacgattatggtttatgcactgttttgtatatatgttacttcagtaaaatggaggaaaagaggaagtgttacatttttattctgttgcaatttcttctggctttttctttctagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatggtgtgtgcactgggaagagggaaagagaatagtagaatgagagcctttcaaggggttgctgtgaaacccttcatataaatgagagagtaacatcaccacttttttccatttgagtagctacgaacttgagatagagaagaacttatagatgaattctcaaaatcagatcatggaagaagtctgttgatatttcagtcattactgctcatcaacctatcacattttcttgtggctgtaacatgtttggactctcaaagattagtatacagtatgtgaaatttaggatcaggtaggattaggcagaagattccctaaataaagccttgctttcattagtaggatatcaggtctgcttatctctgatgtcgagcttactggtcttttgtgtttgttcattcacagaggacaaagaggagactgtggccaagatgtacatttcagagttgaagaacatccggctacgcctggaggagtatgaacagagggtggtcaaacgaattcagtctctagccagctcta

SEQ ID NO: 6241 - DNA, 1201 bp, Homo sapiens
ctggttagggaaatttgtagggagaggagcttaacaactcataagttttcattctaattgaagtcttatcacaaagctggttagactagagaagtgatatgacttattggaagtagcaggaaataatgactatttttcacttctctcccctctctccttgagaaattatagtgattcataaatcatagctgtgctgtactgacaggtactctgtcatcagggaatagaactgtacagccaatactaccttattggtcaccctggtaattcttggcaacctaggtgaaaaatttgacaaggattattgtgggatgctagaccacaaggcagcatccagggctagcaggtcacaactggtttctactcacttttttgaccatagggcactggtacatgcataggtctcactcagccttgcatcgctgttccccgtagataaagatggatcgtttgtggtcaagcccagctggatacatgggttaaagagggaattacctcatttactttattgtatttgtaccaaggtatctgatagcagtttccctttgttcttctagccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggtgagtgtggtagtagctctggcgagaagagttagaaatttaaattttctttatcataaaagaaaatgatgtactggcaattaaagcttcctccaaatggaagatatccaaattcccttttctttgagtggtttgagcaggatcgtcccaagatactggttttgcatttagactagagaacctgtaaggtaccttcagttctgagtttctgtaactgtattgaaaccactagatggacagattaaaattatctttattttgtttttttttatattacattttattttactaggattagatatggggttttgaaaaccaagggaaaattgtaagtagaagaaaatgattcttttttttttgaaaatgatttattttaagcattttttttttgttggtattttgttttgttttgttttgtttagcattatggttaagagtatgagatctggagttgtattgcctggattccaattctggctca

SEQ ID NO: 6242 - DNA, 1124 bp, Homo sapiens
acttcagtttttagtgttcataaataaagttttattctaacaaccacaccctttcatctatatattgcctatggctgctttcacttataatgagagagatagtatggcctgatattttctgtctggccttttacaggaaaagtttgctaacctccagcatgagtggtcaccaaaacgcttccagcaataaaaagctatgatttattacatgatgtatgtgaattataaaaccctgagtaactgtagcgaaattcatcctttcctaggactatgaattgcaactgatgacatacaaggcctttgtggaatcgcagcagaaatcccctggcaagcgccgtcgcatgctttcctcttcagatgccatcactcaagaggtgagagggtgggggaaggaaatacaccactgtcttcccttaaggaaagattcatttgcctgggccttacattttgatttagggctcacttttctggtgaacatgtgactgcatgaacatttcctcttattttgaactatttaaatttcattttctggcagacgatttatttaaattgttcttttgaaccacagttcatggacttaaggactcgctacacggcattggtgactttaacaactcagcacgtgaaatacatcagtgatgcactccggcgtctggaggaggaggaggtgaggacagttgggtccaaagtcatcttgaaagtacagtaaaacatcttagccagcacggtggtgtgtgcctgtagtctctggtacccaggtggctgagttgggaggattacttgagtctaggagtttgaatccagcatgggtgacatagggaaatcccctctctacaaaaaatatttaaaaattagctgggcatggtggcacacacctgtggtcccagttacttgggaggctgaggtggaaggatcacttgggcctgggaagttgaggctgcagtgaccatgattgtgccactgcactccagcctgggcaataggctgtctcaaaaaaaagcccaaaatatcccacataccccgtaaatatatacacctactatgtacccacaaaaattaaaaaaattttttaaaccagcaaaatatatgctatatatgtaacatataattaaattattatataa

SEQ ID NO: 6243 - DNA, 1174 bp, Homo sapiens
aattgtgaaatgaaagctggatagctagacaacaggtaaataagaatgtgttacattcttctgcctgtttaaaatattttattttaaaaagaaaataggtatagaaggagtaaagaaagataaaactgaaaggtagagttataatcatatagtggattcttgaagtctaagatttcagaagcagaataatttcagatgataggatctaagtttgacatttgggggtggggctaaagtggagatgaggtcatttgaactacaagcataggggtgacatagcattgacatcatcaagaaccatgacttgatttgagataaacagaagaactgactgaaatgccaaagtctccgatgaatatggaagaagatcatccatccaagatgaagaagtagcaattttgaagcaatagagcagagtttggagattgtttttttttctcctaaaaaagctttaatgcttcatcttccaggctctcagaaaaagagaagaaacaaatatctgagcaattgaatgccctaaacaaggcttaccatgacctttgtgatggttctgcaaatcagcttcagcagcttcagagccagttggctcaccagacagaacaaaaggtacttttagttttcatctccaaatattgggtggataccttttgaatggtatgaaggcagctttgctgattcagagtcatgatcactagctttccatgaccaatgtgacttaatttttaacctcaccttagcagccatttgtcttgtgtttctttactggggttccatgatgtgttggtcagtcaaaagcactagaagacacttacaactaaccctttagacctggttcaccttttttgtcttatgccattttgtggcagacagcagtctaggagaacataaattctgtattatatgtgatcacagggcagtaacatactcccttgtggcattgtcactcaaaagttgatagccaaaagttctggatattgggaagaaaaacctgtgaacctcttccctctatactaaggcagtaagaaatattaagttccaaagcaaactggtagagtagtttcactgactaagacgctggttcccctcacccatagtcatctcatcatgtggcatcttgaccagttcccctccatattcatttcctggaccatgtgaaagtcatcatagttcctac

SEQ ID NO: 6244 - DNA, 1215 bp, Homo sapiens
catattcaagaaccgaaagaaagctagttcgactggactgcaaaaaacaagaggaaaattagggaaagttgaagttggaggggtaagtgggacctgtatcacactggaccccgcaggccacattaaggataaggagtgatacccaagagagtataagggcccatcaggcctcgactctgctaagatcatgttgtcaacacttctttatggaaagaatgatctctttgaggataatgcattgcaaaatgaaaaatctctcatgttcatgtttatggacaacctccttttttggcttcactaaatatttgcttagaaaacaaaatcaaatttctttgcattgatttaagcctaaacctgaagcaaattgtagttagggactatatacaggactatatgtcatcctagccattccatctttataccattagaggacttagaagcactaaagtcgaaggctctgccattcctattttcttgtgttaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaaggtaatagactgctatgacgcttgatatttttcaaaaaagaaaattttggtaccaacacaaataaaagacagtgaggggaaaacaggcttatagcatgcacagaatcatgaggaagggctacttcaggagctagtctggtttttgttttttgagacggaatctctgtcacccaggctggagtgcagtggcatgatctcggcttactgcaacctctgcctgccaggttcaagtgattctcctgcctcagcttcagcctcccaagtagctgggattacaggtgcctgtcaccacacctagctaatttttgtatttttagtagagatgaggtttcaccaggttggccaggctggctagtctgtgtttttacaagaatctttatttttacaagaaatgtccaggaggagtttaagtcaggacagttggtaaaaagtacatattcctattcctccccaaacccccaaacatcttgctatctgtatactcagtcctctgactaa

SEQ ID NO: 6245 - DNA, 1188 bp, Homo sapiens
gaaacgaaagataattattcttccttctgggcttctcgaggacagtacttctagtattaatataccacttaagatttgatttttatcattaattgtgatgcatcttcctctgcctatgctctgttttaaagtcttaagttgtagatgtcagataagatacttaagtatctttagtcctcagcatctagtacaatttctggttctttgtatgcagtaaataactaatgcttattgaacttggctctgatactaatgcatttcaaacttattccttctattggtcttaatgtcaattattattacaattactatgttcaatgtaggactgggcatggtggctcatgcctgtaatccaggcactttaggaggctgaagtaggaagattgcttaaggccaggagttcaagaccagcttgggcaacatattaagaccacatccatataataataataataataataatttttattatttattatttaataatattaataataaagtctttaaaagcataatacaaaaattgtctccactctttcttttcatggcctgatttttcagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatggtaagatctgtgtcccaagagctagcatagagggtatgtttgctatgtgccatcattacataatgttgaaaaagtaacaagagggaacctaatatctgtgaatcatctaataagatttagaaatgataactaatctatgtaaagatatttctacccagttgagctggaatgaaagtggagatagcaaagtcatgtggtagaaggggtggagaactaaggtgatgagatgtgtggtattctggaggctcggttgcagtcctccagtcccccttgtgagatagcatatagttattagtttgtggctcagatgtcctggaataagtgaaccaggagctgacagacgtgttcttcatgacagaaattgaagcaggacattgctcggcaaaagagcagcttggaggccacccgtgagatggtg

SEQ ID NO: 6246 - DNA, 1131 bp, Homo sapiens
cgtctcagcgccctgagtcgctgggattacgggtgcctgccaccacgcccggctaattttttttttgtatttttagtagagacggggtttcaccatgtcggccagtctggtcttgtactcctgacctcaagtgatctgcccgcctcagcctcccaaagtgctgggattacaggtgtgaaccaccatgcccagccattatcttaattcagagctttccttcctctaggcagaattagatagaactcctcttatgctcttggaattcacagactgtccataatactgtaatagcatttatcacattataatgcaattgataatctgagcttctggttttagaaattgtatcataattctattttgtaccccagtgtttggcatggtgccagtcatatagtaaatgttcaatagatatttgataaatgaataaataaatcagaaggatggtctcttaatgcttttcaaaacactagggagtatatacagaacagatgtccctacttatgaggaaaaagccccagatactacatttggccattttcttctttaaacagagtctactagatgactgggcaagtaagggaactctggtggaagaaatcaattgcaaaggtacttctttagaaaatctcatcatggaaatcacagcacctgattcccaaggcaagacaggtgagtacaggctcttcaaaatatagtgaataaaaattgctctttgcttttggcctttggagatgcctccttatataattaaagtgaaaatcaaggttggatatgaaaacaaagggcatgcccaaagcagtcttcccctgcaacctgacctgtcaccccttttgctatataacattgctccattttgcaaaattccttcccatgatggaaaaagtaaatgaactagttgtcccacttagaactatcaaatgaacactgaataattaaaatgagattttcatcttgagaatttcccttttttgaatgtgtaaatgggatgggtaagcatcatctttaaacttgggcactggccagccacgaagtcagaagatcaaaaccagcctggccaacatggtgaaaccccatctctactaaaaatacaaaaattaggccaggtgcggcagctcacacctgtaatcc

SEQ ID NO: 6247 - DNA, 1170 bp, Homo sapiens
gaagctaaaggtattgtagaaatacaatagattggatcactagataaggcaaatagggaaggaactcaaagaaaatatatgttaatctttgaattataaagaagttatactagagataatctagtctagctctcagcctcccagctaggtgacttctctgtagtttggagaagaaggaatggaagaatgctccaagtcccttaatcccaatagtaaactaaggttaatttcttactttgctcccttcacttttgttgttcccatgtttagcattttaaggtatacatctgagtatataatgccaaaaccagaaagcagattaatgagaatgcttttgttttgtgtatataaatgggaacttttgtatgatttagcaggaagataatctctaattcactagaaggagtaagagagatgcaagtaatttaggagtgaggagtcaaggagcatactcgaagagctgtctccaatctgatttctgtttctatgatactagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggtactgtgtttacattagttgcctcccaacaccaagaggaagagacagctgtaccagtgttcctgcccaagcccaggtatctgagagagagacatgggcaacaatctaggctgtgatgggcagtatgtttgacattctaaatgattaatatgccttaactctcctagagaattttcttatgaaattagaaattgttataagttagattcagaaacaaaaccaggtatgtttgcagaaaaagaatagccctccccagaatcgttagctcattgagaatgggatctcattttctatatgatgctgtaagcaagacaaaccattcttatcaaagtatctttccaattcttagagggatctaaataacagtgattacagttcattcttaagattgacatgtgagactaggaaaaatgtcagaagatataagaccac

SEQ ID NO: 6248 - DNA, 1295 bp, Homo sapiens
tggcttatagttttaaagtagttggcactatttggcacaatccaacatcagtttttgttttgacactgctttttcttttttggagacaaggtctcactctgttgcccaggctggagtgcagtggtgctgcctcagctcactgcaacctcggcctcctgggttcaagcaattctcgtgcctcagcctcccgagtagctgggactacaggtgttcaccagcacgccccactaatttttgtatttttagtagagacggggtttcgccacgttggccaggctagtcttgaactcctgacctcaagtgatcctcccacctcggcctcccaaagtgctgcgattacaggcatgagccactgtgcctggcctgacactgcttttagatagatctgtttttttcctgtctaaacatcttggtgtcatttctatttcagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcaggtaagttggggtgaagaacatacttctgccattattagaggcaagcagaaagaaggaatgggttaggagtagtcccaagattctaggattcccttacgtaatttgtagactcagaatggtgttaaaccaattccttctcctagttgcagtgagaactgttgtagttgttacacagtgaacacttaaaaatgtgaaggtttacatagcatagtcctaaagataaaagctctaataaaatttcagtcagcaagtagagattcatccccatagatgtactgataaatggagttccacatatactctcattgatacccactttttttttttttttaatattatgcataccacacacacacggtctcgctctgt

SEQ ID NO: 6249 - DNA, 2268 bp, Homo sapiens
ggctcaactgatcctcccacctcagcctccccaagtgctgggattacaggcatgagccactgcacccggctgcttctggacttcttatgataacttggtagaagaaaaattgtgccattaatttattatttatttttctggaactgtttatgactttcacgtttaccagctagaagtcaaagtttacttctgttacttagatcaccttacaaggttgatacgaggattaaataagatagtgtacatgaaggagcctaattatatgcctctttttggtaggccctcaagtaacattagttcccttcccccaagattagaccgtatactctcagcaaacattttaaatgccagggttcaggctttattgatttcaattttattttctcatttcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaagtaagtctgaaccttgtttttctttttcttttacatgtatttatttgcttgtaacttggaaaccagtcaagtatacattttaacttctgtccctagttttattattgtcacttccatcaccatgaaagcacactgtctgaagactaaatagtctctcggacttctgagcaaactggtttgagcatttttctttttctttttcttcttcttcttcttttttttttttttttttttttttgagacagggtctctctctctcacccaggctggagtgcagtggtgcgatctcggctcactgcagactcgacctcataggctcaagcgatcctcccacttcagtctcccaaggagctgggaccacaggcgccaccatacccggctaattttttgtattttttgtaga

SEQ ID NO: 6250 - DNA, 1147 bp, Homo sapiens
cagtcagagtcagtaactctggaacatgtgtccaaatccataggtattccagaggtgcaagattttaaaaacttaagtggagactgccaggactttagatttcagcagcacagtgcaaaccctcctcatgaattccagcctgtagaatcagaagctgtagcaacaagtggtaacacagatgtaatgcaggaatccagattctcaagtgcaacctggccgagggccacaaaaagtttagctaagggaggcttcagtgagaagcagcacccccttggggacacagcctgcactgtggaaatgccacctctctccccttgcctgagtgaagagctgttagatccagaattgcatgttctcataacccccagcctgagagagaaaacagagtctgagctaaagtttgaggaggatgagcgatggattatgatggaggctgagggagagtgggaggaagagaaactgtcagacagggaaaagacttttctgatggcagatgagaagaacagcctggcagatatttttgaagaaagagaacaagcaaacacagcagtggtggaggatggatccgattgcttagctgctgtcttgaggacttttggccacctatctcttggtcagatttgttgccctgatgacccacagccagccaaggaccagttggctactgttcccaaggatatacccctggattgcgattgtgttcttacaggtgaggatattctcggtgaggtggcaaacagaactgctcaggggttagagggacttgtttcagattcagcatgtactgtgggtactattgatgcagaacagctctctgacacagactcagtgcagatgtttcttgaacttgaaaaggagtgtttatgtgaagaaggagtaactcctctagttgagctacagaatcaaatctcttctgaagggctggctgcatcccaggatgcagaaaatttactcgtaattagtcatttttcaggggctgccttagaaaaggaacagcatttaggccttttacatgtaagggcaaaagattatgatactagattggattgtggatattttaataccctggattcttctcaggtgcctaatgctgtggaacttattgcccacgttgatatcatgagagacacttccactgttagcaagg

SEQ ID NO: 6251 - DNA, 1278 bp, Homo sapiens
taaactaaaaatatgtgccccctttcttgtttactcatggacagtaagatttgacataaagacatatacgttacacatatgttatgaagaagaaagaagttgaatcaagtttactttgtaacattttaacctctattatttattctctaaagagtgcttcatggttttatttgatttctctgcaggatctagtatagttctagatgcatagaaatattgtataggtacttgttaggttaaatactgagcctttggttaaagcattatttatcatttctgttgaagtaaggagatgaaagaagtattagttgttttacccagagacaatgtggctcaaaaagtcttacaggcagttctaagcaagcaacaatgaagtctaaagtcaggcttcagaatgattgaaaaatctgagatgagaaaaaaataactgaaggaaggaggtcagagtcctgctgggatgtgtggtagagatagcaatttccacccagcacagttgctgatgtgctttatttagcaaggtatggcctgaaaactcttttccctccttaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacaggtaatgcttataatacctctgcattaatattttagacagtattgatgtgtgagatacagtactatgacccacataaatacagactcagaaataagaatgggctcaagctaaatctggtggaataaatatgtttcattgatgggaaatgattgggtagaagtttgtgaggatggatccagaatttgaccaaaatacttgacccctttgagtagagaagtacttggagaagagtctacatgaggccttttcttagctaatgccctgctaagaaggctgatggtgatgggagtagataatatctagattcaaaaggtccaaatgcaccacaatcttagtttgacataattaactctcttagcattagatggaagagggggaaggaattactatcaaatatgcaaaccaaaatagcagagctatctaaaatagaaccttctcagtaaacacaggtgtcatatttcccttgatcttttttccttcctactttctggaaaaaaatcatttgttcttttgtgtagctgg

SEQ ID NO: 6252 - DNA, 1136 bp, Homo sapiens
atgcagaactagcttgggttgctgaaacaaaacggaaactgatggctctgggtccaattcgcctggaacaggaccagaccacagctcagcttcaggtacagaaggtacgtgcccactctttcctgagctaatagaatcatcagtaacttagagtgactaggagagtttctgactatcccatgtcaagtggaataatttagtggcatgatggtaaatagaaattaattttctatgtatttggttgagatgaggaagaatttttttttttgctttgtgagaaaggaaaaataggcccattaatccataattagcaatttccttgatagaaatttttgtaagctactaaaaagataagctagagaagatgttggataggcaaagtgtcaaactgtataagaacaatttttgatgtggctttttcatagattttgtcttaacctttagtaataacaggaaaagggtctttttacttcttaactacagtttacttttcaaaggctttctccattgacattattcgacacaaagattcaatggatgaactcttcagtcaccgtagtgaaatctttggcacatgtggggaggagcaaaaaactgtattacaggtgaattacatttatttatttgccatattgttcctgtttttatcatggtgaattagaagcacaattgtgaaatgatggtttaaggctttttccctcctggacttttcttatgattgttattaaagtccagcttgatgttctggggaattcagaatcttaaccctgtgtccacaaatgtttaaaacagccatcctatataatgtgaaatatattgcaaatccatcttctttataacaggggaattgctacttatcctcactccacagggagcaagctttgagttacttttcaaggtatttatggtagatttttttcagaaccatatgcagatattaattccttcattatagccttctaaaaggtcgtacctagttttaaaaggattggtcaagatggtttgtagacaagttttttcatttcgttttgttttgtttcataaaggatatgtttaagcacagtttcctcagaaatattcataaactgactgagctactcatcctaaacatttgaagcataaatggcaggtttctg

SEQ ID NO: 6253 - DNA, 1134 bp, Homo sapiens
cctctctctaaaaaaagaaataaataataggccgggtgtggtggctcatgctgataatccaagcactttgggaggccgaggcgggtggatcacctgaggtcaggagttcgagaccagcctggccaacatggtgaaaccccgactctaccaaaaatacaaaaattagccaggcatggtggcacatgcctgttatcctagctacttgggaggctgaggcaggagaatctctggaacctgggaggcagaggttgcagtgagccaagattgcgccactgcactccagcctgggcaacaggagcaagactctgtctccaaaaaaaaaaaaaagaaaaagaaataatagtaaaactaaaatagaaaattatcctttagttataaatgcttagcatttttttaaaaaatagtttcattgaaaaggtcagagttacatggaatttctgaatagaccaatttcaggctcttcagaaagtcctattcatatctctttttttaacctcctcagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgaggtaagaaggaaacaaaaccctttttcttaggtgtctgtcctctagaaaaagcactttatcaaatcaaagtgaggtatgttaactgcttagccaggctgagtaccttaaaggtttttgtttttgtttttgttttttgctcttgtccccaaggctggagtgcaatggcatgatcttgactcactgcaacctccgccttccaggttcaagtggttctcctgcctcagcctcttgaatagctgggattacaggcatgtgccaccatgcctggctaatttttgtatttttagtagagacagggtttccccatgttgaccagagtggttctgaactcctgacctcaggtgatccacccaccttggcctcccaaagtgctgggattacaggcgtgagccaccactccaggcc

SEQ ID NO: 6254 - DNA, 2949 bp, Homo sapiens
atggatgaggcactcagttagaacattagtgggcccagactgaagagtggtattgattgaagaatctgattgaatgtttttcccctagatgaataatgcttgggagaacttaaacaaaacatggaaagagaggctagaaaaacttgaggatgctatgcaagctgctgtgcagtatcaggacactcttcaggtgagaggccaggaggtgaccaccaaggaaatacaggttctgttttttgccatttttgtcatttttggaattaagcacaaaagtggatcaccttcacaggactgcagacctaagatagtggtgtttccacaaatttagccaaagttccccacttgtagtgaaaaaagtagcgacatctgtctgaattcttactcttcctgccatgtttatcattgcctgctcatcatagattcattcagctacgttgtgaagctggccttactgtgaaagtcattgcttgccagaggttccaaacccaggttatcttcaagcacagtttggcacagttgcttcagaacatcatgagcttgctagctgggattgaaaaatcttcacttttattcaaatttagtatttccaaattgtagtttattttgaacattatcttgataatgttggctccattattaaatcaccatattattaatataaagatcattattctttatctgtgccccttacctgaaatcacaaacagcacaaggtgctttgattgatttatgtcttcttatgttagcagagataatgctaattctctcccaaattcttctggttgtttttgactgtttacttgtcttttgttctaggctatgtttgactggctagataacactgtgattaaactctgcaccatgccccctgttggcactgacctcaatactgttaaagatcagttaaatgaaatgaaggtttgtatctgggtatggcttttgaagaagaattgttttattatagtttttaaaggcttgatttgatgttaacattgagtgtgtctttgacaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacaggtaaggcaggtggtagatgacatcagtgaactactctccgctcttttctaatttcgtattgaatattccctttctgtcttttcctgagtagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtaagtattttcattttttcatctctaaccctattgatttgagaccagatgctgccaccagcagcctttgaatgttgtgtatatcttaagagaaccaagttagatgatatccatagagataaattatgttgttcaacatgttttaggtcctaaaaaatgatgttttggctcatcaagccacagtggaaacagtcaacaaagctggcaatgagcttcttgaatccagtgctggagatgatgccagcagcttaaggagccgtttggaagccatgaaccaatgctgggagtcagtgttacagaaaacagaggagagggagcagcagcttcagtcaactctgcagcaggtacatgtgacatccaagtaaggtaggaagagctatacagataacagaaagcctatctaagtcagagagaagagatcaatttgaaaagcaaagaatcccttatgtcttgaggggaaggttaatactgtgctgtaacttatctagaaagagcagcttttgattgggtagttcttttctgaattcatttctagctcagtctctttattcacattcaaagttagcagatcttcactataacagattccctttttttcttggatcaagtcaggtctcttcctattcaacagtaccttaatcaatagtcaattcatctgatcgtatcaggcatttataatatgttatagtgaggtctgaaggattctgctagattctagcaataatattggccccatgctaatctagcaacagaacagctttgccagagagcagccgaaaattccttcctcaagataaactcctcatatcatttggaaagttgacttttaaagctgagaaatgactactgacatggttgatatatctttttctcaaaaggcccagggcttccacagtgaaattgaagatttcctcttggaacttactagaatggagagccagctttctgcatctaagcccacaggaggacttcctgaaactgctagggaacagcttgatacacatatggtaatagcaattttttgaaattgagcataagcatcccatattcactagctcctttccaagttcacagtcataattaatatgtatctggaaatctacaaagtagtgcatttttatcaaacatatagtataacctttggggattgctgcctgttacaggcttctaataccttacagtaggcagcagtagtgacagggaaggtcagctggaaattttgagttaatcagctttactggcacacatatattgacttgaagatgacagcatcaagaagacaaatatacaacacagatgtgctttcacttaagaaggaaactacttaaggggggtttagggaaatcaaatagttacccgacagtatttcaagaatgcatgctagaacaaaaagcaacataatttctaggcaaatttttcatgaaaaggggaaatagattattggagtcttttgagggatctctaatccttaaaaaatgtttttcttggccgagcgcagtggctcacgcctgtaatcc

SEQ ID NO: 6255 - DNA, 1074 bp, Homo sapiens
tctaaatactgtcctttcccagatagaagagcacaaggtaagtatgatattatgatgctgcattctttttgaaagcactaattgaaagaaatgcccctttatcttatcttaagctaaaaaagagcactattgttccctcaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaagtaagttggggaagaaagatactaattcactgaagagtcttgggctgcatgtattgagtctctgggatgattctcaaacgtgctgtatagtgtgtatattcattcctgttaacttatttcttatgtaattttagttccatgaagcttggaaaaaactgattgactggctagaagatgcagagagtcacctggactcagaactagagatatccaatgacccagacaaaattaaacttcagctttctaagcataaggtaaagcagttaattgctcttaggtcccaagccatagtattcgctaaagcttgtatcttgccaaaaataaaaatcagagctagtaaaaagaaaaccaattggttaatgtttaaaagtcaaaatgatgaagccagggttccattttatatctagatggtctaatcatgatatttgctcatttaaataacagtttaaggaaagtagttatgggagtaactagttaaaactgtaggctttcacaaattgtcaggcacttctatatatggtataaacaaaaaattataaatttcttaaggataagctatggttaattttagttcaaaaaaagtggtgatattcatactttatttggtttctagcctgaaaactcaaattcttttgttccaaatcaagatgtcgtctgacttttaacacttttttcttttctttctggaaacataggagtttcagaagactcttggtggcaagcagc

SEQ ID NO: 6256 - DNA, 1107 bp, Homo sapiens
gctacccttaatccattctagagggtggtttgatttaaaatgtctcaccatctctcagtcactttttactctatttctttttttttttttttttttgagatggaatctcgctctgtctcccaggctggagtgcagtggtgcaatctcggctcactgcaagctctgcctcccgggttcgcgccattctcctgcctcagcttcccgagtagctggaactacaggcacccaccaccatgcccggctaattttttgtatttttagtagagacagggtttcaccgtgttagccaggatggtctcgatctcctgacctcgtgatctgcccacctcggcctcccaaagtgctgggattacaggtgtgagccaccgcgcccggcctttactgtatttctaactgttctaacatagaagtcactctctatatagggttcaagcaatattccctttcagcgaggcagaattgtgggccatttgtaaaaggaatccctaaaaatggtagcgtttgtgtgcatttctcaggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggtaggggtgaggtctgggctacattggagtgcagtgggtcttctgtatatgactgcctagggtcttctacatatgactgcctctgcccttctttctaggggagaaagagagcctgacagttgctttgtgtgtttaaacaaactgttgctgagattctgcattagtcacaacgaatttaccaaaattggtttgattcagatttggcaatgtgtaaacttcacttcaaggttgcgcctcttcctgtttgtttctctcagttgagtcacaaaatggatctaaattccaacggaaacccataagatagccatttccactgactcctaaaatggaaatgagtgattttttttttaaaccacttctgaacctaacaatcctaacaccaggcacgccaatatttaacataatctctatctgtcatgttgaattatg

SEQ ID NO: 6257 - DNA, 1194 bp, Homo sapiens
tttctctgaaggagttttgaagcaggaataaagaatgtgttgtatagtcacttgggaattttctttcatgccttttctcagtgtctcaattagttcacttagtaagaagaacatatactaatttggaacagacaataaatgtatatgtcaaaagcctgaaatgcctaaaaagtaaataatgagctgtgcgtggtggctcacgcctgtaatcccagcactttgggaggctgaggcaggcggatcacctgaggtcgggagttcaaggccagcctgaccaacatgaagaaaccccatctctactaaaaaaatacaaaaaattagctgggcctggtggtgcgtgcctataatcccagccacttggggggctgaggtaggagaattgtttgaaccaggaggcggaggttgtggtggagccgagatcgcaccattgccctccagcctgggcaacaagagcgaaactccatctcaaaaaaaaaaaaaaatgtaaataatgaatagcctccctgttaatgtataaaaatctttgtttctctgaataggaagttttgctctaccctttacactttcctttttgttcacacccaataggttacaagacaagtggctcagtgcaaatgtgcaaaaaggtttcaggtggagcagatcggagagaataaataccgggtaaggaagagaaaaagcagtcctttgttgtggtggtttctcatatgtggctgatcccaccttttcctcctgatgcttagaggcccagagcccatcggacttgagatgtggtcactctctgacctcatctctatagatgccaagtgtcaggtaccctgttacatctgaaaactagtcccatatctacctagatagtagtagtttgtatttaagttttaagataggagatatttcagagctgtcacttcacatctgacaaagttcctagggggatgaaggtacctttggaaacaattatatctattgactgaccacttgcccacaaagagatggtcattgtgagcctgagtggctcccaggctagagaggcctggggaaactgtgttgaagccccaacagacactgtgcctgctctgagctgggctacaaatggggcccaggagcactgaggagacatcaggctcagtggtcttccctggaaagccatgctaggtgtggccataactgacagtgaactatacttgtgtttta

SEQ ID NO: 6258 - DNA, 1233 bp, Homo sapiens
ggcagtggtgtgaccattaaaagtgatttttatcccaatagaaagtatattggcccggcgcagtgtctcatgcctgtattcccagccctttgggaggccaagactggcggatcacgaggtcaggagttcaagacagcctggcaaacatgttgaaaccccgtctctactaacaatacaaaaattagctgggcgtgatggcacacgcctaataaacccagctactcgggaggctgaggcaggagaattgcttgaacctgggaggcagaggttacagtaagctgagatcacactgttgtactccagcctgggcaacaagagtgaaactctgtctcacaaagaaaaaagtatatcaagacaccagtctttagcttgatatttctgcttttctatttttaaaatccttttgtgaaatatataaaaatgcaaaattgtgagagttaacaattcttctgtagctatcaaattgtcattcctgtctgaatacagtctgctttgggagaaaaacatagatctgctttaagacatatatattaattaagtttcctttgattctacagtttggggattctcagcagttgcggctggtccgtattctgcgcagcaccgtgatggttcgcgttggtggaggatggatggccttggatgaatttttagtgaaaaatgatccctgccgaggtaaggaaccattctaagcatgaattacgtgttaggtatgcccccagcagtgatcttttatgcttacaggaagcattgatggtggggtctgtctgttttttattttgttaagctgcccaggtgtcatcccactagcacagattagaactcaggggtgccagcataggccagggagaaaaagctgaagaggttgatgctatttggggaggtaggtctagaggaatgcagtaatgagaattaagagtgtattggtgttactcgaatgtttgtttggggtattaaattaacactatcctagaaaggagcccagtgaagccctttaggttccctcttagtgcctcagatccctttgcctgtaattcctgtggctgatactcagggagagtgttaggcccttctcatacagggaagaactggtgagccccctggaccaggaggaaggataaagacacctacatgtgagcccattcacttctaagacaggtggccacctaagcaagaccatggggtgtctttctgctaaatgtgaaaaggctggcccaccagcccagaagcata

SEQ ID NO: 6259 - DNA, 2324 bp, Homo sapiens
taggaatcttccttcatttcctggctggctgcttcccctcattttgcctctatccatcctgcccatggattagcccggctggcaggctcacccacctgtgctgaggtggttgagcaaccttgcttgcctccactttggggccatggaaggtgacagtgctgctgatagagtggctttctaatccccaggaggcagcttctcaagtagaatcacaaagccagaaaaggcttcagcaacttctgtatggatgaggaaactggggtgcagaaaggctgtgagatttgcttaagatcacacaggatcagaaccctagcttctgctcacttgttcttccaccccatgccatctctattaagtctgctgttttattcttgaattccagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaatattttgtatttcctgattttcttttcaactattaccttatctataaatgttaccctggggtataatcatgttgtaggtacttaaatgcattccgcaaatcaaaatatcttgatggataaattatagagcttaatagatcttgttttatttcatccttgttaattttgtttaatatggctgggcatggtggctcacgcccataatcccagcactatgggaggccaaggcaggaggatcacttgagttcaggagttggagaccagcctgggaaacatagtaagaccttgtatctactaaaactaaagaaacaattaggcatggtggcacatgcctatagccgcaactactagggaacttaaggtgggaggatcacttgagcctgggaagtcaaggctacagtgagccacgattgcaccactgcaccccagcctgggtgacacagcgagaccctgtctcaaaaaaaaagacaagctattaacatgaacatgtagga

SEQ ID NO: 6260 - DNA, 4604 bp, Homo sapiens
tggagtgcagtggtctagtaatagctcattgtagcttcgacctcctgggctcaagccatcctcccacctcagcctcccaagtagctggaactacaggcacgtgccaccacactcatttaatttttttcttttttgtagagacagggtctccattgtccaacgatctggctccaacgatcctcctgctttggcctcccaaagcattgggattacaggcatgagccacagcacccaattttaagtattttttgtttgtttgtttttgataaaaataaaacatttggaatagaagcatcttagtagggctacctttgtaaatggaacacttactaggcacctggtgctgtgctaggtgttagaaaaattatactggtgtacttgaccaccattggccatggatgggctagagtctcctcaggcacaagataccctgaggttctcatgtctcaggagctggccagttctgctaaagtggtccgccttgtctttgacaggtggtgtgtgatgagaacggctctaagggttatgcctttgtccacttcgagacccaagaggctgccgacaaggccatcgagaagatgaatggcatgctcctcaatgaccgcaaagtgtgagtgtcccagtccggagcaacaaccatcgcatgagccagccgtggccccacctcgctattaactggcacacacaaggcggctactggttctcggcccaagtgtggcctgctcctacctctccactccagggctggtgagtctccctgcctgagccgtggcagcccttttgactcgccaaggtgggcttcctgcccaagccatggcctgcctgccgcctctcccttaaaggcatctgtctgtgggttttgtgagcatcaacaactggggctggctggaaagcagctctaagctcactctgagtcggggtcttggccagcggcagagtggagagggccctggactgaccaggagctgtatactagcagtgtgaccttggctttcctgtgattcaggtctgtccatgggtccctcgctagtggttgatgccaaattgtccccgcggttctccattttctaacttatgactcagtgacctaatacaaggctggctccacagtaatacttggtgacaatgaaaaaatcccatccctttgcagaaaaacttcataacagaccttgttgctttgatgtggttgttactgtagaatgcagagagggggaacttaccaaagccatatggggagaagaagagacaataagtcttggctattacaagccaaaataatttttgtcctttgtgtcattcagtatgccagaggatgggttatctttataatgtctgtgtgtgcagtggttgatctacagatatcactaaaaagaaatacaaaaatgtcagtgcatggataaattttcttttaagtataacagaccaaaataaataaatttaaaaagcaaagggtgccccttcactccaacaatctcatatctaggattaaccactgttaacagtttggtttgtatccttccagaccttttctatgcatttacatagttgcacagaaatgaacattttaaaaacatggccatcaggtttcttcatgaaggcagtgtgatgtggtaggaatagccctggtctaagccaggagccctggggctggtcctcacaggatagtcctgcctttttctctttctgctggggacttggggtatctctgagcctccttggtggtggatggggatctcgtgttttaacctctcctgtcagtctttaacctgtattcctttgggtccctggacatcatgttttattcctctgggtaattactgttcttcatggtttcattttagatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagttggggttccttgtctcctttcacagtctaccagacccatctgttttttcttaagagatgagggcactgctccagagatttgcttcaagtgagtttccagagggaagccttctgttcctgagctgtgctcaagatggtgttactaatagttctgtcctttggtaataggtaagaccctaagtgtcaaggtgatgagagatcccaatgggaaatccaaaggctttggctttgtgagttacgaaaaacacgaggatgccaataaggtgagtataccacaaagattgggaaaagcttttaagaggttgccccagagtatgggtagggtcttgctagcacctacctagagctgggacggtctgagtatctggtagtagatgtaccattactatactctgggatcatcttcctgggttccgcatgttaacttcatgtaggtgtttacaaagcacttggcacatacctgtcacctcagctatcagttgttgaaagaataggacagacgtttgttatgctgcaaaggtgagagaactaaagcccagtgagtgctgatttgataacagcacggcagctacttgtgggcaaagcattgtgccagaccctcaatatttatcacttaaatacccacaaaagcacctgcagaatttactggcagccggaatattatatcgccctaggctcatgtcagcacacttgtgtttatacacctgtactatttctatattatctggatcaataacccatttaaatattaacctcactttacagatgaggaagtttggatttgtgtgacagacttcagaggtggagtgaatttagtttttagtcctatagtagaaagaatattttttgggacttagacctccagaataagaccccatcgctgcaactttattttaaagacatatttttcctctctaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcaggtaaggtggtcttggcccagcctagcaatgggatttgctgtgaaatatttgcagaacacccctatgtttagcgggctttctttttgaggacttggagtgtgttcttcttcccattttacctaaaaagatgaggtttaaaaggatatatacctactacatatgactgattattatagaaccagaaacaagagatgggtttattcatcaagaagctctctattttggaagcctcagcctgttgcttttagccatgtaggttccttttacttaaatgagactcctttgtttggcatggcttcaagaagacccctgctggggtgggtgagtggtcaccagaacagctgtggggagaggtgacaaaaggtgagtgcactgatgatcctgtcagtttcagggcagtagtttcacaactttggacttgcatcagattcatcagcagagcttgttaaaacagatagctgggctccagccccagagtttttcttattcattgggtttggggtctggcctaagaatttcatttctttcttttttttttttttttcttgagacagtctcgctctgtcgcccaggttggagtgcagtggcacaatctcggctcactgcaaactccgcctcccgggttcgcaccattctcctgccttagcctcctgagtagctgggactacaggcacccgccaccatgcctggctaattttttgtatttttagtagagacggggtttcactgtgttagccaggatggtctcgatctcctgaccttgtgattcgcccgcctcggcctcccaaagtgctgggattacaggcgtgagccaccgcgtccggccgagaatttcatttctaacaagttcccaaagatgctggtgctcctggtctggggccacccttggggaaccactttcttagggaatatttgtgatatagaagtgtagttaacagtgatctttttccttcagggggtgaatctctacattaagaacttggatgacactattgatgatgagaaattaaggaaagaattttctccttttggatcaattaccagtgctaaggtattatactgcgatctggggattgaaagcagtggtattccattataggcttattggcatttgtcccattgaaggaatagcatttaaattatgttcatttctgaaagtagctactacgtttttctagcaaaatttctggatgcattctggagaatgacatttcattaggttaacattacactgtttcccaagcactggagtctggagaggaatttgacccagcccctccttgccaactcagagcacctgaatctttcccattccttgctgcctcgtgccggtgtggggacagatggtgctacagaatgagcagaggaaatccagacaggttgttttccatttgtcttggggcctgtctctacagctctgccacattttctccttgagaatgaaggtattttgaagattttggaggtgggcttgggaacttctaccctggtcttaaaaagagaggaaaggggagtggaaggtttttctatgtttcgtagtgtgcatcatttgcttgattttc

SEQ ID NO: 6261 - DNA, 4604 bp, Homo sapiens; identical to SEQ ID NO: 6260

SEQ ID NO: 6262 - DNA, 4534 bp, Homo sapiens
ggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacggtgagtagaagctgtgcccacacgtgcgtgggagcccggaggaccccgggagtcgtcttctggcagggccctcctgccgaggagggcggcatcacgacagcatgttgccaccgaagctgggagcagggtgcggagattgagaacgcggacctggcatcagatgactcgagtttcaatcttgtttctaccacttgctaactgggtgaccttgggctacttattagtgttgctggtagtggggttggaaaccaaggagactgtaaaacaggattagagtgaagccactggcattccactgcgtgtggtccttgtcagtggggctgggctgttagagatccttgcttgtgcccctcacaggctggccaaaaaggcgggacgtttgaaacacaattccccgcgaaagttttacattgtaaagctcctgcccgctccgccacctttactaaccttgactacctgatgttgtgctgataaaggatcagtcagggcaggcaggaagcagggggaaggtttctgtgcgttaaactttcgcagagacttaggttagtgccacaaaagctgcgtgtgccaggccacctccttggtctgtgtgtttgccactggagtggagaagtgctttactctggacaaatggtatccaggctctgtgctgtagagtgtcgtggaggtagtttagggaagcgtcacttgaaaatctggtgtcatttgtcacctcagctgtaacagtgctttgcactagtcagagcccttttatttcatctaatctgaagaaaatgggactcctgagaaggagaacgaatgcaaaaagttggaagccaagttaggactcccagcacagtgctctgccacctcagattgtggccttagcgtggagcatggagagaggtatgctgcaggcgtggcaggagggaggccagaggaaacctgatcagaggctgcacgtgactccagattaaaagggaacaactgcagagatcattactgggagaaacaagccattctatggcaaagcatctccaggtccctagttttggggtcccccctttgttttctgtctgaggcccagagttactacctgcccaggttgcggctgagaccagagaattggacatgttgagagggactaggtattgctactgtcaatccagtgtgctccaagctgagttctgtccatggccataggagcgcaaaggtagctgagtgtggtctttttaagggataatgtaccacattagctgttgtctgccttactgacttttgaacaaaagtcgtgtcacttagagatagcagaagctattggtcagtgtgtctgccaacacatacttctgcaggacttctccctgctataaataagtgcagccagatttgtcagactaagccggcttgccttgtgcagtgctgtctggaaatagacgaggagctgttgttgaagtgggctcctttactgctaattaatgaaatagtttgcgatcccagctatctatctctgatagccatcacaagcaaagtcctctttccctggactgttcctgacttggatcggtcttgtcatctccccttttcccaactaccccccacacagatgaggcccaccttctgaagggggtggggaaagttgttggaaataatgagtgaaaataaattctcccggctaatgaaacagttgagcttgtggagcggcagagttggggaattttgtcccccctttaagtgagatgttgtcctgaggcaaggagcaggttccactgctctgaccctgtctaaatcccctcatggaggaggttctgggtgatgtcaccgttaggagatgccatcatagccttaaggaaaagtggccaccagatctgggcatccttgttgcgattagtgatgagaagtgttttggctggcaggtggtgttattttttagcttttggttctttttgttgttgtttgttttgagacactgtttcactcttgctgcccaggctggagtgcaatggcgcgatctcagctcactgcaacctctgactcctgggtccaaacaattttcctgcctcagtctcctgagtagctgggattacaggcacccgccaccatgcccagctaattgtgtatttttagtagagatggggttttcaccatgttggtcaggctggtctcgaactcctgacctcaggtaatccacccgccttggcctcccaaagtgctgggattacaggagtgagccaccatacccagcccagcctttggttctttaaattgtctctggtgtacacacggacttggttgggaagctaaggaagcattccaaggtgttggatggggaagttggttgagcacccagggtagctgaagtcctagaattctacagaacttccattaaggcttcaaaaggtgggtgcagggcctgccatctgcgcactgtctacttaggcagaaggtatggtggttttatccttgtgatagtacagagaacttttccatgtgtgatcagttgtgtccattttgatgactgatgcttttttgtttaagtcaatttctgttctcagaaattgaaaataaactggactgaattctgaattcagggatagcacctttttttttttttccagatcatttgctttacaggttttgtcacttgtctccataggtggattgcagactaaatgacttgataactttgatgcaatacctcactgaaaaataaatcagataatctagtattagtttcgtaattactagctagctgcacagcttagttaccctaaacataagtttgttcattttgtaaaatgtataatttcagctgtcccacctgagtcatggtgggtggtagtctgcaaagtctcttctaagtggtaaagcttagtcaaatgtgaggtattatcactggatcttggtgtcattaaggccatttagattatctttacttgtggcccctttatccaacaagggcacagacccagaagggtgtttagacttctgtcatgaagtagagtcattagctggaacttatgcttcccttactaacagtgcaggctggaggaatctgatgcccttttattttaatagagttgccttttatcaagagtgattaccttgaaaagtcctggagtaatctgttcttaggctgttggcctgtgggagctgacgttttctctccttattgaaatgtgtttctctcttacagctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtaaacattgattaaatgattttagcagaataattaattgattcttgaaaacaagataaataccaaacagagaactatcttggaattggggaacaagatatgggaattttcaaaatgctggacatggaatcctaaaagttcccataggtaatctcagggccatacccagcgtaaccagcacacgctttcatacccttgttctttactcagcctgaaatatccttcctattctttagctttggaaagcccacgtttttcttttgggatgggggaaagtagaggaccagagaagtgtctctagtcttgaggaaacttaatcactttagaagcataaattcactctattccttctacgtatctgttctatgctgagcactttaaaacttaaacggtggtggtgtatatgtttaatgccatactacactgaaaatctgttgtggccttggaaaatgttttgttttctgcatcaccgtggtttgcacccagatctcttaaaatgtg

SEQ ID NO: 6263 - DNA, 1133 bp, Homo sapiens
atgcctggtgtgaagatacatcacctgacatctaaggggatcggcccaagggaggaaatgaaagctgtgaaaaagatgctctgctctccccactcaccagcctgcctcagaggtccagcttagccacagacacaatctctgacaactcccaagaactagcaggaagagcaatataagaactagggtttattttagcaaagaaaacacgtaagagccacactggtagtcccaggagaggcccagcagcaaatgctgagaaaagccagtggctttttgcacagcctgcccatggtggaggggagcacctgagctggctcctgggcccacagctgtgcctgggaatagtccaggctgtgcctgcagaggagctgctccaagcagaccctgaggaagggcacatatcccaaatgctgcttgcttcaaacaggcaccctcggtgctgcctcctctgaggctggcagttccttcctggatatgcagggtcaagagcggagggggaagcagagagagtgccgcctcacacgtactccccacagtcggcgatgatcaccttctgctttggcttcccgtccttgctgccctgggcctttgtggcagaatagaagtgagggagtaaggccggagactaacagtggtttagggataccaacccctgcctgcccatttgcccacttccaccccggaacctgggcagcagcagcccctcccgctggacacagcccctggccatctctctcaggccacagagactctccagccctcacacagggctgtgctcctagggcctgggtaaggaggaggcccattcctggccacatacctcaatttgccgcaagacatctaggccttcggtgacctctccaaacaccacatgcttgccatccagccagtctgtcttgtcacatgtcaggaagaactgagagccattggtgtttgggccagagttggccatggatagtagacctgagggagagaacaaccatcagctccccgaaccctggctaccagcccttaaaggacgtctgtgcaggctgttgacagcccttcagccagtcaggctcagactcggggatgcacagatcacatgcaaatgcggccaccttatcttggattcagttaatagtcagtgaaat

SEQ ID NO: 6264 - DNA, 1225 bp, Homo sapiens
aagtcagagtgtttccccagaccataacaaagaacctaaagagaagggatccccagggcagaatgatcaagagctgaaatgcagcgtttaagagacatgtccagtggcctttggaaaggtggtggggatccagttcaggagggaggggtatgtttgtctcccagtctgggcaaaggagtgctatgcggaattctctgcatagcagaaaagctcccaccattttcttttgatgtggttttaaagtctcacgttctctataatagaaacagcaggtcttgtcagctccttgtgtggctgatgtgtctggaaatgatgtagttcaggaaagcattttttttttctttgaaccttaaaggttctattattaaaagcagcacagattccacatttttatacatgaggatcttctttgtggtgaataccaggattgactgcatccctttaaagaagttttatgtccctgactctggctaaaattatctaatttccagatgcttttgtagatgactgaagtatttgtgagccacatattgggagttctagatttgagtgaatggcaggaaagggccatctccattgagatgattaagtgaaccaaactagttctcagaattctacagagaaggagggaatcagactgaggaagctgtgacataggacttgaagaccaaagactttgaaatttgcgagctgctcatgtgtgagttattatcactgctgtctttctattgagttacaaatctatatttttattgaagtttaaataaagaaaaaatttacaagagcctctttgatccttaaaaagatatacaagtccatgcctagtttatacacagtatgctctgttatcaatgtgatagctttttctcaaatttgacactttttgtagatcatgctgtctgttcatttatgtagcgggtgtttatttaacacgttatagtccttgaagacatctagagagggtcttttattggagatctattacttccaattgaagccctctttctggagtgacctgagctgccagcaatgttaaacagatacttatttatatataacatcaaatatagcatttttagggtataattcagcagcattaactacattcacaatgttgtgcaatcgttgccactatttccaaaacgtttttgtcactccaaacaaactttgtgccctttaagcgttaactccccattcaaatacattttgtttgtgcagaatctac

SEQ ID NO: 6265 - DNA, 1128 bp, Homo sapiens
ccccttccagcctgccatgaatcagatatctttcccagaatctgggcgtttctgaagttttggggagagctgttgggactcatccagtgctccagaaggtggacttgcttctggtgggttttaaaggagcctccaggagatatgcttagccaaccatgatggattttaccccagctggactcggcagctccaagtggaatccacgtgcagcttctagtctgggaaagtcacccaacctagcagttgtcatgtgggtaacctcaggcacctctaagcctgtcctggaagaaggaccagcagcccctccagaactctgcccaggacagcaggtgcctgctggctctgggtttggaagttggggtgggtagggggtggtaagtactatatatggctctggaaaaccagctgctacttccaaatctattgtccataatggtttctttctgaggttgcttcttggcctcagaggaccccaggggatgtttggaaatagcctctctacccttctggagcatggtttacaaaagccagctgacttctggaattgtctatggaggacagtttgggtgtaggttactgatgtctcaactgaatagcttgtgttttataagctgctgttggctattatgctgggggagtcttttttttttatattgtatttttgtatgccttttgcaaagtggtgttaactgtttttgtacaaggaaaaaaactcttggggcaatttcctgttgcaagggtctgatttattttgaaaggcaagttcacctgaaattttgtatttagttgtgattactgattgcctgattttaaaatgttgccttctgggacatcttctaataaaagatttctcaaacatgtcagagtgggggcagcttatgccacctgagtcctcctcaaccacggaaaactatttcagggtagccacaagtgatccagagggctgcacttctctaaccatgttgctaacctggtcattccactctgggttcctgaaatgccatttcagacatgttgaaacaatgtaggctcagtactcagtgaacacggaattctcttgtgaattgcaaagagtgctgaatttgtactttagaaggcttgaaatcctggctccaccacttctgcagc

SEQ ID NO: 6266 - DNA, 1164 bp, Homo sapiens
ccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaaaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttgcttagttgtttacctgtgatattggctgtacagaaatgcaaaaaatactgaaaacaccaaggataagaaactactctttattttagacaacctcataaaattattttcacatcccccccaacttcttgctcttaatcctcatcttttagttgaagaataaggcttaagagagagaaaggaaaaaccataatggctaaacttagcagcaccaacacggttctttcatcaaggcgtagctcatcatttctccaaactgacatgctacagaaatgtcttccaaaaagcgttaag

SEQ ID NO: 6267 - DNA, 1320 bp, Homo sapiens
cataaatgctttgttttgctggtgatttaaccagtgcttggaaaaatcttgcttggctatttctgcatcatttcttaaggctgccttcctctctcagtacgttgccctctgtgctatcatcttatcatcaattattagacaaatcccactggcctacagtcttgcttctgcagcacccactttgtctcctcaggtagtgatgaattagttgctgtcacaaaaggagggaagtagcacccaaattaagttgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttcttatccttggtgttttcagtattttttgcatttctgtacagccaatatcacaggtaaacaactaagcaagtttggtattaactttattctattttctgtataactttaagtacataaaggtttatttccacaggcctcaggaaatgggtagaaatcacaggacaatctctcttcccaccaaaaaaaagttgcatattttggtaagtgtttgtcctagagggaaaaacaactgaaatttacattagcagtgctgtgcaagattcttacataattcaagacctaaaaccagcctgcagtggaggtttcagtcctctgttcaggtgcttagacagaagccataagctgatgagcatgacagggaaaaggaggcagtgaagacaggtg

SEQ ID NO: 6268 - DNA, 1133 bp, Homo sapiens
agaaggagaaagggagtgtgtagtattttccaagctttttgagcaaacaatccttttctcatggaacacatcagaaacagtttggagtatgctggtaaatgtgttttggggatggaagtcagaaagcctgatctttttcatatggttcctcctattctctgctaaagccagcaacagagtaagttgactctagcatcaagaccactagtcatattaagaaagggcaggttggtcgagaatggaataggaagaactagctgcctcacttttcactttcgcgcctacattttcttcgctccctaagttatacaagatgtacatttcctctcttaagcaacttaatttgggtgctacttccctccttttgtgacagcaactaattcatcactacctgaggagacaaagtgggtgctgcagaagcaagactgtaggccagtgggatttgtctaataattgatgataagatgatagcacagagggcaacgtactgagagaggaaggcagccttaagaaatgatgcagaaatagccaagcaagatttttccaagcactggttaaatcaccagcaaaacaaagcatttatgtgagtacctcaggcctgggcacctctttgcttgaaatatggcaagacttggaaaaatgtttgcccttagaatctatctcactactttagttagttgtctcctttgggcctgggcacagttctggcactgatctggaacagactcccttttctaaaactgaacttgaccacatcaaaagtttgtaaaacaatctccatggtaattaaacttgcattcaacaccatatggtaacagaagatggcaaaggataagattcagatcttagatctttccaagtagggcatgttagatgatagaaggattagttgcaagctggatctgagctcaggcttgggcatgaaggaaactgtctcccatgtggtttggaagagttaggggctccctgagctctattgtgaactatacgggtttcatccaaggaatggtatgatgtgggcataaaaccattcttcagacaactgaagatggtccccttctgtagccagaaacactagctgtcctgcattgtccatttcctttagccccaggcggtcctgcagaaggaaaggc

SEQ ID NO: 6269 - DNA, 1099 bp, Homo sapiens
tgggcgacagagtgagatctgtctcaaaaaaagctacttaaataatttgttctgtgatcacactaatacctttcttaaaatcacactatgaattttttttttttttttttttttttttttgagatggagtctcactctgttgcccaggctggagtgcagtggcgccatttcagctcactgcaagctccgcctcccgggttcacgccattctcctgcctcagcctcccgagtagctgggactacaggcatccgccaccacgtccggctaattttttctgcatttttagtagagacggggtttcaccatgttagccaggatggtctcaatctcctgacctcgtgatccacccgccttggcctcccaaagtgctgggattacaggcgtgagccaccgcgcccggccacactgtgatttcttatactttatggatgctactgatcccatagtgaaatcagcttggtaataacttagaaatttcatgtccttctttctagatgaattctttcctgtgtttttttttatttgctgtattaattggtcgaaaggagctttttgctgcatttggtttttatgatagccaacccactcttattggactattgatcatcttccagtttattttttcaccttacaatgaggtaatgtatgatctttaaaattatcacacatatgctcttgcctgcttcaaatctagagctttcaggatagtgaaaaaggaaatagaacagtacagttttaacaaatagatgaaacaaagtcttttagtcccctgattcactggtcagtatgacaaagtagcagaaaaattcaagcccaaataaataaacgtttgcatactcttaggaaagtataagtagaaaactagacttcagtggtgaacacctaaaaggactcggtagatggagattaactattggaatgttgtgtcctaggccacatattcaccagtgcttgggtaaaaatcttatgtgtatgaggggacaaagcaaacactaattggtacagctcagtaagggaggcttagtgactgttcctctgctccatgaccacctgcctccatatagcctgagggatccacccaaacccacaaaatcaaaa

SEQ ID NO: 6270 - DNA, 1155 bp, Homo sapiens
ttttaaatcattgagttttgtggggtttttttgtttgtttgtttcttttgttttttggaaaatccgtgtctttatctttttttcccacgtggtagatatgatcccattggaggtaaattgtagcttcttctcattcatgcagtaaataatacatcctttcactcagcagagatggccatattaaacacgttttgctatgttaaaagtggcagaacaggaaagacgaattaaaaataacattttttaagcgacataaggatgaaatactgatgaatctctgtgacattacagggaaaaaaatatagttttctatctctttcaagggcagaagagttttcatttttatttttgtaattttatctgtaagtcataaatattacttaatcaggcctgattctacttttgaaaattacagttcttgaaatgcagataatgtttactttgaaaacaaatgtcatgaatgatttccagtttttaaagctatatgtttcactgcttcatatctctgtccactttctgaatgagaacttattttgtgcctagagctctcactcactgataatgcttattaccttctgggcatttattccaaagtgggatcaactgtacgcctttggtatctgaccataaagtcttttgctccgctgacatttgggtgatgtcttcacatggaaatataataaaaataaaaatctagtttaatactgcattatttattttcctaaggctaaagaggagcagtcctatgcttttattcagcatcctttatctgtgacttcatgctctgataactgcctttccttccttctgtgcctttgaatacaaatttcagttctgcaaaagtgaaacattaaacattgccaacgcaaatgtatgtactttgtctttagtttgatatttgtgtatcatttttttaatttgtgtatcatttgttacctgaacatatgtttattacctgagaggaactgggtgctagcaatgaagagtggaatgaagaaatagccctaatgatgagtggtgtcagtgccaccactgtgctttacacagagtctcttcagtgtcttgctcctgctttgctccagagtatcaccagttcttgcagatatttccttggaagcttcatttggaatcattccttctctatttttataacct

SEQ ID NO: 6271 - DNA, 1354 bp, Homo sapiens
atgagacagagactctgctgcctacctcaaaagggcactgtaagattgaaggtgggcatcagacaaggtatcatgaagtgggccttgcaattgccattgctgtcatttttctttctcaacagggtccccagggcatcaggggctacccaggcatggcagggcccaagggagagacggtaagtgaatcttggggtgttctacaagagcttccaggagctgccttctggcccctggagttcagccaggactgacctgcaaccctttcctctccccagggccctcatggatataaaggcatggtgggcgctatcggtgccactgggccaccggtaagcctctttttgctcccctacccctgaggctggagctcctacagctacagccacagagtgggcatggctccccctgagcctgtgtgacctggattcctgcttgtctttcttgccagggtgaggaaggtcctaggggaccgccaggccgagctggggagaagggtgacgaggtgagtcctcaggcacccattgttcagtcaggacccctggggagtactgggcaggacaaggcaccccctaaggctgtgtgtgtgagagtgcatgagtgtgtgcgtgagtgtgaatgtgtagtgtgtgtgagtgtgtagtgtgtgtgtgtgtagactgtgtgtatatgagtgtatgtgtacagtgtgtatgtgtgaggctgtctgtgagtgtgtgtagtatgtgtatgtgagtgtgtgaggatatctctgagtgtgtgtgtgtgactgtgagtgtatgtatgtgtgtgtgagtgagtgtgtgtgtgtctgcccaagtgggtgacctgctggggaggaccatctgtgccaagagcccagtcagcccaaattcagactttaggcgaagccctgggatccagtcccatggtcactggggccagacaatgagattccagcaaatcagccatggggctaatgggatttggtctcgatcccagttctcttaactctttttttttttttttcccaattaatagacctgttgggggaagcggttttaagtttacagaaaaatggagcagaaaacacagttaactgttattattatttagttttttaaattattttcttttctttttaaaaattaaaaaattcttatacttttatttttctattagacagcagagatcatctagttgttttgttttgttttgtttttgagatggagttttattcttgttgcccaggctggagtgcatggtgcgatctcggctcactgcaacctccgcctccctggttcaagagattctcttgcctcagccacccaagtggctgggattacaggcatgcgccaccatgctcagctaattttgt

SEQ ID NO: 6272 - DNA, 1438 bp, Homo sapiens
attgctcaataagtcatttggggtttggcatcctgcccagccacttcccaaacatgaagacctctctgttgctttatgttgtacatgccccatagccatcccaacgtcctccccagtcctctcctggcaccagcaccttagaagttgttggcagaaggcacttaaactgtgggagaagtgtgcacacctttgagtcccttccctcaaggttaaagctcctgtcagactctcagaagggtctgtgggtgttgtatattaggcaaacaggggaaagcttagaggtccttctatatgtgttaataagctgtttctaagtgtttaaatttgaaaagcatcatgttctcatgatttatgggaatgaagcaagtactgaaatcaaattaaatactccctgggtcctgggtcagtttgaccctagccctggggtgaggcaagccccctcctatgaggatgagcaaaaatactactctcttcgccctgagttgctttctggatctggggcttcaggacttgctgcttcagtcagcctttattagcaccaaagactttatgaagatcccacacacagacacacatcccttcccgcctcccccctgccttcagtaggatctggctccgtggctggaggaccaacccctatagtgggaatgcagagcttaacgtgtactgcttgtgtgtgtgcgtgagtgtgtgtgtgtgtatgagtgtgtgttccgcctcccaccctctccccatctgctctgggtatttttgtttttgtttagttttaggtttacaacagagaggaattaatttatcagcagcctaaaactgttgtgtttttcttatggtttaaaaaacgccatgtcattgataactccctttctcccttcccttctcccggtctgctgatcactctttcatgcctgtgtatccagggtgctctgtttccccaccgttcccaggtgtacgaggcagagggccgggacagctttcctctcagtcattgttcaccccacttgaaaattcagacaagaaaactttgcttaaaagatttcatgtgtgggaaccacagttcctggctgcctttctcctgtgtatgtgtaaattccttaataaatattgcagggaaggactgtttgcttggccattactgtgcgtcactcttggaggagggtgcgttacacttaggttttctgttttccaaaggcaattgtttcacttcctgtattttagaaaattctgtacttctcatacccaagggtgaggcccaggctccagcagtcagaaagggggcctctctccactggcatctagagctgtgagctgagagaactccagagatcagcaccttctagagtcacagagcatcagagcggcatgctttccccccacaggtggagaaactgagacacggagaaaggacatggttggcaaatgtccactagagaaccctggg

SEQ ID NO: 6273 - DNA, 1228 bp, Homo sapiens
ctgaatcccttgggaaggatgacaaacccataagcttacaaaactggaaaagaggattggatatattatcacccatggagagattccaccttaaatatttatatgtcactgacctggctactcagaactggtgtgaactgcaaacagcatatgggaaggagcttcctggtttcttggcacctgagaaggcagctgtgttggacactggtgccagcatacacctagctagagaactagaacttcatgatcttgtgactgtcccagtcaccactaaagaagatgcttgggcaattaagtttctgaacatacttttgctgattcctaccctgcagtcagaagggcacatcagagagtttccagtgtttggggaaggggagggtgtacttcttgttggagtgattgatgagctgcactatacagccaagggggaactggagctggcggaactcaagacacgcaggcgccctatgctccctctggaagctcagaagaagaaagactgttttcaagtcagcctatacaaatatatctttgatgccatggtacaaggaaaagtgacccctgctagcctaatccaccacacaaagttgtgtctagaaaagccactggggccatcagtgctgaggcatgcccagcagggaggcttctctgtgaagtctttgggtgacctcatggaacttgtcttcttgtctctaacactgtcagacctcccagttattgatatcttgaagattgagtatatccaccaagagactgccactgtgctgggtactgagattgtagccttcaaagagaaggaggtgagagccaaggtgcagcattatatggcctactggatgggccaccgagagccccagggagttgacgtggaggaggcttggaagtgccggacgtgtacctatgcagacatttgtgagtggagaaagggcagtggagtgctcagctctacactggcgccccaagtcaaaaaagccaaatgaatagaaggtatgctttcaagaatgttgatccttcctgctcctgttgtacctaagcaaaagaggaccagtctctgagcttggcttttatggagagtgttcttattttggttcttttttttatttccacaacctctaaccacattcagtccaggaccaaggctcagggatgagtgggagagatgggttatactgtccctggagcttcatcatgattgcctgagaagacagatgctcatcatggctggaat

SEQ ID NO: 6274 - DNA, 1081 bp, Homo sapiens
tgtcctccctcttttattcttgtgtaatgatgagacataattaagggtcatctacaatggacaattttcaaggtgctgatgtgatgtcacaacctccgctacatcctgagtaagtcagtgtccccaacagcagatgaggctgggtctttcctcatttctgcttctgggatgacatcagtgggagagttgaagatctgagaattctaaaggaaatgttctctgatgggaggagagagggaacttatttcccttcaaagtagtttgcttcttaagaccactcctccctccagaatgtctttaaccagacatcatttcagaaggtggggcagctgcttccttaggaagagtgggcctgatagctcaaccaactcctttagcatgtaaactcacagaaggcaagaacccctttttttagactttccaaatgcatcctgcaaagagagagatagctgatagggactgacaagcacactgtttagataagaagcaattagccttttatatctgtgctctatacattttctatgtgcagcatctttcctaacttgttgtggttcccgggtggcaggtgcacagctgggagggactgccggctgtttcgtacaacattcttgccaattcccttgaggagaaaattcttcacatggcttctgcatgtacagtatttgggcagcaaaacatgattaaagtcagtttgaaaatggtttcatgtgttgctttctgtagatggttcttcattctagaaggaagaaaacagggttccaggtggctacaaagaggaggaggatgccttggttgagaggcaggggagagcagtacatttcagaaaaagagcatgaaagatatggcctgggcctctgactcctgtttgagaactctatggtcacagcagtgttcttgagccatgaaatctgactggtccaggcagcttcctggctctgtctccccggtcctctgcttccaggccctcaaagccttctacttccatagactccacaagggatatccaacgacagaggaaggtaagatggagctaaggccgcagctgtcgacccactgttcctttctttctgagcttttg

SEQ ID NO: 6275 - DNA, 2893 bp, Homo sapiens
tcctgtctcttcaagcctccccactccaccgtgccgaaggagctctgccagtgggcctgggcaggcagccacagagggcatgttatctgctaaagcaaacagtcctcctgaggccctgagggtggccctgaccccctcagggctcattcctggtgggcatgactcggtaaggaggttctgtgggtagggctgtttgctggaataaggagggctgaggctgagttgttccccgccactgttgaggatcccatctgacatttggggattcactgcatgaagttgttcatttggggctccagtttttgtgcatttccagaccagggtccctgtctgggagctcagacttagctgggctccagcagcctggctccggactctcgtctgccaccatcaccagctctgtctaagcaatacttacccctccgggcttccctgctttcctgtgccccactgctgccctctgcagagccatctgctccaggcacccacctgcctctgcttgctttctcacccatgtctggttggagcttctcacagccactcaaaccctgacttgatttgacaactgggccctgttggtggagaccagtgcctgaactggaccctgtgaaatctgtcccgtgggaatcctgaagtctgactcaggaatgcccagacctgtccctgtccctcctcagctctagggtgaaaggcgagaggttgcacaggacatggacagagcagcccttgggtttgtatctggtaggggagaaagcagcaggacagtggaggtgtgtggaaggcactctttccacctctctccaggcattatccccaggtgctgaaatggctgtggccccagcacctgaggcaggggtacgctacctggggtagcagtagaaaggtcttggggtctgaatgacttggggcctccattcataaccaaagttgtaggggcatggaggcagtggcgccttatggataggtcatctcagcccaaagggcctccttggctggcatggttctgtgttacgttgaagccagagtcttataacacctcccaagaaagataggggaagaagccagaaccccacctggcctgcccacaggacaagaagtgggtaagggcaggaaggaaatgaacggagttagctcccaggctcctatctctgcctgagcctctattcttatattatcagagaaagggaccattgggtgcatagagatggggaggaggccactgggctgaattttctctttaggcggaaatgctctccccaggcccattgcgttcgtcaagttcttggaaatggacaaagggctctgtcctcctcgaccctagtgggggatcaagaaggaaactccgttgcaaaagggtattttaatctcctgtttatgatatattcacctctagagcagtcactgtcagggtgttgcgaaaatactctacacctttgggatgatagggttgttagtgacccacaggacagtatagatgtttgtggatgtagcactgagtggtgatacccagaccagcagtcaccccaggaagtgggggctacccataccctcattcctctggtggggagctgcctgcagagaggcctgccactgggggttccaggccgtggtgacccttgcctctggggaagggttagcacaggggaggttctagctggaggaggggtctgatgtgctggtaacttgggctgacctacctacagtccctggctgccaaaactgctcagcagttgggccactccactattccacctctctaaaagaaggtaatttcctccccaaattgaccttggggaattattcttttaaccctttgcaccaaataagttactcatccccacctggattttaccccatgagggtaaagttgtgtgaggctgacacgtctgtgtgatgcagtgtggctgcacttaagggtctgtttctcagcatcatggatgcaggggcttgtctgaaaagccactctggacctagcctgtcccagaagaggagaatgcacaagtgtaactcctggttgtttgctggggtgggggagcatctgctgtttgaggacggggggtggggaaggaaggaacatgatccctccagaagtctcccaccctggggccaactcactgccatgttcagtgtcccggctccaaatgcccccttgcccagatgaaaccctgcagtggttacaggaatggagctctttgtcattccacctcctctggtcaggcgaggttcactgtgcatatggcagagacaggagtggccctgcagtgatgttgggttgtgggcagggacagtgatggatgactcagagcgtctgtctttgtatttctgctctgttcattctgtcccactttcttcatagactccttttccctgcaatgggtttttggtatgaaaaaggctccagtaaatggagccaagtcttggtttgacaaggggaacttgatccttcagggaagaatcatctccaaaatgactccccatctggtttcttctaccacccaattctactaggaaaggagcacttaggaggctcttgggatgcagcaagtcccaggcaatgccagcatttcatgggggctgaggcagaacccaggagctccaagaaaggccacccatagagctcatcctctgtggaatcactgccggttagaacactgaggtcaagccagtcctcccatggtcatgccacccaccagggaagcatgcctgatctcttctttactgccagccttgaggagagcagaagcctccatttttaaagacaataaagacctccaagggtacttctttggaaatgaaatgtagcacaatcttagcctacgttaccaggagccctgacatgcaaccagggtccctcttccatgccctgctgcccaggagttgctgagctcctctt

SEQ ID NO: 6276 - DNA, 1144 bp, Homo sapiens
gcagaaagatgcaatattttttgtttcctttttttccatttttttctctaaggaatcaatatttcaatatgttgagtgtgtgtccaatgctatgaaattaaaatattaaataacatatttatggcattttcttgaagagtgtggttgaagaaatatttctccttttgtttttcttttttttttgtttgttactgccacttctttttaggagcaaatctccccaggggtgtacggtatttcttgactctgggaacagctgctacccccaagacttgccacgttgttctgccctcagatggaattaggtgaatgtgtgtagctgctttttcactcgtggtcctctccccatcccttgctctgaccccagagctctgtgtatttgcatccagaggccatggaaacattctttgcatttaagagacagatttattccctgtggagagtgggtggattcattgccacactcttttctcccagggacccaggaaactaggactttgtgtgtttgctgcccacctcccttttattttttaaatgcattaaaaactgtgctagtctcctttgcatggacttcaagctgcatgaaatgcaataaatctcattttagataatttagagtctgggtttctgtgtctgggggcattcatggggccactttgcttggaaaggttcatttgccctcagtttgtgtgtctgggagagagggccacccttgtgagaaggagatgttcaaagctaagggaacttaatgctgtgtacctaattcaaactgaggtccttagccgatctttttttttctggctctgttgcccaggctggagtgcagtggtgtgatcactgctcactgcagcatcaatctcctgggctcaagcaatcctcccaccccagcctcctgaattgctaggactacagtcaggtaccaccatgcccagctaattttttttattttttatttgtagagacacggtttcactgtattgccctggctggtcttgaactcctgggctcaagtgatcctcccacgtcagcctcccaaagtactgggattacaggcatgagccactgtgcctggcctacctcggctggtcttaaaagtgagcttcatcagaatatatttgctgctcagagatgcttgcctgctgga

SEQ ID NO: 6277 - DNA, 1209 bp, Homo sapiens
gagcgatagctagatgaaaccgtacttttcgggatcctagtccatccaaagcagccgccttcggggcaggtgtggggaggagggaggccgacgaggagccaacgccgcgcgaccctccgcacttccgtcttggaggccagggtggcgctgccgccgtccctcgcccggaggcagagatgcgctggcgcatcaccgccaggagcccacagtgaaagaccatcggatggaaggcgacgcccagaactccaggagaccgctgtgggaggacgcgaggccaggtgacgaataggccaggcgtgagttcccaaacagcctcctccccttcaagagagtaagcttgggccacaggctgggacggaagcagaggggcagacacgccaccacccgcccggcctcgaacctacggcggcacagttcagcggaggcggcccagcggtcctgtcccgcgcctgcgcactccaggccccgccccgccccgcgccctccaggcccggcccgccctccaacctctgcgtgcgcacagcctagagcccgcctccgtgaaagactgccgggcgcatgcggtcggggttgttcactggctgtccggggctccgcgcgcgtcgccggcccagctctgtcgctgacgggaggatctgaagccggccgcaggtaggctgactccagggatcccgggggggatctgttctcccgcgcaggagtcagcggcgcgagctgagcccggcgccgaatagccccgccgccgcggtgacggacgtcgctcctaccaatcaggggcgaggtgactcggcgtcctgcccaatgggctgtgtgcctaacgggagtggggcgggcgccccggccggcgagctgccggctcccgcgcgcgggcctcgtggccgggcggcgctggggagaggggccaagcggggcgcggggcggcttcagaggctgcggggcctgcgctgccgcgctgggccgcgccgaatcagctcggccgggctcgtcggacggagaaggccgtaggggagtggagcggcgcccccccccacaccctccgcccttgctcttcgtctgcgaggaagcccggcagtcgcccatccattcaagcagtgcgggcctcgggcctccggcctcggcgcgggctcagccgcccggggctgggcgcggcagctccgcgccgtaggacgagggggcctgcgaactcgccggccctgggccccgcggctg

SEQ ID NO: 6278 - DNA, 1237 bp, Homo sapiens
gccaccacacccagctaattttttgggtgtttttttttttttttgagacagagtctcactctgtcacccagactggagtgcagtggcacaatctcagctcactacagcttcaagctcccaggctcaagtgattctcccacctcagctaccccccagttagctgagactacatgcacatgcccaccatgcctggctaaattttgtatttttttgtagagacagtgttttaccatattgcccagtctggtcttgaactcctgagctcgagcaatcctcctgccatggcctcccaaagtactaggattataagcataagccaccttgcccagccatgaattttttttaaaggacttttgcatccatgttcataatagattggccactaattttctattctattcttgagtctgttttagtagtttatctagaaaattgtccttttttctgttttcaaatacataatatttttacaaggtcacgtagctagtaggaggctgtaagcctggtgagtttttgcttttatttaataacttgcttttttctaaacaggtgatctgtgtccacgatgtctcatccatctaccgagtccccttgttgttagaggagcaaggggttgtagattattttcttcgaagacttgaccttcctattgagaggcagccaagaaaaatgctgatgaaatggaaagagatggctgacaggtttgcctgcaatgaggagctgggagtgctagcctcctttactcttttgtagggctggtgaagccgactctagccctagcacttttgtacttttgcacttctgccatccactcattagaagagcctttgtagtaagagatgttcagaaaggatcttagctgtcacgtagctgtggcacagatgaggagatcctgatagggccaggccaggtgccgggcctccagacaatgagttcgggttatgtcttaacacgcttgtctcttaccaactagatcagtgcagatgggcgtcctggtggcagcgggtgagtgtgcatatccaaagcccacacgaatggctgacagtggctggagcactcctgggtaccactccagagttctgagctgtgtttgggaatgtgtctcaccccacaccagaaagggatcacattaggacggggatgtgttgctgcctactccactacatccttttaaggctcggtgatgctgtcacattccttcagaaatcttcacttcgtgtcttagagcaatgggcag

SEQ ID NO: 6279 - DNA, 4897 bp, Homo sapiens
agaggctgaggtgggaggattgcttgagcccaagagttcaagaccagcccaggcaacatagggagaccctgtttctacaacaaaaacaacaaaaccagctgggtgtggtcccagctccttgggagatcaaggctgcagtgagctgtgatcacaccactgcactccagcctgggtaacagtgtgagaccctgtctcaagaaaaaaaaattgtgaacaactcagtaccaaagatagtgcagtggcagtattacaattatgtatactatctttttcacttgcaataagcatgttcttaagttactaagaaaagtccatagtttcatatgcagtttctaagttgatagtgtttacatacaattcattgtcacagtagcacaatgtatggggttaattcatggcttcagtgtcttggtaatggcccgttaggcgattattgcaagttggactggtagaaaaggggaattgcctttgtggtttgttcttttgtgcagtggagtgctggttccaggaggatttggtgttcgaggaacagaaggaaaaatccaagcaattgcctgggctcggaatcagaaaaagccttttttgggtaaggagctctgcagtgcagtcttcacttaagagtaggaaagagtggggaacggtgccacgtgggagcctatgaacaaagtggggggattactgaaacatgctgtctttgtggataggagctcaagtagaagccttcatgttttctctttagagacaaattcagtcttggaaagcttatttatgcttatgagctacatgtagatgtcgtggaattttgagagaatgaattgtgaattcctgtccatttaatgaacccagctgtttgtagcacacgtgaggttgagttttatatctgctcacttggcacaacagctgactgtaattggacaaaatgattttgcatgcctcctggtgctgtacattttagtaattttcaacttgaacaattataaataaaaacttaatgagagagggtaagaaaacttgaattttaaagtactgaggctaggcacggtggttcacacctgtaaacccaacacttgtggaggctgaggcaggagggttgctggatcccagaaatttgaggctgtagtgagccaagatctctccactgcactccagagtgggcaacagcaagaccctgtctggggggaaaaaagtactgaatagaatatcacttacttctaaaatcggataactttgcaaatctagaattttcatctactttacatgcagtttttgaaatctaatacaagtaaagtgtaacagcagagagtacttgttcatagcaggaagttatgagtttgcaattataattctccaaataaaggacacaaaggccattgcagaggctgctgggaaaagtaggagctgccttttcaatggagttttgtttgttttttccccccgactggaaggcgtgtgcttagggatgcagttggcagtggttgaattctcaagaaacgtgctgggatggcaaggtaagcgtgcattaagacactcattcaattcccgcttgtgtatttctggaggatatgaggcctgttgccgcctgggtgatcaggagctttggagaagggcaggcctgggttcctagcacctcatggtgtgccgtaagggagctgccttgcctcttgaggaacagcacggctcctccatgcaggaaggagggagcacagccagactccctcctttgccttctgcctctgtgttcctgttcttgagattctgtcactttgatcaccgtggccaccatcctgaagctggtgcctggtgtgaagtccttgtcctaagtgaggcttgggcagttattatgagaacctgggctctggagctattgaaactgggctcagattccaaccttaccgcttatgggtgattttaagcaatttacttagcctttatgggcctccgttttttctgtaaaatgggagtaataaaggtacgtacttcacatgattaagggagataatgtatgtaaatagtctctagtagtgcctggaaaatagggaaatgctcagataatatcagctcttcgcctagctgtgtattactatgtgacagacctccctaaagctcagtggctcccaacagcagtgacttctcatctcagtattctgtggtttggctcagtgcctgggtttcagctgcacgtggtgtactatctgagatggcacactcctgccttgtgttcagctgtgagctcggcccagccgggacgtcaagatgctgtctccacctagtggctcatcattcattaatccagcccaagcttcctcacacagggtgggcagctggactccaaaatgacaggcctgttatgcaggcacttatcaggcctgctgatgtcccgttggccaaaacaagtcacgtggccaagccccgagccggcaggggaggagaacacacatgggtgtgaagactgagcatgctgcactggggccaccctggaatggtccaccacagcccatttattctctgtagcccacccgacaaatactagattttcagaaagaccttgtaaattctgtggaaaataaagtaacctgaaggaatgtaaaagcagtttgactttataaagaacaagtgactctggtggccagcatatggtttagggctgggtttcattcaccctttccctgagaggctgcttcacagtgacctggcggtgtggcttagtttggtagacagcatgcccttgagtgctggcttctgagtcctgagaggcactgtcttatcacccgccaccccagagctggctttctggtctccctggatccttcacagccccagacctctgcctctcacttaggttcccaaatgggtaggtgctttggtgatgagcttacacttcagttgagactggaccctggttcaggccaggaggagaacagtgcccagcgttcacatagtaccaggaacttggtcctttgccttttggtctttagtggttttgctttggttagacggtaagttcaatgaaggttagaaaggttgagttgaaatcagttcatttctgactgagctattgagtgaaacagttgagtagggctttgtattagctgctgaagatgaaagaagtatagaagaaatagtacttgtttatctcagagagacaagagtctgaaacattaagacaatataaaaacttggctgggcatggtggttcaggcctgtaatcccagcactttgggaggctgagttgggttaatcacttgaggccaggaggtcgagaccagcctggccaacatggaaaaaccccatctctactaaaaatacaaaaaataaccaggtgtggtggtgtgcgcctgtaatcccagctacttgggaggccaagacatgagaatcacttgaattctggaggtgtaggttgcagtgagccaagattgtgccactgcactccattctgggtgacatagtgagactcttgtcttaaaacacaaacaaacaatataagaactgtcacaggcggggcgcagtggctcacgcctgtaatcccagcactttgggaggccgaggcaggcagatcacctgaggtcaggagttcgagaccagcctgaccaacatggagaaaccccgtctctactaaaaatacaaagttagctgggcatggtggtgtatacctgtaatcccagctactcgggaggctgagacaggagaatcgcttgagacctggaggtggaggttttggtgccgagatcacgccattgcactccagcctgcccacacttgttgcccacaagtgtgaaattctgtctcaaaaaaaaaaaactgtcaaagatacagtatctaattaaaaattactaggttatgccattagttttgattttcccattttgtactgattgactttccagagagttatacttaacgtaaaaaaattcacgtgtgtgtgggttgagtattttatgtcttaaaaatgctatttattgccggtctggtggcttgcacctgtaatcccagtactttgggatgccaaagcaggaggattgcttgagcccaggtgtttgagactagcctggcaatatagcctttgtctctccaaaaaatgaaaaaaaattagctggatgtggtagtgtgcccctgtagtttgaccttcttgggaggctgaggctggcggattgcttgaacctgggagttcaaggctgcagtgagctatgatcgcaccactgcactccagcctggacaacagtgagatctcgtctggggatgaggtcagggggatgctatctttagtttttgttctaatcactgatcttaaactgaggagggaagttgtgtttagagcttagcaatgaaactattaatcactttcgtttgtaactattttcataacaagtattttggtatttcagatgccaattctacagagtttgaccctacgaccagtcatcccgtggtgagtcaagtgtttgaacctccacagggcttagaagggtgtagaaggggcatttatgaacgtgattgatgattagagacaagaagtgagactgcttgagtccatcccaaagaaccctgaggttttgggcactcagacctaccagagaggaaaaacttttctttttcattatgtaattcctccctaatctttcattgaccacagaaagtttttaagacaggtaccagcccaggaaactggaggggattcctgattaaaattcttctccatccctactcccctcaactcccagaacacagtatagatactaatatgagaccctggcatgtgtacttactgtgtgccagccgctgctctcactgctttcatatgtatattttatattaattcatgggatccccagccatagtcctgggagaactgctgggttggagcactggttggcttaaccgtatccaaagattttccagg

SEQ ID NO: 6280 - DNA, 1361 bp, Homo sapiens
agcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggcttatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatatagataccagtgtctttttaatcagttaacagccaaatcactacgcattcattggaccagtcattccccttctcttggtcttagttttctcatacataaaacgaggccgagcacgctggctcatgcctgtaatcccagcactttgggacgccaaggtgggaggatctcttgagctcaggagtttgagaccagcctgggcaacatggtgaaaccccagctctacaaaaaaaaaatacaaaaattagcctgctgtggtggcgcacacctgtagtcccagctgcttggggagctgaggtgaggggatggcttgagcctaggagatcgaggctgcagtgagccgtgttcgcaccactgtactccagcctaggtgacaatttgagaccctgtctcaaataaataaaatggagagcttggaaaaaatgattcctaagcgtccttctaatt

SEQ ID NO: 6281 - DNA, 1141 bp, Homo sapiens
atgcatgaatgggggttagcacatccatgaatgtagctgctagtttaaaaagagatttctcaaagaaataggaactccgaattcttaaatggaatgccatcattaagaagtgagagaaacatactggtagcagcattcagagactggtaaggatgtacctcatgggcctgcagtcccaaaagtggtttgggaccggggcatgacctttcctgggaattctgccccaatttacatctctctgattcagccactagataagaggaagcaaactttagccagactcttcttgcctcaccaactaagagaaacaaagaccaaggtatcacattctgccattagctgctacctctcccttccccattttcagacagattgagcccactttttgtgtcctcctctgctcttaagctgtttctcatcgtgggtgctcagcaacttgtctgctctcactctagtttctatttgcttccctgaaattagcctttaactatgcccagacaagccagagccttgcctaaacttctaattcctctgtgcttcttagtgtatcctttctgcctgcttgcctgcctgccttcctgcctgcttgcctgccttactgaccctttgccccacctctgatattatcatttcctgtgtttttctgattacttacctaaacctctgccaaagagctcgatctgtacaagagctgtcttttgctttgccctttggatctggtatttatgactcctgcccttctgcctggctacacgcttctgctagacatacataggtaccacctctgttatctgggtgcttactggccctccccctttcctatatccttgtctccacactaccctaccacttagagtcctggcccaactgaccatgcacttccgatatagcaggtagtcacccaaagctcagggagatttcatatcccattaagctttcctacctaagttgagactactacttttttctccaatgttttattttaaaaatttcaaacctacagaaaagttacaaaaatagaacaataagcaaccatgaactctttgcctatctttaccactttttgcagtatttacttcgtctgtttctcctaactatatatacacatataaatatacatacttgttgaatacctgtatat

SEQ ID NO: 6282 - DNA, 1197 bp, Homo sapiens
cacaccaatatactgaaatattccacaaagagacactaagaatatggtagtttaataggacgtagtagtcctaaaaagactaaaaagggattaaaagtccctacctggaagggtagggagttagagaattatagaatgagaaaacatttaattaactggcctatataagacattcttgtcctttttttaactggtatgggtctatttgatgcttcgttggaaagtaattttttccccttcatcttatctttcattgtttcttttgcatgaaaccattcttaattattagggaataattcagttggttgtccctggcccagctataaccaatctgaatccaaaacatgaattttggggttttactcttaatctgtctatacctcatgccttgtttttcccagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggtgagtaagtaaacccaaactctttctagccaattattaatagttagcgtccaaaaactgaacatcctattatgggaaagcctagggtacccagcttatcccttatttttcatatagtctcctaaaaaggcccacccaaaatgaaacaagctgcacaatttggacatctccatctctacattagcttatgatatccaggcttcttccaaattctttctaacaagaaatcacaccctttgttcttcttggccagtgcccatttacctgagagagagaatggaaggaggtcttgccgtttaacctatctcaaaaagcataaagctttcaccaaatcctatcataatgacaagaaatgagagaaaatctgccagtagaaagcatggctgttataaggatctcttatctcctttctcactaattctcacctggtccttggagttttctcgcttcgaatccattattacataaaaatcattttttaaaatttaagctaataacctcactaggtttttctttccagatcagattcccctccagcttttgcctcaataaatctgaggg

SEQ ID NO: 6283 - DNA, 1114 bp, Homo sapiens
atatagccagatggtgcaaaccttgaaggaggaggggtttttaaacacaagagtgagaaggtaatagtttttttacttttccttcctggaagcagagttctgatctctatctttattcaggactcatattaatcattctgtttgctctgaagagtctgttcttagtcttggaaagtgggagggcacatacctcatattgaatcctttctgctaatacttaatgacaaagggcagtggaggttttttcctctgatgatcattagtgggtgggtagggaacaatcagataaagcagtgaggatatacccatggttttctagacagagtatagtggaaagagcctaggctttggagttagaaacaccaaaattcagatctagactctgtcacttactagctttatgactgtaaacaaattatttagcctctgtgagcttcagtgtccttatctgtaaaaaatttatacttcataggatatcacaaatattacatgaaaaaatatatacacacataccacataaaatcacaagcgattggtgattcatagatacaaagtaaatattagttcctttcttccttcatttaaggggcttatgctctgctagctgaaatgaaccttttacatgcttacctaagttataaaatagaacatagtgagtactctaagggaggtagtagcaaagtggtaaagcagttcagaggagggagctgtcatttctaagcatttggaaacaaggttgggcttcatttcaaaatgaattttacttgggccatgaacaaatttcaatagagtaaataatttaggtagatatataaaatagggaaagcatagggtatggtatctttgttaaaaatagctaccacaggtttgagtattgtatttgtaaaagctaatagtaggaaatatggctagagagatgggctggggcattggtattaaagatccgaaactgtgatgcagtttggagttgattctggatacattagggagccacacattggatgtcttctttctctacctcagtttactatctgtaaaatgtataggcatcaattcagaaacttcaaatttttgtttgcaataaacgaaataagaaattccacacttgaaaaga

SEQ ID NO: 6284 - DNA, 2052 bp, Homo sapiens
ccccttacctataaaataaggatcataagagccactttttgaaggcttatggttgaattagtgagataatgtgtgcctggcatataggaagtacacagtaggggttagtttatttcttactttcttctctacccaagtcgctgctattattgcctctttccttccaggccatcacagagccatgaaccagcagcacatgatgccttcccaagccttccagatgcggcgttccctgcctccagatgacatccaggatgactttgattgggattcaattgtgtagggcttgtttctgcaagacaccagaccctaacgttacctttctgtgcagtgaagggaaaggtttaagagaatccagttgagaaaacaaacttgctaatcactttaccaatgttatcaaaattacttttgaagacaatcagaaggattttagctggataacttactgcttttatctgacccaagcaagtactacatgtttgtctccctgccagctgccctatgtagctcctaactgttgtgtgatttggacggctttttgcatatttgtgtcagtttgatgttaaccacaagtgccagactgatttttcagacggagcctattttgctgcaagcagtttatataaagatacatatgtgtaaatatatgtacaaaaattactgaaaggcttcagttttttctaattggattattatgtcttgaaagttattgtcagtttttattccttgttaggctattttctgcaggatgcttttaactgatgtaggaaactgaaaggaaatagattttttccaaaacccagttccccttatttaatcttttttagaaatgtgggtaatgaattctatctaataagtcaaggaaaccagaatttgacacactccaacaatccgaaggggcatgttgctcctgagcagcatgaagaactgaccaaattggttttgatgcttgggggatcatagagtatttatgtctgcttttctaaatctgcattataatagctctaaaatttgttgattggtaagaaattgggcattgcttggctctttaaacacatcagtgcttccacattcacctatgtatttattattcaaaagtgtcattttaatatttattgctaccttctgtgaatgcttagctcctgtcgggttcattaaggagaaatgtgtctgaaagcacagaactattattatttttttctttttttgagatggagtcttgccctgttgcccaggctggagtgcagtggcacgatctcggctcactgcaacctccgcctcccgggttcaagcaattctcctgcctcagcctcccgagtagctgggagtgcaggtgcacaccgccatgcctggctgattttttgtattttagtagagatggggtttcaccatgttgcctgggctggttgcaaactcttgagctcaggcagtctgcctgcctcagcctcctagagtgctgggattacagacatgagccactgcgcctggcccagcgttacttttcttgataagaatttacagataagacactcagagagacattgtgtcattctctatcatcactccttttaccatgtgaatagatttctctgtcttggcattcttgctgattcagacttattagttaaatcggatttttctggaatttgaatcagatttcatttgggcaacaacagcagggcagggtttctaaagcaggtttccccactcatctaggttgtcttgaaaggaggatagagccacttacagttttatttgcttcagtgtttaatgtagatattatgtggcctgctgtttctgttgtcttgtatgtctgtgtatgcatgacatttggtccctttctttgaaatgcagcccctcttacgggttttttagtggtggtggtttgttttgtttcatatcatatcacagtttgcatggactgattatcttagttttatgataaaactagaagaaatgagggtttttttttaatgaatagattttgaattgattctttagaccccccaaaaagtgtcagttctaatggggaaatatattccatcaagtcaa

SEQ ID NO: 6285 - DNA, 1267 bp, Homo sapiens
gtgctgggattacaggccaagccactgtgttcccctaagactttttaaactaaacatttaactgaaaagtttgatggttgagaaatcccacttaaatttaattccttagtttcccatgagattgacctggtaggtaatgaccattgtttgcttattaagcttttctttttccaatacagataacaatgaagatggtgccaaaactgctttctcctttggttaaagattgggctcccaaagcatttataatttcctttaagttggagactgaccccgccattgtaattaatcgagctcggaaggctttggaaatttatcagcatcaagtggtggtggctaatatccttgagtcacgacagtcctttgtgtttattgtaaccaaagactcggaaaccaagttattgctatcagaggaagaaatagaaaaaggcgtagagatagaagagaagatagtggataatcttcagtctcgacacacagcttttataggtgacagaaactgaagtaaaaagcccttataggatcaaaaattgttcagggctcttagagatggtgaaaactacaaaaaaaaccatggctttcatatggacagataaaatgaaagaaagggaaaaggcagtggtgtgtaggcaaatatggtttggcatttgtcttttaatgacacctgatatgatgtcattttgattttgaaattgaacactagaactgttaatcacctttaaaaagaagagcttattgggaattatatattccttaaaatatacatgggggcctgaatgtcagccatctttatactatagaaaaaggattatggatgcatgaatggtcatgctttggagatcaaatattggttgaatgcctatgtatgtcaggccctgtgctgagccatgaggattaaaaagatgaataaacatatcttgtttaggaaatggatgtataaaaaaatcaagtgcaataaagtgtgtgtccaaaagctgacacaatggaaaggatgttttgttttgtttgaaatttatcaaatatagtagtaggaaagaaggatacctccctgaagatagattgtagaatggtgagcttttcactgcatttactttttgcttcttattgtagattcacctcatgtttgggtaatagtttacatttcaagtattttaggactgcttttcagtttaacttaatatgtccttccacctgggaccaggcaggggccacttggtgatctctgtcctgagggatgcattacagtgtggtagagtatgggctagaa

SEQ ID NO: 6286 - DNA, 1174 bp, Homo sapiens
gcaacattaatataatcttttaatcatttctaattgttttttttttttgttggtttatgttgttcccggaaaaagacgagagtgtttcgtgtctaaaaaactcctagaatgacacgtggtttatcatggtttatttaaactgcctgtagattaataataataattctctggcagaccacatgatacaattacgttcttgttactttagctcattagctcacttgtttttattacccttaattccaaaattaagggattctttttcatttcgctttttacatgatatcgagaggtacgtgattgttgttccctccaaaattagcattcaaccagtggtgcttttggttttttcccgtttactatttgctggatggcaagagatctgttaatgtctcccaatacacaagtaatgtaaactagggcatgtactacactaaatgaagatcaccatgaattctacatgatcatctttatttttttctttacagtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgtaaatttgtctagttttgctttagtttgtaagtatttagctatttataggacccttagcttgacccagtctacaaatagatgatgctcactggtaattccctcaggtaaaatgtctcaaaatctctaatcctttaagtggcatgcctgtgggcccatactaaaaattagaaaatacatactctgataacctggccatttttcattgaaggatttagctcatttgtaagaaagacttgagtgtagattttgggtgggtccctttggctgtgaggcattgtttaaaagggcattgctctagcctagacc

SEQ ID NO: 6287 - DNA, 2108 bp, Homo sapiens
acaggggactctaaggcgagggtggagagtggaaaggtggagtttgtacggcatcagtataggttcttaaaggtttccctcccacacaaagccaccctcctgctgctggttgagagcacctggaggtgaaggctcaggggaaagggaggcagggaagggccatgatgagatgtctctgcctttcccagcgccatcctttacctaaatggggacttcgatggcggaaacttttatttcactgaactggatgccaagaccgtgacggtgagtgctcccttgtccttgtccctgggagataaaaagtctgttttctacagctgatgttcccaaagtgcagtggacaaaaataaccaactgggcttcccagtgggcggtacccttcccccatccagaggggctttgagacgtgtccatcactcctctaaccagtcaccctttctctttagttctggtcttagggaagccatactgaagagctgccctcggtcgtgagccctaatgagcccatgtctcttctgagagtggattacagtctttgtcctgtgcaacccccctccctttctgtcccccttaggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggtgagagcagctcgagcgggtgagagcagctggtgctgtggtgacccgttcccagagcgcccttggtttgcctttctcttccccaaatcccattgccagtggctgagacacgaaaggagcacttgggacaccagctccaacgccctgtcattatggtcacattgccttgtcctccctgggcctgctgtgaacgggatccaggtggggaaagaggtcaagacagggagcgatgctgagttcttggttccctccttgggccccacttcagctgtccttttccagagagtaggacctgctgggaaggagatgagcctggggccattaaggaaccttccttgtcccctgggaagtagcagctgagagatagcgagtgtctggagcggaggcctctctgaatgggcaggggtttgtccttgcaggacagggtgcaggcagatgacctggtgaagatgctcttcagcccagaagagatggacctctcccaggagcagcccctggatgcccagcagggtccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcatgacagcgatacagtacttaagtgtctgtgtagacaaccaaagaataaatgattcatggttttttttacttggtttgttcagacaatggaaatttgcccattctgtcccagaggtctcacttgataaaaattgctctaggcaggacccagtggcaggtgtgggacgagaagtcctggcttggcacctggctcaaccacttgctgtgcagccacaggccagacacttaaccttcagcacctcggggttgtcatctgtataatggggatcatagtcctccctctgctcaccttctggggcagctgtatggcccagatgcaatatcggatgtgacaacacttttgtaaacggtaaagctctgggtgaatggttgggattattgttaatcctcttctggcagggagcggcggtcagcagtgctctggcacgtcacccctatgtcagccacatgcttcctgctctgccgtctggcctcagtgtcctgtatctcggcctccctgtgcaggaagacacactctaggaaacactggaaatggagattcagctcctctggctacatccctgg

SEQ ID NO: 6288 - DNA, 1148 bp, Homo sapiens
ccggctgacgcgccgggattcgctgagggccggtggggggatccgggctgactgaaaggaaaagaggcggtgcaagcctcgtgggcatgcgccgcccggcttggaaggtggggcttcgcccgggggcgggccttcgccgggggtaggactccggccttggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaaggtgcagacctgcctggaaccaggcggccggggtccttctggggagaggagtgttgcaggggacctgaggagcttgggggatcggggaagtgtccgcagggaggggaaagtggcctcctggctggggagctctcctcggagccggggagagctgctccctggcaggagaccttcctcgcccagttcgcatgggcagatgctaaccccaaaggtccagcctggggttagggcacaggccaagcaaaactcatggccattttgttccctgggaaatctcctggaaggaattaaagcggcagtttgggtctcccattctgatgtcattgtaagtgtccgagtgagaagctagtagcggtctacaatatctcccttccggttggttttccagtggtgcttttcctgctgtttgattcagcagctctctttcaggatgtgaggttgccacgtcgccagcaggggctgcctggccctttctgtgtgtgtgt

SEQ ID NO: 6289 - DNA, 1106 bp, Homo sapiens
gtacttcccccccccccccccccacattttggtgtctgtcaaacttggacacttctaaaagtcaatggcatgtcacagtttaagtggcattttttctttcttagagctacataaaagaatcataacaagctgggcgcagtggctcacgcctgtaatcccagcactttgggcggctgaggcgggcggatcacgaggtcaggagattgagaccattctggctaacatagtgaaatcctgtctctactaaaaatacaaaaaattagccgggcgtggtggcgggcgcctgtaatcccagctactcgggaggctgaggcaggagaatgtcgtgaacctgggaggcgaagcttgcagtgagccgagattgcaccactgcactccaacttgggcaacagagcaagactccatctcaaaaaaaaaaaaaaaagaatcataacatagcatcttacatttgatgaagcatggcacattgaaagtacaatcgattgccatcttgttaataaaatgtcagagggattagaggaaagactcttagatgatgcttgaatttctggcttgagtgtctgcattgaatagtggggatcccctcaacaaaattttcaggaggaggaggatatccctgttattttccagaataatcagtgatactctgtgatattgataatctaccttgttggcccttaccaaattactgggtgtgagtaacagctgactgtagctccctttctctaccctagtgctctggaaggaggaaaggagagctggcttgtatcttactttctcaagttatcagtccacaaacatgaagagtattagtgttacagatacaaagatgataactactgtcttatgagcctttattctgctaagtgtatccattatctcttttaatcttcacacaacccaccatcaatgaggtatatagtattcttatgttacacagcaggaacatctcagagattctgaaactggcccgtggttatacagatgggaagtggtagaggtcagattcagacacagtcctgtttgagtctgaccataaccttaatcctgtttgggccaattaagacagtcgtaaaagatctcagtatagagctataaagaagtta

SEQ ID NO: 6290 - DNA, 1652 bp, Homo sapiens
cttatccaaagtcctacagccaggatgtagggtcatgactccaaccaagtgtgtctgtgtgtctttcagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaacatggttttgaaatgcttgtggattgagggtaggaggtttggatgggagtgagacagaagtaagtggggttgcaaccactgcaacggcttagacttcgactcaggatccagtcccttacacgtacctctcatcagtgtcctcttgctcaaaaatctgtttgatccctgttacccagagaatatatacattctttatcttgacattcaaggcatttctatcacatatttgatagttggtgttcaaaaaaacactagttttgtgccagccgtgatgctcaggcttgaaatgcattattttgaatgtgaagtaaatactgtacctttattggacaggctcaaagaggttatgtgcctgaagtcgcacagtgaataagctaaaacacctgcttttaacaatggtaccatacaaccactactccattaactccacccacctcctgcacccctccccacacacacaaaatgaaccacgttctttgtatgggcccaatgagctg

SEQ ID NO: 6291 - DNA, 1178 bp, Homo sapiens
cgcctcccaacccaagccctgtgtcccgtcaggctgaactgggcttcgtgctctaggcagcctctccttctctctcctatatccaaagagttctagtcctctctccccttcacccgtcaccactaccataaacccttactgcttacttatagcttgcccaggcattgttatacatactctagaaatagtaattcagttgttcttcaaaataaccccattaggcagacaccataattttccctgctctataagaaactggggcacaggaatgttaagcaattaaagcaaggacacacagctagtaagtggcaaggctgcaatgtaactccggggagtctggccctagtctgtgcccttgaccattgtggaagatggacacagtcccagatgggcacctaaacaccctttcactcacctacaactgccacctagctggcagtgtgtggtctcactttggagctgagtcaagctcagtcatgtaccaacatctcaggtttcccacacacagttgcacaatctcttacaccatcacaccctgtcatatcacatcacccctcaagcccttcagttagattcatggcttgttggtcatttagtgtcaactctgcacctccaccaccgtgctgggcaccagcaacatggatgcatcagacagaccatctccgtgctgaggtttactgtacagggagcacacggtaccttacagttagtcttctaaaggcgatgatggaaatgcgagcaagcacagtgggagcagggaaggaagagggagagggtgcttcgcccttagagcagggtttctcagcttggcactgtgatgtttctgctggtgttgtagaggcctgtcccatgcattggaggatgtttatcagcatccttggcttctgccctctagataccagtagccagtgtggcaaccaaaaatgtctctgggcattggcagatgtcctatggggtaccaaagccgtctctgtttgagaaccagttgcagtggagtgggaggggtggttctcgggaggaaggctttccagaggagtatctgtgcatgttctgaaaggtgattaggcccaagcaaaggtgtgaggtgtctaggtcgtatgagggagtcactgcgtgtgccttgtgagtcatagttggggtagaggagacactttattgcaagagctgagaagggcttc

SEQ ID NO: 6292 - DNA, 1232 bp, Homo sapiens
ccattttgctgacaagcaaatggaggataggggagaggtggtacatgggggacttagcctgctggaattcacagagcaaacaggcagatgggctggaatcagaagccagcggcttcagctccaaatccagggtgcttctcctatctatatctgtgctattcctaccaagtaatttgggccccctcgcataggagggctggttcctgggcctcccagtcagagagtctagaaccaccagaccctaggcatggctccaccagggaaatgagacccccaagaatccaaagcctctccctctctgagacctggctacagagagagaagatcatacttcccctctctccccaggaaatggcccggccagcccagtatcttgaagtcagctaggctggtttgggcacctaaggtcaggaattggccaagtttcctgggagaaagactggtgtggtgccaagagtcaggcaagatatctgaacacagaaacttgccagtccaggccctgccctgtagtaacctgctcccagacacgcctataacagtgtggtttgtttctccgcagaagctgacgggtcgcctcatgctggccgtgggaggagcagtgcttggctccctgcagtttggctacaacactggagtcatcaatgccccccagaaggtgagtactgtgccatcgttggcttatggacaccagcctgctctgttgcacatcacacatgcccacagtctcacgccaccacctgaattagagtcatttatatgaacgcactgtactgtctgcctctccagccagttttctggccctgatcatgtcagagactcttctcttgctttggaatcagggtggcagaattctagaatctcaggtcccacagaatcctggggtcttgtataggccctcttgaccaaccccccacccaactcagtcatttaataatatgtttgatgatataataaactcaaagcaaagctcaatacaataatgctgcatttccgtggcattctggggctgcagagggttttcatgggcttgtctcacttgatgctcactgcagcactgtcaggaggcagcaggcaccactcccagcctgcaggtgtgggaaacggccagagagaggaaacccgcccaatatcacccagctaagtcagagacagagctggtatccaacacctgcctgccaggtggtccttgagcctgcactcatacccatccacaggcagcacacttcctttat

SEQ ID NO: 6293 - DNA, 1276 bp, Homo sapiens
cctgggcaagacctcctggagtctctctaacaaataaatactactttccatgcagtagacgctgttctaaacactttacaaatattaactcacttggtctttctacaaccctacgaggtggtactgttactatccctagtgcaccgaagtcacccagcggccgagtgagaactccagtccagctttccacccgctactccgcgcatcccagcttgccttacagccgggtaccggctccaccattttgctagagaaggccgcggaggctcagagaggtgcgcacacttgccctgagtcacacagcgaatgccctccgcggtcccaacgcagagagaacgagccgatcggcagcctgagcgaggcagtggttagggggggccccggccccggccactcccctcaccccctccccgcagagcgccgcccaggacaggctgggccccaggccccgccccgaggtcctgcccacacacccctgacacaccggcgtcgccagccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaaggtgagtcgcgcgcccgcgggccctcccgccaggaacaaaggcgcagactcctgcccgccttacgccggccagggcctcccccgccgccccgctgcgctgtgcgcccggggcgggccgcgcgcctctccgagcctggctcggtgcgggtcccgagcgcagcgccccgccgggccgctggccgcagtggggatgggcttcggatctagcgggccggagggcgccgcgtgcgtagttggcgccggcactgagcacatggcctccttccgggggcgccgcgccgtccacgcggccctgctggggctggggacacagggcccgggagcggcacgtcgcacacgacctcggcagcagcagcccagcctcggcccctcccggtgcgggggagggggcccgagcgcggcgcccattggctgagcgggccgagcccccggcccggccccggccccggcgcgcggaggagtcaggagccgcccccgctctccgtctgctcccctagcc

SEQ ID NO: 6294 - DNA, 1227 bp, Homo sapiens
actttttgcgttcacaaatgctaccccaaagatgcaccgtggtgttcagaggaggctaaccaaggaccggaggagaggcgaggtggtgtggctgttcaggatcagagcactggaacccagcaggaccgtgtgcctatctcagttccaccatgccagagccgtgtgacctggggcaggtagcaacgtctctgagcctcagtctcctcaccccctcatccctccacctcacaggtgaagagtaaccctgagacactgcccttagcaatgtgcctcccacgaaacaccctggagcattgatggtgatgatgaaggggtggagggaggtggtgggtcctacagtagaagggtgaaggcatctcagccagaaggagctgggttcaagtgctagctcaccccctgtctggctgggtccccttagacgagtaactttacttctccaagcctctcgctcctcatccgggaaaatagagacgatgataccttcctcacaaagtggttgggaggattcactgaatgggtggcatgaaagtccccagcacggtgacatctccctcagcagatgtttctgctctgtcccttcacatgtggcatgagctcctgtgtctccctgtcaacgagtcattcggaaggaaaggctggttactttgaatagacgcatagctcactactgaggagaagtcctcaccaaggactgttggaaagaagacctgtgtgtattcatgctcgagtccagaccccaatctgaacccatttgaagtgcctccctccctcctgcccctcctccctgtcctcctcctcctttttcttcttcacagtgatgttgttctggacccactgaacttgctgctggacagcacttagaatggtgccctaatgcctggcacatagtagatacttgaatatttattaagtgaataaataaatgctatagaataaaactcagtcctttttttaactggtggagctaagtcattatttcctgcatttgtgaatattttaaaattacaaaataaatttatattgattctagaaaaataattagaaaatacagttgattaaaaagaaaaaataacagttccatgcaatcccattgtccagccttaaccactggtgttaatttgctctacaggtccttccaggcattcttctatgcaaatacatttaaatattaatcaagcatgttgtttggtaactggctttatttttcttttcacttagtcatattct

SEQ ID NO: 6295 - DNA, 1178 bp, Homo sapiens
gctcccaagcttcccaattccgtcccctgccccgctgccgcccgcggctctccttccccttctaggaacggctcaagcgccttgggcactccatcgggttctgcaccgagttctgcatcataaatacgactctcgtgtaggatttaagtgtgaacttctgcaggttctcggaccctgaagcacccggggccagacattccgagctcgcggcggtggaaggcacgcaaaagggcgaaccgagacgactccaggacgctgaggcagcgcaggccccacccggccccgccctgccccgccctgtcccggccggctttccagtactagtcctctggcgccggctcccagcccctctcgtacccttcaaatcgcgctccgccgctagactctcgtgatagctgagactttccccggaaggcccgcccccttcgccggagaggccaatgggctagggcaacggttgcgacggttggattttgaaggagccaataggcgctcggagcggagagtttaagaggcgtaagccaggcgtgttaaagccggtcggaactgctccggagggcacggtgagaggtggtggggctgagccgaggtggggccgtggccagggggagggggtgctaggccggaaggggctgcagccgagggtggccctgattttgtggccggccaggagcgaaggggtccctttctgtcccctgagcaccgtcgcctcctttcctccagggctccgtaggcaccaactgcaaggacccctccccctgcgggcgctcccatggcacagttcgcgttcgagagtgacctgcactcgctgcttcagctggatgcacccatccccaatgcaccccctgcgcgctggcagcgcaaagccaaggaagccgcaggcccggccccctcacccatgcgggccgccaaccgatcccacagcgccggcaggactccgggccgaactcctggtcagtgaggtgccaaaggaactgagtgagagcagccttcatactttctccctggggagcctggtcagactgtcttctctttctccgccccaggcaaatccagttccaaggttcagaccactcctagcaaacctggcggtgaccgctatatcccccatcgcagtgctgcccagatggaggtggccagcttcctcctgagcaaggagaaccagcctgaaaacagcc

SEQ ID NO: 6296 - DNA, 1118 bp, Homo sapiens
ctgtttcatagaaatccccatccatcaagaaatatgaaagttaaggctgtaatatgaaatattacagtcactcactcctgtaatcccaacactttgggaggctgaggcgggaggatcacttgagcccaggagttcaagaccagcctgagcaaccaggggagaccttgtttctacaaaagaatttaaaaattagctgggcgtggtggcatatgcctgtggtcccagctactcagaaggcaagtggtgatggcgccactgcactcctacctcagcaacagagtaagactctgtcccaaaaaaaaggaaagaaaaaagaaaaagaaatatggaggttaaagccaaaatgtgtaggttggttctctttgcctcttttaccacccatgccattacgctaagtactcttcctgtggacaaaaaggcttcctgtgctgctccccagttgagaggcaggctacttcagagcttgatggttcttaacacttcaacatccttaccccaaccattcagcatagagaccgaggacctaagcgagcctgagtttcagagcacccgtgtccctggcattccagaccctgggccagagatctctctgacagatgtctgccagctcagaggagaggcccatggtgcccttcatagcgtcatccaggtgggaagcttgggtgagggtagaagaggtgttagagtcctgcctgtgcagagggacaggattctctcctgggcggggggtatgcatgtgtcctgctctagggtagggagtagtatcctgttgaggggtgactgacattctaacctccttctaaaccccacaacaggagaagttcctagagatcagtcgtctccacttccgcacagtgccttccaatccccactacttcttctattgccctccatccagcaggcgagaagtgagtggctctcttccttacctctctcgtgccctcaacccagaggcccacccagaccctcttgagtcttggttccctgaggcctggatgtggctcttgtcttgccttagatcaagctgtctaaggcaagacaagtgtaatcccacttgcctaggatgaggcaagtgggattcttgcctcatcatcttgcttcattcttttgcctaggat

SEQ ID NO: 6297 - DNA, 1202 bp, Homo sapiens
ctttcctcaagcaggagctgcatgggaagggactggcttctgccatgttcagggttaggactgcagttgactgaggcacagcttggggaaggggagctggggtggctggagaactggtggtgccaccgacctgataccagactgggttcggggtgaagaggatggttatttgggatatattttgccccaggtgtccagtaggcaactggattttccagctaatatttatagctcaattaacatgtgctggtcttgggctgagactgttaaataacttctagtgtaattcttgcaacaaacctatgagggcgatgctattataattctcattttatggatgaaggcacagaggttttgagagtaaaactcaagtgtccatagtgacataacgagtagtttggcagaattggaacctagtgctggctacctccagagccagcactcctaacactgcctctagtatacaggggattctttgagtttggcatgatagggctgctatggaggtagctggatcctctaccagtgtccccaccttcccaccatggctgtgtcaaggtcctgagatcacggatgagctcgtgcgagttctatgtcggcgcctggatgaggccacgctggacgtcatcacagttatgcttgttcggaactgcaagctgacaccagctgatgtggaggtcagctcccctctaggcaccagcatccttcccagactcagccacaggttccaggacagtctaggctggaacttctgcattcagctctgccctcttcttcccactctgcagttcatccagccccctggaagtctcccctcagaggtgctgcatctggccctacccacctcctgcaggccctggcttccagccctggcatggtacctacggcagaacttgctcatcttcctgcactctcccaagtacacagatagcaacagccggaaccacttccaagtgagatggcactcatctctctccacactcatgtgcacccctgccccctgccccacgcacttactctttcctaccgatacccctatatgtacctttgcccatggacctgggtacacccatgcccccccggggaccattattacccgcctgtgtcttctcatgctcccatatctacctgcaccacattccccactgtgggcacccatccccgagggttttgtccatttgcttgctcttagtgctctgtgg

SEQ ID NO: 6298 - DNA, 1122 bp, Homo sapiens
aactggtctccacctaccaccacctggagtctgtcatcaacacagcctgtttcaccctctggacccgcctcctctgagggagtggactggaccactgaatgtcactgttccttgaatcatgggcctaccagattgcctgccagaggcaggactgaccagcccttctgggccccagggcaagccagacactgagtgacaccaaaggctttgtaactatgtcttgagggtctgctgccccagcctggcagcaggaaccgccctccccaaacacccacagccactgacccatccaggactccagagagtcaggtcaaccccgaggaccccttgggcccttctggggtactcctttcggcccccctggtagagtctcgggagttcacacagggtggcaaacaccccctagagctcctctgcctgaatcctgccccctagcctttgaccactgtcagccacctgtgtcccttgagccttcgggtcttcacttcccacttggacatcactgctggacattcccatcgagatgacacctgggttccaatcccagctctgcctttgaagcacttgtggccaccgtcaagtccctttgctctcggaccctgggtttctcatcctttaatgaggtgggttcagaagctctcccatcttcacagcaaccctggcactggcttctcaatgggagggaagcagcagagaaactgaagtgttagacactatgtgtcccaccaccccattacagagacatatgacaatgttcagcaggtcatctttaatgcagaggaggagatgggatgtcactcgctgtctggaggcacgtgggtggtgtgcgggccctcactggccagcctctgggtggccccgcctatcccagtatgaacgtagccaactcaagccctctactgtgtctcctgcagggagagggaggcctcggcacctcagcccacaaggagaaaacagcccctgtccgggtccctccagagctcccttccccagggccacgcctcacctcgaggctgatactcacagcccacgaagcctttgtagccttcatcttccagcagttgaaacagataggggaaattcagctctccggggctgctgggctcccctcggcctgggacc

SEQ ID NO: 6299 - DNA, 1116 bp, Homo sapiens
gcaggactggcagcctcatcctgtgggcaggctatgagttagatggaccttgtcaagtccttccacttcactcacaagctggtgtgaccttgggctttgagtaattccctgaatgtctcttggcctctgttttctcatttgaacttagagatgaagaattcctctaggtgctgttgtcaagttccatgaaacggattggtgttgatttttctgcacacttcccaatccccagacgtgggcaggaagcaggcagcagggcagggtagacgtgggctggacctgggcccatctgtgggctcctcactcctctggggaaggcagtggttgcacagggggcttgagcctcagagaaggtacctgttggggatgaaacccgctcaaatctcctaataggcctggatatggagggtgaacgcctggccctctgggttaccaaccctcagggttatgaggtgctagacaggaaaagggtgggccctgatctctgcctctcgccagccaggccaaattggggaagttcagtagtcccccagtttttagcagggttgagtgggctttctagggactctgtctctgggctgtgagtttgctgagtcctgctgcccgttcctctcggctgggctgcgtgttgtgggaggcccagtgtgctagtagcccatggcaagccctccctttagcctgtgtcctgtctgccttaacaccaggctttgttttggtaagtgctttgttttggaatcttacccaccggtgggatttgggtggccctgtggggtggggttactacctcttttcttcaccttccccctccattggccccagccagtggggtctgcaggagtcctgactcacctccctgattctcgtcacccccagccccactgagccccctcctcctccccagagcagagccagtgacctgggacacagcttcactgacactcagtctggctctgcctgcttgctcacacactgtccgtgtcggcctaactcaggcctcaatttctccatgtatttaaggccctttcttgtgttttattttacctgatttggctttgtgtggctttccttccttttatactaatgcttctctctgatcttatttgcattcaaattacc

SEQ ID NO: 6300 - DNA, 1217 bp, Homo sapiens
tctcttctggctggcagcccgcccctctctggagagagggactctgaggaaaccatctgggagtattcacagaactcccggagggcttacgaagaatccctggggtgggatgtcgtggagatgcctctgcaggtctagagaatgccaagccctgtagacactgcagagcctcgcagatctagaagctatggagggcttagtgagccttatagccaggagtccctgaatgtttgaaatccttcagtcctttctcatagccagtgtggcaacagcctggttagggtggggcagcttacacacagggctgcttctcatgggctggtggggaggagtggcttcacggtgtctgttactctgtaggggcagtgggttgggcaggtgtgggctctgacacggaaggtgagccttgatctcggcccagggagctgacatcccaggccacagcctcagggctggccggcatgctccaaggcccctcatgacccccatgctctgctctgccagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccaggtctgcctgagccggcttggctgtcagcaccctgattccctgggcctggcctgagacgatgccagtctcaaacaccacaagaccccaggtctttatcagtttgggggcttcgagatcctggggcagcactaaagacccaagatctgtcccggggatcctaagacgcggccctgggacccagaggccagacctaatgtggctccagggacccagtcctgccaggtccaccttgtagggtctgggagaccaggcccagggtaacccagacccagagccctttctccaggattaataggcagagggtggggggttctcacgctgagctcacagcctgctgttctccaccgggccacagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgcca

SEQ ID NO: 6301 - DNA, 2608 bp, Homo sapiens
aaacaaaacaaaaatgctgcaacattgcctgtgctgcctgggggctcaggggattgatgagtaagatgtgttctttcattcggcagctctctgctgagccccagtggtgtgcctggctctgggcaaggttgcacagagcaatccttatggggtgcccagtcaggagcagagaaacatgattgggatggcagatggaaggcaggtagatgtgggggcctgagagaatgacaggagagagatgagccttcagaggctctttcaggctcccccgcacactgcctgatgtagctgccagggtccagcacctgctcttggccagcagaggctaactccatggctgcagtgtgagtgtcagctgtgtagtgggggtgtccactggcgcgacccacactgaccagccccctatcctggcaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggtggggttggggcaaagcctcctttttaatacattaagtggggtagactgagggattttagcctcttccctctgatttttcctttcgcgaatccgtatctgcagaatgggccactgtaggggttggggtttattttgttttgtttttttttttcttgagttcactttggatccttattttgtatgacttctgctgaaggacagaacattgccttcctcgtgcagagctggggctgccagcctgagcggaggctcggccgtgggccgggaggcagtgctgatccggctgctcctccagcccttcagacgagatcctgtttcagctaaatgcagggaaactcaatgtttttttaagttttgttttccctttaaagcctttttttaggccacattgacagtggtgggcggggagaagatagggaacactcatccctggtcgtctatcccagtgtgtgtttaacattcacagcccagaaccacagatgtgtctgggagagcctggcaaggcattcctcatcaccatcgtgtttgcaaaggttaaaacaaaaacaaaaaaccacaaaaataaaaaacaaaaaaaacaaaaaacccaagaaaaaaaaaaagagtcagcccttggcttctgcttcaaaccctcaagaggggaagcaactccgtgtgcctggggttcccgagggagctgctggctgacctgggcccacagagcctggctttggtccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgttggatgatgaaacattcatttttaccttgtggatgctagtgctgtagagttcactgttgtacacagtctgttttctatttgttaagaaaaactacagcatcattgcataattcttgatggtaataaatttgaataatcagatttcttacaaaccaggactctgtctcagctgtttctggaaccaaagagtctgggccaaatcagtagctaggatgggttctggagattccctgctcctgaggagacggggagggtaccctaagtatttgtgccagtgtaggctcctggcatggctacccactttcagaaaggagtggttataaaccctgaaaaccaggccaccaagagccagccaggccagagccaccagtgcatgtgaagagcaccctaggccggggagcataccctttgcctctctttccctttaagattctgtgggttgcactatcggggcattgggactgcccctctcccactaccttggaggagagggatggccctgtggcagtagagactgaatgtatggaaattggttagtgagatctcctgtaattattgcaatgtggataatggacacaaaaaacagtgtgtccatctggcccctggacacacag

SEQ ID NO: 6302 - DNA, 1252 bp, Homo sapiens
ttcacatagtggtcatttttgcagtgagaacatttaacatccaccctcttaatatttttcaagatctttagattttctagcatgggctaggtagccaggtctctgctgagctcagacttgcattacctgcaggagactttggaggaaatggcagctgccccttactgagtgtctgctgagtgccaggcggtgctcaggagtcttatttatgagccctgtagatctgtagtagcatcttctcattacagaggaagaagctggaggccaggaggctgagcaaatagccctggctcacagtgcccctcagtgacagagccaggattggaagccaggtcccattccccgcccatgttccttgtgctttgccctctgcctttcatcaggttcacatgtgcaggaggaacttggctctgtctaatgtgtatgtgtgtttcagattattctgactccactgaagtcaaatttgaagagcttaaaaatgtcaaactagaagaggaggatgaggaggaagaacaagcagcagctgccttggatctttctgtgaatcctgcgtctgtagggggacgccttgtcttctcaggctccaaaaagaaatcatcttctagcctgggctctggctcttcacgggattctatctcttctgattcagaaactagtgagcctctctcctgccgagcccaagggcaaacgggagttctcactgtgcacagttatgccaaaggggatggcagggtcactgtgggagagccatgcacgaggaagaaaggaagcgccgctagaagtttcagtgagcgggagctggcagaggtatgggctccaggcagtggtgtggggtggggagctgccctggaggacaccctgtcgggaggggatctgtgtgggggagggaggtggatctgtgtgatggaggtgctgcaggagggcaggagagaccctcagtcagtgcctctagccagcagtggttgtgtcaaacaaaagcctggggtggcattcactctcccagcttgttctttgctgggagttgcttttctgttatccctgtggctactgattccaagaattgcatcaatgcagcctgagtcacagcagcagatcctcctcagcccacttggatcacaatgccttttttttttttcttgagatagagtctctgctctgttgcctagctagagtgcagtggcatgatcttggctcactgcaacctctgccttccaggttcaagcagttctcctgcctcagcctctcgagtagc

SEQ ID NO: 6303 - DNA, 1172 bp, Homo sapiens
ggctctcaagatatcagcaggaccccaggcccaggaaacactgcagagcgctgagctctccctgctcagccccccagtcagggagagggagcagccttgcaggaccaagtcacgcctctgttctgggctctggcaggatccagagtggccagcacctgctcagtcctgtgctgtcctgcaggcgctgcaccagctctactatgatcccaacattgagaataagaacctggctcagaagtggctgatgcaggcccaggtctccccacaggcctggcacttcagctggcagctactgcagcccgacaaggtaccagagatccagtactttggggccagtgctcttcacatcaagatctctcgctactggagtgacatccccactgaccagtatgaaagcctaaaggcacagctcttcacccagatcacccgctttgccagtggctccaagattgtactgactcggctgtgcgtggcactggcctcactggctctcagcatgatgcctgacgcttggccatgtgctgtggcagatatggtacgactcttccaggctgaggactcaccagtggatgggcagggccgctgcctagccctgttagagctgctgacagtgctgcctgaggagttccagaccagtcgcctaccccagtaccgcaaaggcctggtgcggaccagcctggcggtggaatgtggggctgtcttcccgctgctggagcagctgctacagcagcccagctcacccagctgtgtgcgtcagaaggtgctcaagtgtttctccagctgggtgcagctggaggtgccgctgcaggactgtgaggcgctcattcaggctgcctttgctgctctgcaggactcggagctcttcgacagcagtgtggaggccattgtgaatgccatctcacagcctgatgcccagaggtgagctagtacccactcacccagaagacaacctctttggccagccacacatccatccatccatctgttcaataaacattaattgaatgtgtactgatacctggtcctatgctggagatacagcaaggaaccaaagaagacatggtccctgtcctcatggttcagacagggaggcagacattaaacaactaattatcagttattcaattaaaatatttgactctcttttccttctctcaactagtcaccaagtc

SEQ ID NO: 6304 - DNA, 1201 bp, Homo sapiens
tgagggagctcctgctttgccaggctccaacctcaacactacctccttctcttccagaggctttggctactctcctgcgcccacggtacctggacctgctagtctccagcccagcttttccccaaccagtgggttccctgagtccagagcctatgcccctagagcgttttgggcgccgcttcccccttgccccagggaggcgtctagaagagtatggtgccttctatgtagggggctctaaggccagccctgacccagaccttgacccagacctgagtcggctgctcttggggtgggcaccaggtcaacccttctcctcctgctgtccagatacagggaagactcaggatgagggtgcccgggctggacggctaagggcacgaagacgatatctggtagagagggccagagatgcccgcgtggtagggctgctggcaggcacactgggtgtagcccaacaccgtgaggcactggcccacttgcggaacctgactcaggctgctggcaagcgtagctatgtgttggccctggggcggcccacccctgccaagcttgccaacttccctgaggtggatgtctttgtgctattagcctgtcctctgggtgctctagccccccagctttctggtagcttcttccagcctatactggcaccatgtgagctggaagctgcctgcaaccctgcctggccacctccaggcctggctccccacctcacacattatgcggacttattgcctggtgagtagtgggggcattgcctaagctggaaacctggggcacggagtcagggggtgagtatggattttctttcctcctccctttcaggctctcccttccacgtggctctcccaccacctgagtcagagctgtgggaaaccccagacgtgtcactcattactggagatctccgacccccacctgcctggaagtcatcaaatgatcatggaagcttggctctgaccccacggccccagctggagctggctgagagcagtcctgcaggtaaatgtacaagtctccactcccagctgagctttttctccagatgcagcgcactcagactgagccccctccctctacagcctcattccttagttcccggagctggcaagggctggagccccgcctgggtcagacgccagtgacagaagctgtgagtggaagacgagggattgccatcgcctatgaggatgaggga

SEQ ID NO: 6305 - DNA, 3228 bp, Homo sapiens
cgggcttgcgggtggcgaccctgcctgcgcaggtgcttggtctgggaggtggttttagcgagggaatggcagaaaatggaggcctaagcagaggaatctgtctacacagctgtactgtcacctgggggcagcctgaggacgccccttcagggaggtggcccttcagctcggcagctactttaggttgaagaacttctctctaccgagcagcccgtaaccccctttttctccctcactgctgcaggagtctgctacaccatttttgatttgggcttccgctttgatgtggcatggtaagggagggcagggggaggattccccttgaagcttcttccctgcagcctctcttcttttctctggtctgagtccctcccccacaccactgcctgcctgggacatggacctttgggaaatacgcggtcagttgttgcctgtagaactggtggtggggttgaagggggtttgaggggttaagattttgtgctccgcttccctgctagagctgaactgctttcttctctgcttccacaacaggttcctgacggagacttcgcccttcatgtggtccaacctgggcattggcctagctatctccctgtctgtggttggggcagcctggtgagtattggggtggtgggactgggggcaggggctgagtcatggcaggtggtgtcactggggtcttaggcatgctgagggcagtgacagcttgggctctgctcatcagttttttatccttccaccaggggcatctatattaccggctcctccatcattggtggaggagtgaaggcccccaggatcaagaccaagaacctggtcaggtaagtgtcagggtccttggacttttgtcagaaccagctgtgttggcgctgcctgtgtgtttgatctgacatactgtttctgacaagccaccttgtgggatgggatgttataggggaaagattgctggggacttactgggcaggaaggacggtttctttctcatttctttctcctttccactccttacccctaatctctaccactaccagcatcatcttctgtgaggctgtggccatctacggcatcatcatggcaattgtcattagcaacatggctgaggtatggaaggccagggtggtggcgggaatccattccagtgtgttctacacattccttagagattggatggggtgcatcaggatggtttctgattacttttcttcttccctcagcctttcagtgccacagaccccaaggccatcggccatcggaactaccatgcaggtgggtggatgggcgtatgaatgcaaaatgctgggacttcatgcctgcttccactctcccccatcccagcttgggccatcattttgatattctctcacctactttttctgctttgcagagtggggatggtgattggccccattagcccatatctcccccattcctggcttagcctcactgcacccctctctatcctcccaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcaggtgatgaatccccttgggaagcctctgtgtccttgtccccaacctagccttaccctccttctggagaagctgaagtgctctccttctctacctataactatagattcccccaaacagcttccacctcctcatttccatcttctggttttctcctacaggggctctctatttttgtctctgatttggtgtcactgacaacagccctgttctttttcccccctttctaatgcgttgtatctgtatagcacttagtcctccctctttctgttctctcattttatctgccatgcttttcatgtctccagtctgtatttgtgatctagactagaatggaattttgtctgtctatatcagtctgtcatggtgtgtttgactgtctctcggagctatgtgtatctccctctcacatgcctgtcagtaggacaccattgtctaaattgtgtgtgtctagtctgtctgacagtgtgtgagtttgtgactaaggatcagcctgagggtctgagtgtgactgtgggtgcttgactgagttgattcttagtgactagctttatccatatgccacttctctccgtctgtcccacagcgtaactctgtggttgtctgtccctgtctgccttgtctgtcacagtgtgtccatcctggttagtcatatatctcttgtggtctgtccatccaaccatgtgctagatgtcatcttctatcatttgtcactgccttacctattcctctgtccctgcctgatttctcctgttctttttttgcagacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtcccccacctccaccctcaacccatcttcctagtgtttgtgaaataaacttggtatttgtctgggtcagtgcagcttctgttgccctcttgcgtcaccgttcacagaggaagggtaaagaggcctgtacgcctcagcctcatgccaatcccttgtcagctttctgactgcacacttctgatctgcacagagcttgctcctaggtggggaggcacgggtgctgggtggactctaacccccaaacagacttgtttggggatgagggagtgtgcagataggggcccctgggtgtgtttgtgcctgtagtccttctaggcccgtttgctcagggctctgactgaccaccatgcccgaattgtctgacagcatctacttacctggttgtacagtcgggcaccatcatctccgtccttgtgaggcctggagcctaggcagtggtctctgcctccagtgatggtcctgtccttctagcagcagcccctcccagaaacctctactctgatccttgttcccagggcccagggcagctcctcccaccccatccaatctcgttttct

SEQ ID NO: 6306 - DNA, 1151 bp, Homo sapiens
gagagcctggaggagccatgcagcgagggggctggtagatccccagagactgctctggagagtggcaaaagggcaggtgcttgttggtcacaggcccagggttgacctgctcctccccctacccagcatggtgaggacaccttcaaccgggccaagctgcttaacgtgggcttcctagaggcgctgaaggaggatgccgcctatgactgcttcatcttcagcgatgtggacctggtccccatggatgaccgcaacctataccgctgcggcgaccaaccccgccactttgccattgccatggacaagtttggcttccggtgagggctctcttctcagctggacccagccctcctgcccccaccagacgcaggcccacttccagcccccgagccccgcttgctcctggctgtggcccagaccccactggcgaggctggatcctccctggaccccattggacattccccccgacctggtctctggtccttcccctggagtccccttgggacccttactgacacctgccttcccatgccacaggcttccctatgctggctactttggaggtgtgtcaggcctgagtaaggctcagtttctgagaatcaatggcttccccaatgagtactggggctggggtggcgaggatgatgacatcttcaaccggtgagtaagcacgcggtggggaataggctgggtgggggggggagggggggtgcagactgggtggggttctttgcccttcctggagcctgttccagtctgtccgtccccatcctcaggatctccctgactgggatgaagatctcacgcccagacatccgaatcggccgctaccgcatgatcaagcacgaccgcgacaagcataacgaacctaaccctcagaggtgaccccagcaccctcaccccttactccccagaggcaacttcccaatatccccaactcttgaccccaagtggcccaatccctgatcccccagtgggggacctccaagcatccttgactccaaaaaggtgactcccagtgccactgattccctgatgtgatccaaggcccctcaggactgctggcacccctgatcgttgtcccccaacccccagcccagcctcagcccaatatctctgacctctggcctgattcctagaggtgaccag

SEQ ID NO: 6307 - DNA, 3011 bp, Homo sapiens
accacgagagatttgctttgagaacataaattcctctaggcgctgggagagtggaatagagatgaggggcctggaggcagaaaggctgtctggaaaaagttagtggtggaattggtggaagacatctgagagcctggactcatggtggtgaggagagatgccggagatactaggagagatgacagatttgggtggttgggaagactgcgaaggagtggttgaaaatggttccctggtatctggtgtagaaattcatccgaatgggaatggaggaatagagagggtgaggagtttagttctggaatgtggaatttgcagattcaggttatcagagaaagggggcaggcagggatgcctaggggacatttatgtatttggttctggaattcaagggaggcgtaggctggaggtacagatgagagatgccagcctgctacccaaccatgccttcctttttacagaatcaccgaagattcagctgtgaccacgtttgaggctctgaaggctcgggtcagagaacttgaacggcagctatctcgtggggaccgttacaaatgcctcatctgcatggtgagtagaaaagaacctaggggtgcccttggtcaggcttccacgccctctgggggagttggagagggtgggcctacctcagagtgaccccttctctgccccctcctccctaggactcgtactcgatgcccctaacgtccatccagtgttggcacgtgcactgcgaggagtgctggctgcggaccctggtgaggtggcatgggggtcggggaatgggaggccgctccgggcactgcccagatgtctgtgcttatgcctgagcctgcctgggggaagtggggagcatggcgcaaaggagaacagagccaggagccaggatatttacccgcaggatatttacccccaggctcgctgcctctcctccccaactgcaggtttaggaacttctccccctccatgagttcactgcattctcccttccccgccccggtccccgaaggcccactgcatcacacagactggtgaggcctggggtcaggaggaggctggctgtaggtaaacaggaccagggccttggcccctccccctcccattactaagctccttctgctcctgcccctgttcttcgctcaggagcagccattaaaatgtcgcccggagacagtaataaaaggctcggacgtgggctctgtgtcctgatcaaaggccgcgtgtaatctcgttagggctgcggctgccacagctggacccagccttgttctcattactggggctcctgctgcggggctggccaggcggtttgatcctggcgtccccccaacacaggagcgtgcctgcctgctcacagaagctgcctatgcgtccccagcctgggctgacaggaccaaggtctcagcacacactggtgcagagagacatggctgcaggcccaggtgctcacatgcgcacacatggctcattgtgtagaccagagccctccctgttctccctgcagggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagttgctgcctgtgtgttatgtgtgtggggtggtgggggagctaactaggggaggtgggctgaggcagttaaggggttaattcctggtggcaggatgggggaaaggacttagctataggtgtatgacactgtgcagggttggtctgctctggggccgtggagcatttggtttggaggggggtggggctggggatctgggctcctgactattgatgggtaggggctctaggttaattctttatcgatgcagaatcgtcagctcattaatcacagaagaggtcagagcttgggggtacagaggggatgcaagctctatcccccaacctaggctaggagtggccacaagcttgggtacaaacacaagccccaggcctctatccctttctggtcccctgaaacataccagagaccacagtgggatcaccctatcagcctcccaggcttttgttctattctccaaatgtatctctagtgaccatcatcccagtgta

SEQ ID NO: 6308 - DNA, 1357 bp, Homo sapiens
acatagcgaaacccccatctctactaaaaatacaaaaattagctgggtgtggtggcacgggcctgtaatcccagctacttgggaagctggggcaggaggatcacatgaacctgggaggcagaggttgcagtgagctgagatcatgccactgcactccagcctgggcaacagagtgaaacttcgtctcaaaaaaaaaaaaaaaaaaacaaactgcacagaattttaggttttagaaaactttgcttgcccaagctaggttctgcatgcacactacctgtgatatcagtttggtgaatgaaatcaataacctggttgaggagacaaaaagacgtttctgaatcaccaactaaccaactaacagaagacaacttgtgatgaatggcacagatgagcattgctagagcagctcagaggtggaaacttgctgagaatgggctgggcttagagggtggagtgtgaaggcttagctgaagcagcaagatggcacacatggggaccatgaagaagctggccacgagcagtgcagggcccaggatgcttggcagccgcaaaacagctgaaaaaggagacaaaggtcttcatgtctggcactgagctggttaggttttcttctgtaggcagtggggaaccttggaaggattttgaggagagcactgtgactaagacatttctgttctagtggcattgtggtgtagtgaaaaggtcactgggctaggagtatgaaaacctggattctagtctggctctgccactgctttgtgttctcaggcatgtttctgcccctcttcgaagtttagtttcctcatctataaagtgaggatgataataatgtctacctcacagggttgttgtgaggatttactcagcacattttttggactgcttccaaaatgctagacacttattgggtgctagggatacagaggtgaaggagacagactcttggactctcttccatggagcttaataaaataatacatgtagctgggcacagtacctgtaatctcagcactttgggaggctgaggcaggaggacctcttgaggccaggagtttgagtccatcctgggcaaatacagcaagacctcatctctactaaaaataaaaaacaattagccagtcatagtggcttgcgcctgtggtcccagctactccagaggctaaggcaggaggattgcttgagcccaggagttcagggctacagtgagccactacactccagcctgggtgacagagtgagaccctgtctcaaaaacaaataaataaaaaagataaaacatgtaaaaagcttgcttagcatagtacgtatagtagagatatttaggtggtatatttgagaaataaaaggattgaatact

SEQ ID NO: 6309 - DNA, 1188 bp, Homo sapiens
agccgcacccacatctcatcctaaacgaccgcagcagcctctgaaactagtctaaacacgcccagatctgccgacgccgcagacccccttcccccagcccagggtcggaggcgagtcgccgggggtcggcagaggtcagcagcctgcgagaccctcctaggctcgtggccctaggcgcggcagctgacacgtaagtctcgtcgcccgacgttgtttcggcgctcagaaacaacgtaaagtaaaggggcggggcagcgttttacaaaccgaaccgtgaatctttgcggtttctctttccagccagcgccgagcgatgggtgagtgtcgctctgcattgaggcgggtgaagggaggttgagctcaatcaggccccatcctgcttcacagcctactgaggagtccagacgccccgacccccggccagggacagccacgaggagtggtggccctcgggtttcggccgcccagcccgtctctgggggctgcgaaggctctgggctccgggttccgggccgcgggctgcgggctccgagcggcgccaacatggctgccgcgaggaggaggccccggcctggccgcacgtgtatgatgacaactcggtaatgctgcatactcccgagtgcgcggtggggaagccaaccttggagagctgagcgtgcgaccggcccggcgcgggggtctccgggagctggcgagtcgctagcaccgagtcacagtggctcaagcttccttccccgcttccacatgcaggcatctctcgggacaactggcacaagcgccgcaaaaccgggggcaagagaaagccctaccacaagaagcggaagtatgagttggggcgcccagctgccaacaccaaggtgggtgcgagcgtgggcctgtccgcctgggaggtcgccttcccccgctctccagcgtgctcgggtctttccgtgtgacagttgtgcgttctttcttgggctctgatttctctgtagtagggcctgggtgtcctgtccccctttagctgttggataagtaagtaccaaagagggaatgctccctcaggcccccaaacctggagcttaggatttcagagagaaggatactgtgtggggacttgagcttctggagagggtggcgcctcgcgtcatagtcagaagcctagtcttgttttttttacagaggcttaattttcagcatttggggtca

SEQ ID NO: 6310 - DNA, 1188 bp, Homo sapiens; identical to SEQ ID NO: 6309

SEQ ID NO: 6311 - DNA, 1200 bp, Homo sapiens
ggtgggaggatcacttgagcccaggagttcgagaccagcctgggcaacatagggagaccctgtctctacaaaaaatacaaacattaactgggcatggtggcacacacctgtagttccagctacttgagaggattgcttgagccgggaggtcaaggctgcggtgagctgtgattgcaccactgcactccagcctgggtgacaaagcgagaccctgtctcaaaaaaaagagacaagttgttttttcatgtatcaatcttgatattctccctcctctgtcctatttcctcccctgtcacctgcagtctttccttcagttccttctcatttttctgtcacttcatttctctaccagcaactattgaaaaataactccacatctgtacctactgtgtgccatgcaatttcctaagtactttgcctgcatttattctaattctaccaaggtagtcactgtttctgtttgacagatgaggagctggagacccagagagaataactaatgagcccaaggcacagactaagcattatcgactcttcctttctgcaccacaatgcatcccagttcacctgtccatatctatctttgtcaactaaggtttatctttttctctgccccattttctcccctgaggagtctttattctctttgatgctccattttaaattatccgtgtttctttctcttgctttcttatcagatctctctgggttccttcctcctcccatgcctccttcctctcagcaaacccacttactatggagagcttatctctgtcctcttcttcccttccatgcggcagccttcggcctaatcttggtgaaataaacactgcagtacaggcctggcaaaagagtggggagtaggggagagtcggagaaggagaggctgggcacggtggctcacacctgtaatcccagcactttgtgaggccgaggctggcagatcacctgaggtcagcagttcaagatcagcctggcgaacagggtgaaaccccatctctactactaataatataaaaattagccaggcgtagtggcaggcacctgtaatcccaactactcgggaggctgaggcaggagaatcgcttgaacccgggaggcagaggttgcagtgagccgagattgcaccattgcactccagcctgggcaataagagcgaaactcagtctcaaaaaaaaaaaaaagggaaggaactggcag

SEQ ID NO: 6312 - DNA, 1248 bp, Homo sapiens
ccacgctgatgaagacagcagaacacggaggccccgcgttcccgccgcgagagcaggagagaaagattacctcccgcgagctctagcgcgcccggctttccggcgcactccagggggcgtggctcgggtccacccgggctgcgagccggcagcacaggccaataggcaattagcgcgcgccaggctgccttccccgcgccggacccgggacgtctgaacggaagttcgacccatcggcgacccgacggcgagaccccgccccatccccgactgcctgaaccgcgccaggagacggaccgcaagtccagcgtacccacagacgactcaggcgggagacgagcggtgtcatggccgccgacagtgacgatggcgcagtttcagctcccgcagcttccgacggtgagcggcttcccagaggtagccttcaaagcctctgcgctctgggagaggggaaggcctcgggctcatagttctagaggctcctcaagcttcagaggactgctccttccgcctgaactagccacgaggagactacaagttccgttgtacaccgcggctccggctgcaaaagcctggagcgttgggagcatggggctgatggaggcatggcgggagatgtagtctggagctcataacggttagtagtaatagttgtgattcagttcagtggagtggattgagcgttgtgatccaaaggaaggtaggacgtattgggagctctggtgtggggcactgccaggctctggggcttactgggagctgttgcttgtggcgctggggcaccatgagaacagtagtatggatccctgtgggatattaagggagctgagatcctcaagccctacaaaatgtttcctgcaggacatgggaaaaaagaatcaaaggtcgtctagtccaactttctcctctacagattgtgaaagcgaggtgggaagtaatttacccaggctcatacaagccagtagaagactcaggcttcctctccccaaattcagggcattctccactccaaggcctgtgtgtagaacacgtgggttacaaaggcttgtgggaaaagctaccaatggaaactaccccccttaccaccatcaccgtggcctagcttggtgtctgttcccctgggctctttccttaagcatgaacatccatcaccctcctaacccccaggtggtgtcagcaaaagcacaacatctggggaggagctagtagtccaggttcccgtagtggatgtgcaaagcaacaacttca

SEQ ID NO: 6313 - DNA, 1173 bp, Homo sapiens
ccctaagggaggaaattcggatgtggggccttctcctcttagggttgtgattgccaggatcccaggtccagaaacaaatgggaggggaaggagatgatgcagaaagtactggcctttttaagagctgtggcttggcatactgcttcccctctctgagtctgtttcttcattggtaaaacagggccatggtatcagctttgctttcatgagtgaaaacattctgtggtaaaatgctgcttgtatttgttatgactagtgagagtaacccagacttgattattcttcaggactcttggagaaagcacctggggtgaagcgactaagctcactggatgacaagatcccccacaagtcaccatgcccaagacgtaccatctggctgtctcgaagccagtcagatatcttttcccgtaagcccccacgtacagtgagtgtcttggacccatactaccggccacgagatggtgctgcccgcacccccaaagtcaacccttttagtgctcgccaggacctcatggggggcaagatcaagttttttgacctgcccagcaagtctgtcatctctctggtatttgacctggatgcaccagggcccggaactatgcccctggctgactggcaggagcccctggccccacctattcgccggtggcgttccttgcctggttcgcctgagttcttgcatcaagaggcttgtccatttgtgggccgggaagaatcgctatctgatgggcccccaccacgcctaagtagtctcaagtacagagttaaagagatcccaccattccgggcatctgccctaccagctgctcaagcccatgaggctatggactgctccattctccaggaagaaaatggttttgggtccaggccccaggggaccagtccatgccctgcgggtgcttctgaggagatggaggtagaagaaaggccagcaggctcaactccagccaccttctccacctcaggcataggcctgcaaacccagggaaagcaggatgggtgagggggtttagtccctgcctcaccttggggatggaccttcagctgaaaccatatggccccctaggtgcacagccttgattcttccctggagcctacagagcaggcaggctaggccaagccaggctcaacttctgggctcccagtgcccattggctgtgtatgacggga

SEQ ID NO: 6314 - DNA, 1099 bp, Homo sapiens
ttaaaccatgcttgttccattactatggttcatcacgggagaagtgcaaaggctgtgacttcttattggtgtcttatctctacagcagaggagtactgcaattcagctttctctgggtattgttaagcattggcattaggccatgcttataagtgcatccttgcttttgctatctttggagaacttggtgtttatgttaattttagccactcagaaaagatcaaaattagactgaacagtgtttactctgtattggtagctatgacatggaggcaggagaataaagtatgggattggaagtttttttcattcaggtattcctaatgcaccaggttctaaaagtagcttctaggagacatctgtattgagcatcttggcagttagtggttattgtgtcagccatcaacttgcttctttttgtataggaaaatataaagcaaggaagtctgtgtcaaatgctaaccatgactccgattttccccccaggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatggtaaatctcttggtctatttggcatgtgaacttttttttttttttttttttttttgagatggagtcttgctttgtcgcccaggctggagtgcagtggtgtgatctccgctcacttcaagctctgcctcccagtttcacgccattctcctgcctcagcctcctgagtagctgggactacaggcgcctgccaccatacctggctaattttttgtattttcagtagagacggtgtttcaccgtgttagtcaggatgttcttgatctcctgacctcgtgatctgcccacctcagcctcccaaagtgctgggattacaggtgtgagccactgcacctggctggcatgtgaacttttaaaacagcaactgggaagctttggcaatagactttcaagtattgccttctcattgaagggagtgcaaagtctgactttctcttattgctctcatgacctggcagcaga

SEQ ID NO: 6315 - DNA, 2782 bp, Homo sapiens
aggctggtctcgaactcctgacctcaggggatctgcccacctcagcctcccaaagtgctgggattacaggcgtgagccaccgcgcccagttcatcttccatcttttcacctccactgcatagatgtgcctgttatatttctgagcccccttcccccagcattgaccttggggtggtgacagtagaaggctgaaaccaacatagctgaaacctctgcttctctcacctggcaggtaaaagcagctgttaagtatgcccttagcgtaggctaccgccacattgattgtgctgctatctacggcaatgagcctgagattggggaggccctgaaggaggacgtgggaccaggcaaggtaaggactggggttgtaaatagaggtgggataagagaacttagaagctgaagctagggctggggcccagctggagggaatctggcatcagcttccttccagttcctctcccagagttgagggtgggtgagaccacgtgctcatggctcttctcactgtgggccctgccccctgcactaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagtgagccttgccagagcctcatctggggaatcagggggttgagcaggatggtgttagtaacttattgtaagtcacagcagcagagcaggataggaacactcatttgcatgccaagctgaggagcttgacatgggatcttagcctcttctgctacagcagcttagctgtagctacaggagtttaactctggaaaaaggaaggcagtctcacatggtgtgtaccccagggtatgcacctgtaaccctcctgctccctttattcatttagaaaaggtgctgacttttctgttgagcacctggggttacagtaataagtaagtctcagcagaagatgtgagaagagctcaccattagtgccgtgccctgtgctggaagaagggtggataactccctgaggatgagttaaggaagacttcctaggggagaggagatatctacgtctaggaagaggagggggcataggcattccatgtaaacttaacacctgggttacgatctggaaggatgaaaaagcatggctttttttggccaggcgcggtggctcacgcctgtaatcccagcactttgggaggctaaggcgggcggatcacgaggtcaggagatcgagatcatcctggctaacacggtgaaaccccgtctctactaaaaatacaaaaaattagctgcgcgtggtggtgagcgcctgtagtcccagctactggggaggctgaggcaggagaatggcgtgaacccaggaggtggagcttgcagtgagctgagatagtgccactgcactccagcctgggcggtaaagcgagactccatctcaaaaaaaaaaaaaaagaaaaagcatggctttttaaaaattcttggccctttgtcctctctgggattggagtttgggacatagagtggctggatgggcaggtagggtagaagcctggcatttgtgtccacacttggtggggctgtctctcactcaggcggggagacaaccccttccccaagaatgctgatgggactatatgctacgactccacccactacaaggagacttggaaggctctggaggcactggtggctaaggggctggtgcaggcgctgggcctgtccaacttcaacagtcggcagattgatgacatactcagtgtggcctccgtgcgtccagctgtcttgcaggtaaggacagcaagcagatgagtggtttaggggttgtctgctcaagagcatgagggagcagacgatggatctgcttaagggagatagctagcaagttgtcagagtgttggtgcagaagtcctctgcataaaggtgggcattgaagcagtgggagagaatgaaattgccgatgggaaatggtgagaaaagcaggctgaaggggagtggaggagtcagcaatagggggtggtccagacatgcatgtctgggatgggccaagcaagctgggtgtcaccacttcatggtgatgggttattctttggctcaggtggaatgccacccatacttggctcaaaatgagctaattgcccactgccaagcacgtggcctggaggtaactgcttatagccctttgggctcctctgatcgtgcatggcgtgatcctgatgagcctgtcctgctggaggaaccagtagtcctggcattggctgaaaagtatggccgatctccagctcagatcttgctcaggtatggggcagtcttagggagagggccctgggttgggaggcaagggttaagggatttcttatttcagtgtctgggtgaggctgaggatcttgccttgtgatctggagggaggccactgtaggcatatttcccatttcagcagggctcaggtgctccaggagcttagggaagctgcatggggaacaaaatagtgcttatgaatactgaccccttttcctcatctgtctaatcccccaacttaggtggcaggtccagcggaaagtgatctgcatccccaaaagtatcactccttctcgaatccttcagaacatcaaggtacttggtaatgggttctatcttctttagctctttgggacattttcttggccctgactctacctggctaaaaaggcagtgttgtggaaccccagcttctgctcacaaagctggctttc

SEQ ID NO: 6316 - DNA, 1111 bp, Homo sapiens
ttgcagtcatagtgtaactttttttttttttttttttttgagacggagtctcgctgtgatatctccctgacattgtatttaaaaaaacctgtgtgttatagaaggttatatagggaaataaaagacctagtcccttaaccacaggtagtttgagaggctctgtgctagaccatttggtcagaatgacctcttaataaaactattcgatatacatgactggctgtgacggagtttgtagataaggatccaagaccatttcaagattctaggcaaatggcccagatagcttacaacctgtagctgaaagcactgccctttaagttgttcctcatccctgtggttatagctgtgaagttgccacttattttcagccctggatatttgagtgagtaagaattaaatgaattaaatttgataatgtaagtaagtaaataatacttgagtatttaataaatgacagctcttttattcctttatatttttctgaatttattttattttcaggcttaataattgcctccagttttacattttttcccctttaattttttattacagaattgaagatgttcctgctccttctacatctgcagataaagtggagaggtaagattatttacatggtagttagattcgtatcagaaacataaactaagagcaatataactttaaagttatttttattttttaattaatttatttttgatagaggcaaggtgtcgctttgttgctcaggccgaagtgcagtgtgcaatcagggctcactacaaccttgaactcctgggctcaagcaatcttcccacttcaacctcctgagtagctaggactataggcacatgccactacacttcgctcatttttaaattttttggagagatggggtcttgctatgttgccaaggctggtctcaaactcctagcctcaagcattcctccctgcctaagcctttcaaagtgtaggattataggtgtgaactaccaggcccgtctcacctcctccccctgtaacgtttccatcttgatatggctatggttttttgtttttctttatctcagatctacacccgtagtgactatgtttcttaatcagaggtgggcataataattaacta

SEQ ID NO: 6317 - DNA, 2852 bp, Homo sapiens
gagatggggtttctccatgttggtcaggctggtgttgaactcctgacctcaggtgatctgcctgcctccacctcccaaagtgatgggattataggcgtgagccaccgtgcctggtctctggtaagtttttaatctcgtaatcatacagaactttctcatgatttgccgtgaaaatcttgctagagtatttttggctatttagagaaatcgggtggatacaaagtttgggaaatagtatggtcctattacaaatggaatgcatataggtcttgttcttttgacaagagacatgcttttcaggcggctggatggaggaatatgcttatttccttcagtgctcttgcagtcttaatttatattactaaagttttgatcattgcttccttgaatatacatagttttgtattgcctgcgcttggcttacacttcttgcttttataatataggactgtattttctgtcttagaaaaaattgctaggttctagccatcaaacctttggtgctttcttttgttctcctagaatggagaatggtgtgttgggaaacgccttggaaggtgtgcatgtggaagaggaagaaggagaaaaaacagaagatgaatctctggtagaaaataatgataacatagatggtatgtggagttgcatgtgacattcaagagatgcgacgttgtatatttcttgtatacagtggtggaaacggggctctacctgtcctggatggtctctcctaagatgcttggggtgatgatgcctgcatctggtggagattgcagtggggatagctgtttactgaagctgacagcagatttttgaaagagaataacttattttctcaagtaaatccagttatttcgattggggttttttaaatcaaaaagataaaagcaagattaaattggtgttttaaatactattacaaccttaagtgtttttctgatgcaaatttttttaaacagcctgtgcagttcagttattttaatagcagtacttttagagcccttgtacattttttatgtgtgcgaaaattatataatttctaagctgaatttggctgctatagttttacatatcagatgggggagaatgaaaagcttggcatctcttacctaactggtaatcagaatgctcaagtaaaacaatacctagtgtaacaagcttgggtttcttttgcagtaagttgctctgctagccgggatgctccctttccttttctctagggggcagataatttttaggccatctgctgaaacttggtaggctttttgagggtttaaagggaatgtatttttagtttccatttatgcctttatcattaaactcgaagacatgtttatgcttcatgttctttaaccatgtagaggaagcaagggaagagttgagagaacaggtttatgacgccatgggagaaaaagaagaagccaaaaaaacagaagacaagtctttggcaaagcctgaaactgataaagaacaggacagtgaaatggagaagggtggaagagaagatatggatataagtaaatctgcagaggagccacaggaaaaagttgacttgactctagattggttaactgaaacctctgaagaggcaaaaggaggagcagcaccagaaggaccgaatgaagctgaggtcacttctgggaagccagaacaggaagtaccagatgctgaggaagaaaaatcagtttctggaactgatgtccaagaagagtgcagagaaaaaggaggtcaggagaagcagggagaggtaattgtgagcatagaggagaagccaaaagaagtttcagaagagcagcctgtggtgactctagaaaagcagggcactgcagtggaggtagaagcagagtctttagacccgacagtcaagccagtggatgtgggtggggacgagccagaggagaaggtagttacctctgaaaacgaggcaggaaaggcggttcttgaacaactggtaggtcaagaagtaccacctgctgaagagtcaccagaggtgacaacagaggctgcagaggcctcagctgtagaggctggatcagaagtctctgaaaagcctgggcaggaggctccagttctccctaaggatggtgcagtcaatggaccgtcagttgtaggagatcagactcctattgaaccacagacttctatagaaagactgacagaaacaaaagatggctcaggactagaggagaaggtcagggcaaagctggttcctagtcaggaggagactaagctgtctgtagaagagtctgaggcagctggagatggggttgataccaaggtagcccagggagctactgagaaatcacctgaagacaaagttcagatagctgctaatgaagagacacaagagagagaagaacagatgaaagagggtgaaggtaaccgggatatgcaagagctgcagtgggtggagtacattctggatttgactcactaattatgggtaaaagtcagccttccattcaggattttccgtctgcctttggattaggaaagggctaaatgaaaaggggggtagtttaacaaggtcgtgatagtcaagtaagttcaatcaaaagcagcaagtcttctttagctggcttataaactaacacttttactaactgcaaaataggccttctgtgtgatttctgagacttggctagctatcagtaacttgttgcagcatactagccaataaagtgggatggaaaaggtagatgaggggtggggtaggtagggaaatagtgggctaggctggcagagaatgctgaatggatgttcacttgcatgcctctggattttaaaattattgttcacatgactccttttctgtgcgttgggaagcagctacagagcagtagaatccactg

SEQ ID NO: 6318 - DNA, 1408 bp, Homo sapiens
attcaagaaatactttgtggtcactgccctcttaatatagggagcaaagcagagtttgggtgacttgtatatgcttcctatgactgaggcctcagttatataagacagaatggcttaaactaggctcactcatgcccaggttctgtttgtcttccaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaaggttgaggctttgatggtttttttcttaattattggctgaatctgccttggagcactgctggttttatatattagccaaaggttttgttctggccttctgtactgatctgtgttcctgatcctaattcctatctgtctaacgtggaggtgatcaagtgtggctgtaggcctttgttttccaatggtgctatattctgttttcaaacacttcactgaacccagctgtcttgcaaactttcagtggtgctgtccctggatgggggctacaaaaacaagaattggtgaagatcttgctcttcagtgctgaaaatggatgatggactttggctgtgagccaggcctaggatggttcttgtcctatatccacctagtcttcacctggggctataattctgtcctggaaaaagaactctgaaaacctgggtcaggggaatgattcctaaggaaaacggtctgcatttgagctctggtttgaaagtagccaaggggactgatggtggacactccagatgtggttggaagcatatgtggggaggctggctggttgagttttgttattttctgtatagaaaggttgagatatatcaacacttggaattgttacccatctgcagaattgacttctcaaataaagatgctaaaaatctccttgtctggaattatgtttaaagatcttaagtggggtcttaggctgcttttttgagatgggatcttgctcttgtcgcccaggctggagtgcagtggcgtgatctcggctcactgcaacctctgtctcctgggttcaagagattatcctgcctcaggaggctcccaagtagccagcactacaggctaatttttgtatttttggtggagacgaggtttcaccatgttggccaggctggtctcgaactcctgacctaaagtgatctgcccactttggcctcaggaagtgttaggattacaggcgtgagccacttcacctgactgcctggagcatttctgtgtgcgatagagggtttcaaaggcagaaacgagcccaccagtccaaggatgctggtggtgagggcactagtattaatgtt

SEQ ID NO: 6319 - DNA, 1861 bp, Homo sapiens
gtgtgcgcctgtaatccaagctacttgggaggctgaggcaggagaatcgcttgaacccaggaggcggaggatgcagtgagccaagattgtgccattgcactctagcctgggtgacagagcgagattccgtctcaaaaaaataaataaataaaaagaaataaggactttcaagccccatcccagacattctgaatctgaatctgcatttttgaaagatgcgtagatgactcgtaaattaaaatttgaaaagtactggtataagagatctcagagggtctcttagaagcaccccccgccccacattctacctagaattgaattgaggcctggcctttcccagggcttatgggtcagtacagtcattgatatttttttcttttttctttctctcccatgctaaccatagctgagaagaaatggctttggaaagaatggcttcttgcagagccgcagttccagtctgttctccccttggagaagcacttgcaaagcagagtttgaggactcagacaccgaaaccagtagcagtgaaacatcagatgacgatgcctggaagtaggcatataaatgctcacagttaaatctgacccagtaaactctgtgtgtttagggagtatacaaaagaaatcgttcttttccttttcttatgttgttgaatacttcattcacaagggaaataatcatatcccaaagagagagcaattggcttgttttgcttttgttattgttcttccctgttatctgctttatagagagaagtttgtgtggtgggacagattttttaaacacactcacacacacacacacatacacacccagtatatatggggcgatgcacaggtaggagctggcagtgcagggaagaggagacactggtctgcagcaacagcttctactaccagcccttggggcactcacccctgtgatcaagcaatcattgtcaatgacaaagtgactattgaagttataattgtattaaattaatgctaataatttggatattttattttatttttggctgctcgggtaactttagcccttaaccaagcatatgtgggtttttttggttgtttttttttgttttttttttctttttcctttttgggtacagctgtaaaatatttggatataggaaatgttgtgttattcttgcagccttgatattcagggtggattgtaaaatataaatttttgtgagatttcaaagattaagattattttgataacattatttacagatttaaaagatgtggttatcacaagtctcgagggggaaactactgcataaaataactaacttggaataaatattttgcatcagtttggattgtcttgtgtaagaagtatattttctttaaaattagatgagtggattcttttttaggggaaatatttttagaagttggggggaaatgtgaattcagacacaactgtttctctattttagcagatacttttttgatgcagaaaaacctgtgcaataaattaccagtaataaagtcagaaaccaagttttttttttttcctgaaactgttttttagtgcccatgtatttaccagtgtacgtattttaagggaagtctgttctgttttcctactaaataagaacttggagtgggggttgggggagagttggacgatggtagctgaatggctagtgaaggaagcaggttttttcattcaacaaatactttttttttttttttgagacggagtctcactgtgtcacccaggctggagtgcagtagcgatctcagctcactgtaagctccgcctcccgggttcccaccattctcctgcctcagcctcctgagtagctgggactacaggcgcctgccaccacgcctggctcattttttgt

SEQ ID NO: 6320 - DNA, 1112 bp, Homo sapiens
acactattttttagcagttgcatgagtaagagtaatgagatttgtattttaaggactttgtcatgtggatgttttggagttgactgctcagatcttttatagggctttaatatttttgatctattaccttgatgacattatttgtccacacttgagcccatctgtctttctagctatgaccttgttatgaacagtatttgcactcggtgcaaatatccatgtcttacctaattaagcaacatcatagtgccataactcaaggaagttgaatgaggtgaacatagatacagctctttccccttccccccctttttaaatgtaacaaatactttttatgttccccttccccccttccccttttcccctttccccttttggaaacgtgtcaggaaccaaatagtttaagatgagcagttgaggggactgagagagtgatcgacacagaacctggcttcttcgtgcttcatcataagtcgtgctgccggccaggttacttaagcacccttttaacaaggaaaccttgtgggagatccagctggccgactcgagttcagaaacaggaccacagaggttacactctggggtaaatattctccatatgtctaacttggaaagaagactctatgtatatgcatcatgaaaaataccgactgctttctgatgtaattaattttggagaatatcagtggggtggtttgaagacaccaacagatctcaggaaaactgatgctagttggtatttgaagaaattaatgtgaactaaatataaaagctcttgagaggttgtatcgtccttctctaggaagatctttttttcccccatcttgaggcagggtctcactctgtcacccaggctggagtgcagtggtgcaatctcagctcactgcagcctcaaccttcccagctcaggtgattctcccaccttagcctccagagtagctgggaccacagacgtgtgccaccacacctggctcctttattattatttttgtacagatgaggttttgccatgttgcccagactggtctcgaactgctgggctcaagcgatccacctcggcctcccaaggtgctgggattacaggtgtgagccaccgtgcccagccaagaaga

SEQ ID NO: 6321 - DNA, 1096 bp, Homo sapiens
aatcgcttgaacctgggaggcagaggttgcggtgagctgatatcacaccactgcactctagcctgggtgacagagcaagactttgcctcaaaaaaataaataaataaaaataaccatcagatctcatgagacttattcactatcacgagaatagcatgggaaagacccacttccatgattcagttatctccctccaggtcccttcccacaacacatgggaattatgggagctgcaattcaagatgagctatgggtggggacacagccaaaccatatcaccctgtctcccacccatgccagcagcaaaggggctagaatcagagtctccagcaccaggatattccatgaagctgtctcctctgggacctcagaaactgccagatgggagctggctagctagagcagggaactgaatcctttcctcatggtagcctgggcttgttgcagggggagactgtgccactctgctgaagaatattggggccctgcctgtggacatggtgcgtctatactttgcggaaactgtgctggccctggagtacttacacaactatggcatcgtgcaccgtgacctcaagcctgacaagtatgtccacagtctgtgtcccttgtccagggtctccctcttgggtctccagataaaatgttggcaagcacagtagctctaaatctatccagatggctaccgggaaaacatgctcctgtgtgtgtccatctgggcctagttctctagccccccgaccaccccagatgcagatcattgcctcaaggtctggctggaacactataaggcttcggtgacatggaagagtcattgaggagccccactgaagaaaccaagcaagaacaaaagaataagcacatctagtagatggctaaacaagtgtcctgacgtttactgacatctactctgtgccagcactatattgtgggtttttaaatgtagtccctggcatgtagaacttaagtctacagtgggagacagaaatatatgtatataggcttcttctcagagggtattagtcaagtggaaaaaggaagacctgctttctaaagcaggagagcagaatgtgcagagtcacacaggtgcaagaga

SEQ ID NO: 6322 - DNA, 1151 bp, Homo sapiens
acagccacagcctttccccccgatctcccactcaaggctaccgggtgacccccgatgctgtgcattcaggtacgaagggctccctgcagatcagtgacaacccctgggaaataggaaagttcctaggccctgtgtgcttctgacagatcccactctgagtctctcatttagcccaccccctgaaagatcctgtagtcttggggaggaattaattgatggggaagggggtagcttggtttctgggacataacagggctaagccctgtcttgcccttgagtcacttctaacagctaacactgctctgcttttgtctgtctgtctgtctgtctctgtacaaagtgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtccc

SEQ ID NO: 6323 - DNA, 1287 bp, Homo sapiens
ggggcctgtggagattgtttcggaagaagaaccacttcctgatggtgggggtcccggcttccccctactcgtgagtgacccttttctgccctgggaaacaggaggcctagtgagatccagggatatagctaatggcttcttctctatacattcttgtattattttcccagagtgaagaagccaccctcagtcaccccaattttcctggagccacccccaaaggaggagggagccccaggagccccagaacagacatgagacctcctccaggaccctgcggggctgggtactgtgtacccccaggctggctagcccttccctccatcctgtaggattttgtagatgctggtaggggctggggctaccttgtttttaacatgagacttaattactaactccaaggggagggttcccctgctccaacaccccgttcctgagttaaaagtctatttatttacttccttgttggagaagggcaggagagtacctgggaatcattacgatccctagcagctcatcctgccctttgaataccctcactttccaggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctggggatgtcttgtgattgtgattttgtgtgtcaggggggtgctggagggaagtggtggagagaatacttgtgttggatggtgagttttccttactgtcctccacagagtttatcttccatttggggccatttggccaccaggggatgcctgagtctcaaactccaaggtttttccccaactctaccctaggacagcttgactttagccccgccctacttgaggcttggagcagccaccctacctcttccccaccgtttaaccaccagccgggttcctgcttatcttgcctgggccgggcacctgtccccagagacagagcaggagagaacaaaaagggatactggggagttggaagaggaaatgagagagcaggtgtgcatagtaggggtgggaaggaagtggatgggacaggactgggcaggcatcattcaagagacgggctag

SEQ ID NO: 6324 - DNA, 1182 bp, Homo sapiens
tggaactggtagggtgagatggattagatatccaggaagcagtgaattcctggtctatatctctgtagccccatcccttgtcttgcccctcccctcatgtacctgatgtccagctgacagagagaggaggatgaatcctctgagaaaacatctgccaaggccagcaggccagcattccctggagagaaggggagaacgcctatcacctccacccaagaacaggggacaagggtatcccaacccaactatggctggcagaaccagccctgctggttcctgaagccccagcacagaaatatctgtattccaactcccacgttcccagtggagaggtctttgcctttatccagtgagtttttaggtcaaaggcctagctcctttcccctctccctccccagggtctggcccccacccaggcggttccctggcagccggaggcccttcagtgtggagttgcccttcatagcagcaaccatctcaggcagaaattgggctgggcgcttctcaaacagacggcagaaggagaaggtaatctctgtcaagaaaaattatagtaaattctgatggctgcattaggactggtgctgcccctcctgccccagttggccctagcaaggggtattaacattatagaggcccaaaaagaggaaggaatttgtctagactccaagcaaggctggaactaaatcagaatccaaactaaagactgaacctaaatgttccctataagaaggttctctgcatggacaattctccattcacttccttctttccctaacactggccaccctctatgcgggggtggggatcagagaaaagtctatgaggggagcctggcacagtacatttattttgccccaccaccaccattttgtccacctctgaaaggtaagagcaacttttgggtgaagcactctaaaagagcgatttctcatgtttagtagaggaggaattgaggttggggcttttagaaggaaaatcatgcaggttctatatccattttatagctgaggacacaaggccaagaaaggaacagtggtttgctcactcagattatggcagaaccatagtgaagacccaggaaatgtccaggttctgaataaggaacttaccttgcagagtcagattctgtagcaaaaagagcacctcgctctgacagtcagcgagattcatgtcatggaa

SEQ ID NO: 6325 - DNA, 1289 bp, Homo sapiens
aatattaactgaaccccccgccccgcctcccatttattttcctcctagcatttcccattatcacaggttaccttatttatgtgttcattttaactcattaccctgtaagtttcttaagtggcaggcatgttttgttacagttataactcactcagcacttagaacactacctggcatataggagatgtcctgttgaattaatatgtaatgttaatgtcactgatggggaggtacaagtttttgtggaaagataggagggacagatttgtgtgtggataggggcttgtttagagaaggcttgcaggaaatgacagttatcagatctaaattctaaaggaagaataaaagatgaaaaaagtggggagttcactaggactcaagtgctgcttgcctatgtgagaaggggagtggtgagaagaggggcagtactgtttcaggtcttgaaggaccttgtaagccatgacattaaagctgccaattgattacctccttttctttcccccatctaggtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaacctgcccgtcttttttttttaattgagaatttttttttttaatttgatattttcttttagttttgagggggtggggagcggcaaggaggacagggtcttactttgttggctaggctggaatgcagtggcgcaaacagctcattgcagcctccacttcctgggctcaactgaccctctcaccgtggccccaagttgctgggactacagcatgcatcaccatgcccagctaattttaaaaatattttgggccgggcgcggtggctcacacctgtaatcccagcactttgggaggccgaggcgggtggatcacgaggtcaggggttcgagaccagcctgaccaacatggtgaaaccccgtctctactaaaaataagaatattagctgggcatggtggcgggcacctgtagttctagctactcaggaggcttaggcgggagaattgcttgaacccgggaggcagaagttgcagtgagccaagatcgcgccactgcactccaggctgggcaacagagcgagactccgtctcaaaaaataaaataaaaaatatatattttc

SEQ ID NO: 6326 - DNA, 1198 bp, Homo sapiens
tcgatctcctgacctcgtgatctgctcgcctcggcctcccaaagtgctgggattacaggcgtgagccaccacgcccggccaggtcccgaaacttaagcttcatttgtttcactgcaaatctgcttctgcctacaagcctggtctcattttcctctacctaaggatcttcctccatgcaatttcggcctaggaggcccttcccgccccttttcgcctagctaactctttcggtactcaaccaccaactcctaatcctccctggtcccccaagtgggctaggggcttcttgggagtccctcgcactgctctaagcatccaggcagagtcattattccgggtgccaggttgctctttttccagcagccttcaggggactcctggctgggcggagtctgtagaggcgcgcggagtcctgggagagcgtcagatgtatttcctttcccttttttcgctcgtgtcccgccgggtggcgctcaccacctccccggaacacgcgagtctcctgtcgcggttccggtcggaattaccccgtggagcacgccgatatggctgcgctgacactgaggggtgtccgggagctgctgaagcgtgtggacctcgcgacggtcccgcggagacatcgatataagaagaaatgggtaaggtccggctgggggcgcaggagggaaaagtgagggtggaaacttctccagtctttccgtttcccggccctctagaacgcctagcgtctttcccaagcactccacggaacgtccttaggcacctccctctctcgtcttttccgtcaccgcctctgtccgcactctatgtcccgagcgttagtgtcttccacttgttacgtctgcagtctcctgactccgcccaagttgcgtcatcaccttcgccttcattcttttagtgatgtcactgtctcttgttccccagctgtgtccacctacctttctgtcccccactcccccttttacttccctccctcccctccccctttcccttgcccattcttcccccacatgacttctcctttcctcattgattttccagcccggtcgccctcacccctcggaaaataccatagcgaccttgcctgcactcctgggtctccgccgccttgcaggaaaggattcagccccttcctcaacctcgagctgcctctggcgaccgggcaaggttacagcgaccaccctgtccatactgccgg

SEQ ID NO: 6327 - DNA, 1173 bp, Homo sapiens
ctcaagtgatccgcccgccttggcctcccaaagtgctgagattacaggtgtgagctaccgtgtctggccctattatttccattttatacataaggaaactgaagttcagaggggattgctgacttgttgaaggctgatcattatgggttacagagaagacttgaaacccacacgctcaactctaaacttactgtgacttcctcatttgtacaatcatcacaagaacatgcattcaacattcttcggacaccagcctctgtgctaggcgaccacaacactttgaagacagaagcagtcctgtgtactgtgcacctctgccaatatctgtttacaggagatagctgccatgtccctgtccaccctcccttttctctcctggcgattgcgatattggagttttaggacacagccagagcacttgtcatttgttcctgttggacaccatttttaggattatcccaagagctctggctgtttctgctcttcctcccaacatgtgcttatccacaaatctgagcactggacctctgcaacttcatccaagtcacccataaacctatggatcacagcagaccaaggaaagggcgtgacctacacccttaacagacagacacataaccgagttttgagcttcccagccagatgtatctttagttcacatttctctggctgggcttagctgggccctcccaagtttcctacacatagatttggggtggcggccctgggcacctcaggaaggtgaagccacttgggatcgggctgtgtatgctcagcacccagcatggtgcctggtactcagtgggtacccagagaaggcttgttgaatggagcaatgggtgacttgttattagggaacccattttggtccattctgattacttcctcttctcacctccaatagggaattttccaatcagtccctgaccctttgctcctttcacatttattgtatctacctccatgatcttttttttttttttttttgagatggagtcttgcactgttgcccaggctggagtgcaatggcaggatctcggcttactgcaacctctgcctcctgggttcaagcgattttcctgcctcagcctccggagtagctgggattataggcgcctgccaccacgcccagctaattttttgtatttatagtagagatggggtttcactatg

SEQ ID NO: 6328 - DNA, 1159 bp, Homo sapiens
ggcaagaaaggtgcaagaaagtgagcagtctgcctgtgagtgagcacagatgccggggtgtgtgtgtgtgtgtgtgattttcactgtggggtgtgtctgtgagagctagctgccttacccctccttggcacatagtaggccttccataaatgttggatggatggataaatagattgggaccatcagaccatgggaccatcagaccatgaccactgtaggagtgatgacagctcagcgtccccactcagtgtatctgaccatgtgtgtaagtgcacaaaaatgtggttgtagatgttgctctacattcaaaccttccaggctacactcttccatcagcatgagtcctggagagctgggggaacgtaggaagaggagccttgccttgagttcctaaaccgacccactgcagacacaggctctgattctcttacccagagatgcccatgagctgacattttactcatccctctgcctccaagaaggcctgtattatacgtgtcctcctgggggttggagatgatccctcaagtacacaaaggtcccctggcccttcatctgggaatcatatactccactctagctcccagaatctacagacctggctcctcggatctgaagcccagcacaaaataatctccccgtccaaggagcttgtggaacttgaattgggaactttggagtcttgtctcccatcccagcacattgaggatgtagttggtgaatggactcttccaggcatggagatcctccatcctaaaagtacctgcctccttcccagccatccctgacacattccagccagttggatctcacagcacagctatccacagggagactgggatgttcacgcagcactccattactcagtacctccatacccagccctatacgcagacccacaggtggggaaactgaggcaggaacagggttctgccctcccagagcctccactctgggatgccagaatggaaagccagagggaacctgagaatcatccagtcttactgtctcaatgtacatacggggaaactgaagccaggagaagaagagggagaaactgtccagggcctcacagggaggcattcatggagctggagaaaccagggatcctgaccgcagggcccatcaattgctacatagagatacacatggaaagagg

SEQ ID NO: 6329 - DNA, 1122 bp, Homo sapiens
gactccaggtatcgatgcctaaaaccctgggtgactgccacacagagaagagggcataagccaccaagatctctgccttgagcatgggggactatgcagaagcggggcctttttcatgggtcccaatatctgtgagggtcgctgcagtgcactgcaaagagggtctgaatccagtctccattctgcactgattaatacttatgtggccttgggctagcagcttcacctttataagcacttctgttttatcatatctaaagtgacaatcagacacatcaggcgaattgttctaaggattagaggcaaaaggtgtgaagggcccagcacaaggccttgctcataaatggaaggttcttcgtgttgttgaatatttgaaggaatgagggctgtctgaactaactcttgcagaattcataatttccaggattgggggtctgaggacttctgtgtgaatgttgaaaagaggagggacatggggtggggctagagagggaggtcaggataagatcatgaaaggccttgagcagcgtcctgctggaaagttaggacttaatcctgaaggcccagggattttttaaatggacccagttgttgaactctccttggagttgtatacaagagtgtgatgtgagcatctctgcaattgcacatatttctggggagagtttaggtcgtaacttttatcatagtctaaaaagggttggtcagtgacccccacaagtttgcaaagccctgctttaggtaatgggaaaatgtggaagatgatgtatattccagcaggggagagccacagtcagatttgtgcttcattagaaagaaaagtatggccaggcacagtggctcatgcctgtaatcccagcatttaggaggacgaggcaggtggatcacctgaggtcaggagttcaagaccagcctgaccaacatggagaaaccctgtctctactaaaaatacaaaattagctgggcatgatggcacatgtctgtaatcccagctacttgggaggctgaggcaggagaataccttgaacctgggaggtggaggttgcagtgagccgagatcatgccattgcacttgcctgggcaagagtgaaactccgtctcaaaaaggaaagaaaaaaagaa

SEQ ID NO: 6330 - DNA, 1133 bp, Homo sapiens
aattgcttaaactatctaattttggggttttttttccatctaaaatagggataataatatctacctcataggattattgtgagaattaaattaacttcactatagtagaaaatatcaactaccatccttttctctacttcccttgcccctcattaaagactaatacaagttagcatttcagatgtgtagatcattctttattccagttaaaagaacaaactttatctcatcagttctgaaactttaagatgcagtagcatcacctaaagtgcttttaaaatgcagattctcaggcctcaaccgtacaccacccccccacacacgtactaaatcaagaatatgtgcagaaggtactgggaatctacttgttaatatgtgctccaaatgattctgatgtaggtaattagccagccacactttgagaaccactgccttatctattctttacaaaaatgtacattgccaggtctttctttcctgtggatgctaactataggatatttaggttcctctgttctttgtctcccatagtggccccctttgcaaactccaaatacattatatttatttattcttgtgtcttttttcccccactagactgtgagctccttgagggccaggacttatctctgttcgcagtgccaaggacatggcctggaccatagaagatactcagttttttgttgaataaataggtaatatggatttcaaccaaaacattgtcttgtgtatgtacctgcatgtaaatactctagatttaaaagaatctcttaatacacatagatcgagaatttgttgagtagaaatatttgcaaaccaagataccaagttatacacagttctctgtacctcacctaatccactggcattaccttggtggaccattacacagtacaacttaacagctgctcacagagcatctattctgcagccactatgttaagtgctggacacagaaagatgagtagagtatgattcctgctcgcaggctctgttttagccactgcctgtttctctcttgcctctgattcagtgcctcacacctacacctgattatagtttgctttgtctagttcttggatgttcatactggtacttctttcttctccaaccagtttggaagctggagccac

SEQ ID NO: 6331 - DNA, 2957 bp, Homo sapiens
gagatggaagatactcattcctggagctaagggtagctttaggtatctagcttcatcaggcatattttagaaatggactgcctaatatctatttacctaacaacaaaacaacccttacttacccatcagtcctctagtcctccaaactactgtagcagatactttgccaccttttaacttgtttgaagaagctatataaaagttatttttttaaagaagaagaccattttacttatgatgttcagaaatctatgatttcctacaaccagtaagatcttacattttaaaattgccagaaaaaaaattaaagccctctttttttctctttcctttttttgaggggaggagaccttatcttttaaagctgggaaatgtatatagagagagaataagccacttttatatttcacttaaatttgccttaaattagctgcactttatagagactcagaaaatgtcttttctttaaaagataggccttttctgtttgtaaatatttaaatgaaagaaagcattgtgcatattgtgtggaaagtaggaagaatggttttgaacaggatatgaacaaatgacttattaaaaattgctgatctggtgtaggtggcagctgaaactacatccatgtctccataaggtatccctcaaaggcccaggcgctgccagggggtttgtcctggtagctggaggaaccgatttcagggagtagacactggagacaatactgactccaggcatggctcatggaagtaggattctggttctttgttcctattccctcagctaatcccaacctgggaatcagagaagtcttggggatttttctcatttttagtactatttcagggtttatgagcataaaaagttatccattggggagctccattttccctgctgagtgagctagattgccttccccacccacccacttaagtctgtcttaaagccgtagctggctcccaccaccagtaccatctccatttgaatggcagggctaaattcccccagccattatctcacactgaccacccagagctttagaagagagctgtgcttctaattttgacccagaaaaccataccccttgagattttacctagaggctaaccaagagcctaatatgtttctctgggggatgactaaagccaaaaaggctgtgagatgaaacatgtgaaataatattcagtttccttaccattaccagctcagaagtagctagaggctttctacccaaaggatgccaaagtatagcagggcaggcctggagctagggccttcacatggtggtagcaagtttttcaaatctaatacaatcaagtacaatacttcctttaaatgcttctgtggacctggcatgaaagatccctagattgaaaggaataatacctccatgtctcctgtatgttgagtctagaattgctgtgttgttcttagaagcagtctttgggcaacaacttgaaaggggaaaaaaaaactacaaaaacttaactttggtataggccaagtcagggagaaagtagagaaagctgtcatgccacagacttctttagtggagatcatttcctttttaactttgttcaggttgcccttcaccatggatacagtccggtacccttaaacatttaagggctgttttttttttctttacatgatgttcagcttggtattaaccaaacttaaattttttttccagaagtattaaaatttagttaaagcaagatgaagtcttttcccatgaatgtgtccccttatctcattatagcttatgctcagtttcactttcttggaaaggttaaaacaaattagcctggcactttaggtaacttgaaaataactctcacccttctgactgccttccatccactctcaccccacacctttttttaatatatatacacccttacagattttctaacaaccaaataaaattctagcaataaattgaattatactgctatatttgtatatactgtaccataaatagtatgtctgtacctggaaggtatttttttgagaactgatttatatgaaatatacttgagggtaatgtagcttgtcctttttagtttcaaattcttattcataggcagatactttgaagacaccttaactctttgttgtgtgtattttcccttgcatcagataactatacatggagaaatccattttgttttttggtttatcttctgttcttcctaccttgtgcttgtctgactagtatcacccctgagccagtatacagtaccatcctctccccctaccaagtttggcagaggtgtttatactgcattctcagatctatgaatatttttgtcatcctgcctgagaaagtacatcttccaggcaaaagtagggtatcttgaactcctttcttctgagttgagcagactcactggcttaagcatcccataagcctattatttagtgtgaatttgggacttttatttgtatgttgtcttaacttactaagcctgtgacttgtatttagctgtagtcaagcctcaccagccatatctcatctctgagaggaagactggatagtgagtttggttttggttttggttttaaacccttttaccttttcagtctggcagctcctactgctgctttcctaagttactcaaagcactgcttcttggtccttgttttcttttgccttgtactatcttgtataatgtttactaaaagagcctccccataaatcagagaggcaaaaaggtagcatataaaaagaagaaccaaaagaagagaaaacctgacttctagatgactgtggtgtcatctaaaaggcagaggtgcctgaccctcaggaatgtgtatgatgcaacagagctgaagaatgggttcccttcacctactgctggccattgtcccttctgttggagattcctttctttatggttgctgttcataaccccttcaacacccccccttgctggtcctgccggtcacagttgagg

SEQ ID NO: 6332 - DNA, 1200 bp, Homo sapiens
aaatgcccaagccagtggttacatgactggctgcctttttaatgtcaaagctcttgagtccagtggaaacaatgacactgtcccaggttgagaccgagttggtccctggaaagttacagtgatgctatagtttctctgggagcacaggcaatggggcaaaggagaaatggtttctagagagttcattcctttaagagattgagaaatagactaggaggatctcagttccctaatgtaatcttggtgctgctggcctagtgcatgctcaagctgggttctctcagaacctagcacaagactggttagcctgtacattccctggcaatacttactgattaatctgtggatgcattctgggggaggctagaatgttctaggacaatctcagatagttaagtagacctaataattccttgttgcctacactaaacttctttcctcttaacagaatcagcacttcttgaaggagactcctggaagcaaccagatcattccgtcaccttcagccacatcagaacttgacaataaaacccacagtgagaatttgaaacaggtgctttttatctctggcttaactccctgtgaccacagtgcactgcagaggcagccaaatagtttgggcttagtgtttggtgtctcagcaggtgcatcctgtatttatttgcctgcctgggagctgagcagagaggaatgtgtgttggtatctcggggatccatattgctgtcctttcccttctttggcactttgcagtttttccctgcatgtcagtcagtggagtaaattccttttcttatcttgaaagacatagaatgagcagattatcctgaaactctttatgaaaaaatagctatctgggcaggttaaagatgaatggatagctaagtaatccagagtgatggctattttgagccacagtaaattctaagaatgttagaaagcatatccttgaaaatcaggattttctaaagtctaaagacgaaaaggcaagagggggaaaaaagactttgagttcagaatcacattaaagagaatagaggaaatcttcactcagaagaattcctgtcctgagtttaatgccctttaaaacctatagttatcattctttttaaagtagcaatcagtactggaggatgtcagtaaaaataattgaatcttatactaaacaatgcactacttgttatggtattgttacatgagcc

SEQ ID NO: 6333 - DNA, 1471 bp, Homo sapiens
agatgtgagccaccgcgccccgccaaatttgattatttttaataagaacttagctgtatggtattttaacagtacctgcttttaaaattattatcatctttttcctttacaggtttttgatgaagttgtgcagatttttgacaaggaaggctaattctaaacctgaaggcatccttgaaatcatgcttgaatattgctttgatagctgctatcatgacccctttttaaggcaattctaatctttcataactacatctcaattagtggctggaaagtacatggtaaaacaaagtaaatttttttatgttcttttttttggtcacaggagtagacagtgaattcaggtttaacttcaccttagttatggtgctcaccaaacgaagggtatcagctattttttttaaaattcaaaaagaatatcccttttatagtttgtgccttctgtgagcaaaactttttagtacgcgtatatatccctctagtaatcacaacattttaggatttagggatacccgcttcctctttttcttgcaagttttaaatttccaaccttaagtgaatttgtggaccaaatttcaaaggaactttttgtgtagtcagttcttgcacaatgtgtttggtaaacaaactcaaaatggattcttaggagcattttagtgtttattaaataactgaccatttgctgtagaaagatgagaaaacttaagctttgttttactacaacttgtacaaagttgtatgacagggcatattctttgcttccaagatttgggttgggggcactaggggttcagagcctggcagaattgtcagctttagtctgacataatctaagggtatggggcaaggatcacatctaatgcttgtgttccttatactctattatatagtgttattcatgattcagctgatcttaacaaaattcgtagcagtggaaccttgaaatgcatgtggctagatttatgctaaaatgattctcagttagcattttagtaacacttcaaaggtttttttttgtttgttttctagacttaataaaagcttaggattaattagaagaagcaatctagttaaatttcccatttgtattttattttcttgaatacttttttcatagttatttgtttaaaaagatttaaaaatcattgcactttggtcagaaaaataataaatatatcttataaatgtttgattcccttccttgctatttttattcagtagatttttgtttggcatcatgttgaagcaccgaaagataaatgatttttaaaaggctatagagtccaaaggaatattcttttacaccaattcttcctttaaaaatctctgaggaatttgttttcgccttacttttttttcttctgtcacaatgctaagtggtatccgaggttcttaatatgagatttaaaatcttaaaatgtttcttattttcagcacttacatcatttggtacacagggtcaaatagggca

SEQ ID NO: 6334 - DNA, 1181 bp, Homo sapiens
ctggctctgcaatgatcaagttctatgaacattgttatttttccagaaattcatctgagcagccaaaaaaaatcaccccgctggctgtctaaaccagtaaggttcaggaataagtccagcctccccactccacccacaaccaccaccacccctcacagcgcccccttcaatgacccagctgggcttgactgctgcctttgggtgggggaacttctgaaaggtggaggaggagtgaactggaacccaggcctgcagcccagcccagagctccttcccgctctgccccactccctgaccccaggggaggaaagggttcacgagaactgattgaccccctacttggctctttccagggagcatcggctatcctcaccctttctccaagtgggagctgggctcttcctttccggagatactctggatactccttcactttgctggatgaccttgggcaagttcctgtccctctctgagccttcacttcctcatctgtcaaatgaagaccttgattcctgcctgggcagttctagggctggagggcaggggtgacatggacaatcttgggcctccatggagatgaggtgcttggctttcttcccaggacccacaggctgccatgggattgaaagcatgtggaggtgggaaaggtgacagagtagcatgcctccaaggcccccttcatcccagtcctgctgtggggaaagtgggctttgaacgggatccaagtctaagatgtttccggtgagctgccagggacaaagggctctcagacatcttgggtccccagtggctggggtgggcaggggctgattcagccaaaggaggctctagcccagaacagaggaagccagagcccctgccccattcttgagcctcacagagcttgtccccgagttgattcactgtgcaacacaggcttcagattcatgtatttgaaaggtattcatgatgttgttctcttatcacctctgcccctcacctctgtgaattatcatgaagagtcctttaagagtataaatagaagacaaagaaagatgctattaatgttattttgccaaaaatatttttgtagcataatatattaataaaagatattatgaattcaatggcttagtgtttctgtgtgacagctcctctcttcctgccagggaacgttcaggaaaattgcctttgctgtgagg

SEQ ID NO: 6335 - DNA, 1149 bp, Homo sapiens
ggttaatttattataagttgtaacacttggctagttttgtttgtatatgtcttaaaatgttttcttatgatatttaagtgacagttaaagaggtatcaaggtaacttgtgtagaactattctttgatatattgtcatgtttgttgtgaatattttttcttactgcacagtagaaaaataaaaacaactgagtctttattttaatgtaactcagattggggaaaacaaaacagagctaagggaacaaaatgactgagggagcactctcccacgtccagtgcactgatcattttagtatgtttgtgctttgtacggttatatatttaaaacgaaaacaaaacaaaaaaatacaagggttcatgctcttccctgggtaatagaaacagttactcgctatgcataatctagttgatagttaaatttgctattgcttttcttgtcttgttatataaaatcttttcaatacaagtttagtcttaatggtaataaaacgttatggttatttataacttgtgcttattttgtgcattttttcccatgctgaacccactaagtgcatgtagacaggactgttgttttcacactgaaaaggcaaactttgtagtagtcgttgtagtggtagacagataacgaataccaaggctgcatcatagactcctcctttaaattttttttctgtttttttttcctcttttcggttttggatataacaccagatttcagttcagagaacactcgttcaacattcagggaaagctttttacgtcacctgctatgaatgaacgtagtttgctggcaaagttttgatgcatttgctaagcattagtgggaaaggcatgccaaaatcttctctataatgtgttcaatcttgggggaaaaaaaaaggaaaaaaaatcttaggaccaggcagttgtatactttagttattaatgaatgacttcatgttaatcttgctagtttagatgatttccaagggaaagtattgtaaatgtttttttttcataatcttgttgtgtttgaattatttgtactttatctgtccagacaataaatgaaagtgtgtagaatggatttgacttcccaaatttttaaatgtgtttatttaaactttttttctgtaccatcttcagatttccccaatatttttatc

SEQ ID NO: 6336 - DNA, 1146 bp, Homo sapiens
ctgcgacagcagcgcaggctcctgcggctccttagctgtgctcatccggctctcagtggatggcaggataatccgagagtcttttctgtgtctccccagccctcacttttaaaaaatttaaatattcgctctaacaaatataaatttaggatgtataaatctcttggcactgagtctttgggacacacatatatatcgatacaattgtaaaaaaaaaaaaaggaaacaagttttaaggtgcactttcctcgttgcggtatttgtcgctctctttgttgcttatgccgataagcatgggtttccttggtgcagtgtgtttttatatatgtataaatctatatataatctatacatatatatatacaagccagtgtataatgttataaaatggaattctaagttattaattgtaatctgtaggtgacctcggtattaacgtgaaaaacattcaaaacaagcaaaaaaagggacaaaatggaaaaaaattagactatgcgcgcattgtacttatcaggtttagagattaaatatattggaaactcgggatgaatcctgcccacctgcccctcttgcctgcggctggtctgtccctaaggagccgtcaaggtgcgcactgaagcaggaacagagcgacgtgtgactgagccagaaccgcccgctcgcgggcccatcctcgcctcccgggactcgccaaacgccctgactgaagggcccgcagcggaaaacgctgctgcagagcagcactttgtgctttcctttgcatagatatgagctagaaataaatgttattttctaagaaaacaatgccgaatcccgtcccgctcctcgagaaatagggggtgggggtggggcgctggggaaggtcgtgatttcccactcaggccgcggcgctaaggagacgcttgtccgaggtcccgtgggatctccgaccctcggggctactgggagaggagacttcctgtggtactcggaagacctatcccaccagagtggcgcggggctcacaactcccgaaggacccgcgaccgctgagcagagggaacacagtgtgtaccccagcttgggcacccttgcggaggggtcaccttgccccggctcttagtttttggatcgtcggccccagtcttcacagggatcttgcaaggc

SEQ ID NO: 6337 - DNA, 1142 bp, Homo sapiens
tcccagcactttgggaggccgaggcaggtggatcacaaggtcaggagttcaagaccatcctggccaagatggtcaaaccctgtctctactaaaaatacaaaaaaaattagccaggtgtggtggcgggagcttgtaatcacagctactcaggaggctgaggcagaaaattgcttgaacccgggaggcgggggtttcagtgagccgagatcacaacactgcactccagcctgggtgacagagagagactctgtctcaaaaaaaaagactaagaaaagaatcctatgctgtcagccccagacagcatttagggtatgcttcctgcttttctatatgataatcacttctgtattatgtcagatatgtttgaaaactcaatatagcaagattttacatattgatatcaggcaggctgtctaatttaacataactaataacacaatgagttctttgttgaagtactagtaaatctattaaactacaaagcaaaacttactttgtattttgtctccttttagatttctcactatgtgcaatagacactttggcagtgttgtggcacaaaccattcggactcaaaaaacggatcagtttccgcttttcctgattattatgggaaagcgatcatctaatgaagtgttgaatgtgatacaaggtaaagtacatgtcacaaggagagtaaagccttcctggtatgtgataactttatagtttttccacccaagctgacaatatttctattagtaaatatctttgcatttgaaaatatagaatatcctgaaaaatgtcttcaaaaaatataggtgctataaaaaataatatgctgcatgaaaatctaaaagaaacatcttaataaaattgcacaacccttggggcacaggatgttcaagttaaatgttcagaattgctaaattgtataatctatcaattaggacataatcagttgtcaagtgtgacatttctatttatattgatttattgttataatgttgattaattggaagaagtacttatctttagttatctagaaaatccagtcactgtatattgaagattgaatttttcacagtgacaattgtttcttcttatttgtatgattccatgtttagggtgcaaccctgaagcatgaagctgtgggatgcctg

SEQ ID NO: 6338 - DNA, 1194 bp, Homo sapiens
tgatctcctagcttgtaagcaaactgagatgcactatcccttttctataaaaaataagttaatgtgtcaagaaaccaactctattaaggtggggtttaatattaccctttcctatgtgttttatctaattattttggttgttaatatggtgataatggaaagtcaagttaaattttaaatattaagaattctgatttattgagattgaattatgccaccacgtttatgtaaaaatgaaggtggcaccgtggtgagacctaatgagaaatagttactcagttgtaaaaattttgatttattctctttcttctgacctccttgcctcttgtcttgaaccatagcaaaaggatactgcatctctcattactgtagtgctgaggttattgaagttatacaaaacacatctcagtctctgtttcttggaaaggtatctattacatcctgctagctgactgacaaaactaagcagggagaataaagataattgtattttatgttttgcacacaaacgcagaatttgtataaccatatgacttcatagttgtgatctcaaaaaagaaggaatttctcctttgtttcttgcagttaatgtaagaatactttaaatctctaagcttctgaagtgttagaggtagagatggtctagtaaagatgtagtagtaatgttttatccatttagcatgtgtttattttttcatatgtactcaaaggtgacttattggttcacctcagtgatattacagctaaaaaaatcattcattagcaaaaggaaaagtggtctcaacctaacatcagaagtgtttcttattattattttatattgagttgaatattgaactctaacagttttctacatacaaaacacagtgtcatgaaggttattcataattgcattatagaggaatgtagtatgtcataagtactttgtaaagatttgacattcaactgtagtatccatatgttgcttaaatttccttatgagccccatgatggaaagacttaaagatgaatttgagaaaaattgaaagaaattagattatcaggttctgttaaattgttacatgtatcttgcttaaatttctgtttattaatttatatccacccaagtacataaagcaaatttggaggaaacaactgaagttgtgcaatattttctgataattgctttttttattcttgtgttttctacttaaa

SEQ ID NO: 6339 - DNA, 2385 bp, Homo sapiens
tgttcatcgatcttttaaatggcagtatccctctgaagaagatatgatcgaatgggccaagagggaaagtgagagagaggaagagcagaggcttgcccgactaaatcagcaggaacaagaagacttagaactggctattgcactcagcaaatctgagatatcagaagcatgaagaattctcttgttctttggcaacaatatagtattcttcttcctgaatactgaaactatttacaatgtgtatcaaaactacctgtgagcatgggaatacaaaaggtttgagattcctgtaaatgtgacaaaattttaggattttttttttttcttcattacagattcgtctttttttttttttcttataaaagccgtaacccagtcagacaaattcaccttcacttaggcccctgttctggtatacatttactgtgagcttttgcctgcctgtgctattttacttgtaaagctagagcacccaagcttctgccttctggaatatagagaaatagtttcaccctgcactaccctgttctgtagttattctgatgatagccagtgaggttcttaaagtttgcagtattctcccctgattggaatggttgagtgagggtaagggaaagaatatcttatttcttttatgattggtgcaaattggctaaagtgcatttttaaatttcctctacttaatttgtttttcagagataaggaaaaatattttgcacagatttactccactatggaaaagggatgctgtaggttgaaccattatagcctcagattcgatcttttcctaactaaaaatattaaagcctcatgtgtgaaataaatttttaaaaagatttatctggatttagagaattttagatcaacagatacctctcagtgtgtttgctaattaataaaaatcagtttcttacaaataaagtttgtaagaaaatgttcattttaagtgatagatagtggagaaaatttatcacctaaaatatacccatcagtataaggcaagcaaaagtcttaacatggcagccattctgcctttgccgtggccctgtcctgtttagttcttagtgggttaatttttgtacttttgcagaagaaacttcagcaagctagaactggaaggtactttaatttttcatatatatttgtttttttttttttaatgaaggctcatttacttgaaatgtaaaaactttcactgaatacaaatagaaaaagtgatgtgttttatatcatattgctttttgtccatctttgtggtttagtttatttactcacttcatgtttttcacctataaaattgtcaagctagcaaaaaaactcttgtttttttaattgggagagaagagacctgccagattatcagacctcttcatgttaaaagaccatctcctgtaaaactgacctagtggacaagctgaatttgaaatagactgtgaagtaagctgtaacttgtcattttaattttgtttaacacggttactgacttagatgatgtattaaataccaagataaagaaaaatgcacctaaaatctaattagaattctctgggtcaacaagtcaaggtggtattgatctgtgttaatctgagtaacttattgcctagcctataaataaattccaaaatatccaattcatttcttcttgaaatggtgcttgttttgttttctttccattacacaattagactcctacagtttaaaacaaactttaaaccactatcttgcactgctaacttttttctacctttgtaaatagaaacatttctgcataaaagtcatacatatgaagcaagggctgaatcataatcacaaggcttaattttgataaacgaatccagtgacctaaggattttctgcaaaatttgactgggagttgtgataggtggtatttttgtttattttcttcctcttactccttaggataaaggtaagttgacttgaacaactttcttttgcactgggaaaataagcaaatgtttaaatgcttcaaaaaaattttcaattaaactcaaatattaaatatctataacttataaacaccaactttcaatgtaataaatgtatcctaatcttatgtatgtttaactggattacatagatttttatcttttgttaaaatgtgtataccccgtggaccaacataatattaaagtatgtatatattatataaatatatatgtatatgtgctcgcttgtgtaggatgaatgtcttagagtcgtttgtggtattttatgttgttgactctggctccagggcctgtgcttgaaaaggacagataagtattgcccagagctaagtggcactacttacaaagttttaaatgtcttctacatactgattcatgtttatttgagctctctttatagaattttctcttaaagttt

SEQ ID NO: 6340 - DNA, 1585 bp, Homo sapiens
tgacttcgtagttgataaagcacttttattatccattctcccatttaacttttataatactgtgtgaagtgagttacattatttcattttataaatgaggaaacaaattcaaagagataaatgacttgccagggccaaaatccagagctagatcttgagtccagatcttgtactcctctcatatttcttctgaaacatttaaaagtgtacattggttgtcaaatgtcaaacattacttacttcatacttttttcctccaatctttatttcacagttgttcaggggatgaaggaagctcaggaaaggctgacgggtgatgccttcagaaagaaacatcttgaagatgaattgtaacatgaatgtgccccttctttcatcagagttagtgttctggaaggaaagcagcagggaagggaatattgaggaatcatctagaacaattaagccgaccaggaaacctcattcctacctacactggaaggagcgctctcactgtggaagagttctgctaacagaagctggtctgcatgtttgtggatccagcggagagtggcagactttcttctccttttccctctcacctaaatgtcaacttgtcattgaatgtaaagaatgaaaccttctgacacaaaacttgagccacttggatgtttactcctcgcacttaagtatttgagtcttttcccatttcctcccactttactcaccttagtggtgaaaggagactagtagcatcttttctacaacgttaaaattgcagaagtagcttatcattaaaaaacaacaacaacaacaataacaataaatcctaagtgtaaatcagttattctaccccctaccaaggatatcagcctgttttttcccttttttctcctgggaataattgtgggcttcttcccaaatttctacagcctctttcctcttctcatgcttgagcttccctgtttgcacgcatgcgtgtgcaggactggctgtgtgcttggactcggctccaggtggaagcatgctttcccttgttactgttggagaaactcaaaccttcaagccctaggtgtagccattttgtcaagtcatcaactgtatttttgtactggcattaacaaaaaaagagataaaatattgtaccattaaactttaataaaactttaaaaggaaatgtgctgtgatggcctttttgttattggaaaaggagggagggatggagatcacttcaggaagaaaactaacctagaggacctaatctaggagtcctaacctaggactcctgctccttcacctcccacattcaaatgagcacaatggctcctctcttttactttttaaatacctgaatttcctctgtccacactatcactgttttagcacggggcaggctttttctctcttcgactatttattgctatagccccttaacttgcctattggctctaatattccctcctcctgcaatcgatccatatcactcccctgtttaaaacctttcctggctggacacagtggctcacgcctgtactcccagcactttgggaggccaaggtgggcgaatcacctgaggtagggagttcgagaccagcctggccaacat

SEQ ID NO: 6341 - DNA, 1190 bp, Homo sapiens
gagaaggatgttctccatatagagtttagcgagtgcctaatccctccttttgtaagattttgttccctcagcttgaggaacaacttcatcttcaactttttatttctccctgatgttacagtttggtagatttcaaactggaatagctagcatgtgcttgctaaataattttatgccagccttatcctgtatcctagctgttcttaacagcaggtacaaaaatgcctgtttttcagcaaggttgaaattgggaatgtccttttgaatcagaagaaaataggccatagactcatctcccagcacaaatgggcattctatgaaatggtactggccctaggaggatttcctcaaccactctcctactcttggccttgaacctacctctgggttggatcttactattgtagctgctcactataccctcctgcatgcttagaataatgctttgaggggagcactggtaaaacacagtatttatttttttacctcctttaagaggacttggaggtaagttgcattcattcactcaagtttccctcttgctgtctaatagaagcttactttttgctatatcagcatttgttacagccaatatttaaggacaaaatttagaaaatatatcatttcctggcccatcatcaaactaatacagcttaaccttgcagctaccaacttttgtgtcaagctagatatctttatttgatatctaaggtgcaagaccaacaatatattaagagatctgtagacatgaaggcaaagctcttgtattttttttcatccaaacacctcaatttattttataaattcgttcatttttcctgttatgttttatataatatatggactaaacaaaataaaataacagtgcaaaagaggagaatatttcctcttgtgcttttcttgatgttgtgtacagaatttccttttatattattcctctaccctccacctgtaaatgaatgttagtgcagtaattgtttgaaataatgcctcatccagtgttaggtcagtagctccacagtctacacagtccagaattctttctctaattgtcccaaagggggacattgtggaggcagagttagggggaaccacttcaagtggttagggacagataaataataggcagtatagcacatgaaagaaaacacacacttggaagccaggagacttgtgtcctagtcaaaact

SEQ ID NO: 6342 - DNA, 1184 bp, Homo sapiens
ccccgaattagaaatctaatatccttggaatatttaattttcaaacgatagttagaaatgttattaacttagtcataagcttttccagtgttacaagcaaacttattgtaattacttatttttttccagatgaaacagtttcttctactttattggatacaaagtggaataagattctagatcccccttctcaccggctgtcatttaaccctactttggccagtgtgaatgaatctgcagtttctaatgagtcacaaccacaactgaaagtcttctccctggctcattcagctcccctgaccacagaggaagaggatcactgtgctaatggacaggactgtaatctaaatccagagattgccacaatgtggattgatgaaaatgctgttgcagaagaccagttaattaagagaaactatagttgggatgatcaatgcagtgctgttgaagtgggagagaagaaatgtggaaacctggcttgtctgccagatgagaagaatgttcttgttgtagccgtcatgcataactgtgataaaaggacattacaaaacgatttacaggattgtaataattataatagtcaatcccttatggatgcttttagctgttcactggataatgaaaacagacaaactgatcaatttagttttagtataaatgagtccactgaaaaagatatgaattcagagaaacaaatggatccattgaatagaccgaaaacagaggggagatctgttaaccatctgtgtcctacttcatctgatagtctagccagtgtctgttccccttcacaattaaaggatgacggaagtataggtagagacccctccatgtctgcgattacaagtttaacggttgattcagtaatctcatcccagggaacagatggatgtcctgctgttaaaaagcaagagaactatataccagatgaggacctcactggcaaaatcagctctcctaggacagatctagggagtccaaattccttttcccacatgagtgaggggattttgatgaaaaaagagccagcagaggagagcaccactgaagaatccctccggtctggtttacctttgcttctcaaaccagacatgcctaatgggtctggaaggaataatgactgtgaacggtgttcagattgccttgtgcctaatgaagttagggctgatgaaaatgaaggttat

SEQ ID NO: 6343 - DNA, 1148 bp, Homo sapiens
ttctttttttttttttttgagacggagtctcactctttcgcctaggctggagtgcagtggctcgatctcggctcactgcaagctccacctcccgggttcacgccattctcctgcctcagcctcccgagtagctgggactacaggcgcccgccactgcacccagctaatttttttgtatttttagtagagacggggtttcaccgtgttagccaggatggtcttgatctcctgacctcatgatccacccgcctcggcctcccaaagtgctgggattacaggcgtgagccacctcggccgtcctcaatcatttttccaagtgtttagaaaagagccagaggcattggcatgttttattttctacaataggtttttggctcaatgcagtgacagttcacagttgaattatacagactcagtgtgatctattttaatctttgctgtattgtaacacagatttctgtgcatctttttttaagagtaaggattgataggaatgtctttatttttgtgtttttattccatctgtagatgtgaacaggaagtgctggtgtttcacaaccaagggaatgcatgcagtgggtcagtctgagatagtcattcttctacagtgtttaccggatgaaaagtgtttgccaaaggatatctttaatcactttgtgcagctttatcgggatgctctggcaggtaggaatgctttatgacttagtctgctccctttgtagatgacaaaaaaattttgaattcaaatacaaaataatagtcttaactttggacttaagcatggcaggggactttgatattagtggcaagttgaagctttccatggtttgaagaaattataaattttagtattgtacctggtatagtttttattttacagaggctggaatcaaagctgtaagagaatctggtgacctaaatgtaagaatattttctttttagtggcctggggtcaggatattggtacctggtagaaggaagcatatttgtaacttacttcttgtttctttggttaacaatatttatttaatcatagtgtaaatgctaatgaatattcaaatttcaaaaacaattagcatacatgactatggcttcaaaataaattgtaaatattaactgtaacaacttaaaagtaaaagcatagaggt

SEQ ID NO: 6344 - DNA, 1649 bp, Homo sapiens
ttctgatgttcctcagtagaactgggaagagaaggtaaccttccaaggtttaactatctatctatctatctatcttcaggaaaccctttctaaaatctttgtgttttcactgcagtttagactgacttcttgtgctttgcacccctgtgtagccgatggccagcaccaggagaggagtcaggccgcgactgtgcaggagatgactttcccagctttgctggcttcagaagcctttgtacataagagatgctgctacccaagcaccaaagacctgttaagcatgtgcactactgaccacgactctggtctttcctgttgttggcccctctggggctctacagaaacaggctgggttccaggagcccatctccccgctgtctccccctgccccgagtctggaagagggcaaggacacttccattcctctgtaccatggagtcctgcagccccttaacccctgcgtggcaactgtgtacagcttacccctgcctccagttgcaccacttctagatgtgcctttaaaagatctaactatgggatgggagaacttgagggtgatcgggaacctcccctgctgagggtggtgtcagggttccgtgactccagtgggccagtggtagcctgtcccagacaactccgtcaccccagctctgcctgtgcctttatccctgacagctgctgcactagccttcctgcttccctaaggacttagtggagggggaaagttgtttttggtactacttggtgggaagtaaggggaaggttggatcttgggtttggtctacccacccaagagaaaagactgttaactggaagaaaaaatatatatataaaattttatgtagacacgtttatttatctaggaaactaagtctaactcattgtagggattttatactcaactatacagagtatccaccaaagtcctaatctaaagtcctgctccctgtcactttttaaaagccagggtagcagtaacatgacaaacggctgctgtggcttcctcttgagagaggacagggaaagcctttcctcttcggctggttatgtggggaacttccttagtttttttccacaagaaattctcctttggctttgtttttctgaatggatggagactatgaaggggtttgtagttgtaagagatttaatattcaaaactgaaatattctgcatttcttagaaataccccatcttcccccaccccctttttgaattattaattcaagatcaacaaagcattcctcaagatcacttttaaaaaaggttagaagtgaagcaaatacattcagcttactgatcactatagtattgcataagcacagctcaagaactgagctttgtatgtgtccttttgggggataacagggctggaccatgcttccctgcccttaaacgcagagcttttagtgggtcacagagcgggaactacacacaagtgacttttttccccatgagccctctggccgattttttttttttttttttttttgagacagagtagctctctgccagccaggctggagtgcagtggcatgatctcagctcgctgcaacccccacctcccaggttcaagcgattctcctgtgtcagtctcctgagtagctgggattacaggcacccaccactatgcccagctaattttttta

SEQ ID NO: 6345 - DNA, 1303 bp, Homo sapiens
ggttttttccctttgattcctcctctccatctttcgtgtcctctccttttttcacatacaggtatttccttcccttcttcatttttctccccaccctctcaaatgttttgcagcatgctttatcacctcctattatataaatagaaaaaaagaaagctaactacaagttaattctaaggtgttgtcagataaacaggcacaagcctttcagtttcctgtctgtgttgtatccaacagacagatgtgccacccgtcggtgtagagagcgttgtccccacccaccaagaggaaacgtgtcggagtaatgcgagtccattttctttcagctggtctaccgatgcacagcaaccagccaatcctgctgtctcaagggtatccgtacctcaatgtcagttacattcagcagaaaaagtgacatttaatggaaagcaaaacaaatcaggtcctgatttaaaattttaacacgtttagatagcttatttaaattctaagactgtttttacagactgtattatttgtatataaatatgaactatagtttttactagtatcaccaaattgagtgatacaaatttcatctattttattaccctatttttaagggaattttatgttttgtttaaccttgatgaattgtataaagagagaatttaaaaaattacattctttattttctattagctgtattcatactttggttgcttcagactttatatattgttcttaaaagttaggaaagaatttcatgtgttttaaattgtcacttctattctttacagaaccttgtagtgccaaaaactttttaaaaggtaaaaaaataaaataaaattacaacatgaagattcagattttttttcttttccatacttgtatattgaacattcaaacttgaatggaaagttgattttgtctgtatttgaagtacttctattttaagttaataaatctttttgacaagagttaaatttggttaaactgttgtatagatgatggaaatattacgtaacaagatttcttttaatttcagtgaatagagcattctaaatcacagattttagttttagagattcaagtaacatttcatatcctttatttggttggatgttcacaacacccatatgaggttgatagaagcggaagccatttccattttatctttgaaaataaaaactgaaatgcaaagcagtcagtaaattccaaaaagcaaacaatgctggagtctgaattgaaaagtatttggaaagagaattttaaaacactgagactaatattggcaattagagtggagggaagattacttttt

SEQ ID NO: 6346 - DNA, 1125 bp, Homo sapiens
agcctcccaaagtgttgggattacaggcatgagtcactgcacctagcctacaggcaattttgtacagagaataattcctttccagaagtagcccgatatagcagaaagcatgagttttgttgtgagacagacttagctctacatcttttatgtgagacttaacctgttttttctatgggcaaatgacctgaactcctgaatcagtttccccatctgtaaagtgaggatgaaaatagtatctactttattgagatttttcttattcatctgtagcatctttgtgtaatgtcatatggatgtaacttggttagtactattagcaactgtgatgatgatgattgtgaatcttattttcatatcttgggttttcttacagtgaaatatttgttgctgttattttctttgtaaaaataaaccatgtttgcatcttggtcttctttccatttggattcaaaagttttatagtgattcctcctagtaaaattgcattttctccctaggagtacttctttgattccagagtattaacagatggagaactggctcccaatgatagatgttgccgtgtgtgtggaaaaataggccactacatgaaagactgccctaaaaggaaaaggttggcaaatgaatatatatcaacattttgaggaaaataaatgagaggccaatttgtagctataattatgttcagaaatgtttaactgagaaagtttagggtatttaattatacctaaggtaaatgttcatttgagtggaattttgtaatagggtaagatttgcatgtggtataatagtatcttctaacattcatttgttcatttattcattaattcactcagtttttttttgtttttgtttttgtttttatttttgttttttttgagacggcatctcgccctgtcgcccaggctggagtgcaatggtgtgatctcggctcactgcatcctccgcctcccagtttcaagtgattctcctgcctcagcctcccaagtagctgggattacaggcgcacaccacaatgcccagctaattttttgtatctttagtagagatggagtttcaccaacattggccaggctggtctcgaacgcctgacctcgtgatctgcctgccttggcctcccaa

SEQ ID NO: 6347 - DNA, 1102 bp, Homo sapiens
agtagataacatcaaatgtatcatttggagtttaatgctcttaaaagacatccttttccagctttggtctttcagatacgttttattcattaacttcttggcatcaaattataccatcatcctgacatgttctttttggaagaagtattttagtatgtcttataggtaaattctaaaatggtattagagtatttggacctttgggttggatcacttgaaatctaataatacaattaatttttttatgcagatctttgatggaaaacagattccacagagaatggttgatggatggaatgctttcttctttgataaaacagaagaactggtaattttaaaatagtctttatgttctagaatgctcactgatatatgttagcatctgtataatttaataattttacttaaatttgctgtccatgttttggatagtactgtatagacattgttcttttctttttttttttatatgtagaaaaagcgtttaccttcacttggaaagaacacagaatcattaggggagctttggctgggactgcttcgtttctatactgaagagtttgatttcaaggaatatgtaattagcattcggcagaaaaagctgttgacaacttttgagaagcagtggacttccaagtgcattgcaattgaaggtaacatttaagctgatattaattcaggagcaaccaaaatttggtcaacgaaattgaggggaaaactgaaatacattaggatttggaagattcttcctcttttatcagttttcctcctttaatgtgtaattttagaggaagagtttgctgatttgtatagtctgagtacatataagtattagacttcagcggtgacttctaagtatatttttatggtacagtgaatgtaattcttaatcattgatatatttcttttgtagacccttttgacttgaatcataaccttggtgctggagtttccagaaaaagtaagttttaaatatagagattctctgattttaaaactctgacacattaatgtctgcatctttattgttttcttctttctttaatagtgaccaatttcatcatgaaagcatttatcaatggaaggaaactttttggtaccc

SEQ ID NO: 6348 - DNA, 1226 bp, Homo sapiens
ccacgagaccatcaggggacttcgttctttttttaatggttgcataccattccattatgtgaatagtcgttaattattttaaacctgcgcctgcactttattgatgaacctaaaactatttctgattttttgctattaaaatagtgctgcaattaaaaaaaccttcttagtcatttcacatatgttttggcatgtttgcagggtacattcttagaataggattgctggttcaaagaaaatgtgcttttgtaattgtgatattgtcaaatattcttcatagtgtttgtattaatttatactctcacctgcagtgtgtgagagtacctgtttccccacgtcatgtatagtagttttttgtttgtttgtttgtttgtaagatggggtctcactgcattacccaggctggtcttgacttcctgggctgaagcttttctttcacctcaacctcccagagtgttgggattatagacggtgcagtttgtttttaactcagtttaacccagttctgtgggttaaaaaaaatgatgtggcagaatgtttaatatacttctgcatggagtaagactctgaagttttgttttcaatcatgttgttttttagcgatgtgacattggggatgcttccaggggaagtttatcttcatatgcatatatccttatggtgctgtactttctgcagcagagaaagccacctgttatcccagttctacaagaggtaggtgtttaagaaaactataaaggagttttttttgaaaacaatagatctaaacacaggagattttgcttggttcatgtcatcatgaaggatttttccatcatggttgtcctaagttttctctttccattaatgctataattaaacaatgaatatttttgaaaaatttattatgggagaatatagactaccaaaagaatattagatgaatagaaccattgaatatcttttgtaatgtttttaaattttacagtcttagagtgctgtggatgattgtgaagttcttgtagccagccatgaactcatatattttatagtctccaagatgcaagtacataagtttcttctttctagaatattttccctcctgttgcctggcaatgaagattgatttattcttatgtatactttggtcaaccttgtgaattttggtttagaatgaacccagggaaactcttccttatctcttctgaagtcatattaattacattaaacataagaatgtacattga

SEQ ID NO: 6349 - DNA, 1173 bp, Homo sapiens
tatttggaaaaataagatgaatataaatgaaataactagaaaaccaaaaggacaaaataaattaggtaccagactgtggcacacagtttgaagaactaaagaagtgtggaactaaggagagatcattgaaggctgtggttaggcaaaacagtttatagggaagatagaaattttgaccaggcatttgagggaactgttaaatttgagtgggccagatgcctagtatagcaacatgaatacagatcttaacaaatgggaaaataagcatggatatgggggagagtgaagaagtaaataggtttgtagatatacggaaaatgatcatgtgaaatgtacatatatcttaaaaattatttttctgtttcatttattttcgtttcttcccctgggttgctaaaacagaaaaacagtttttttccttctatctcccagacccttccccagtaacatttatggttttaaagtcagagaagtcaacaaataatgaacaaactgtaagtaaaatttttagggtaaaaacttgaagatgttttcagattctgttttccttacttttctttttccttttttcttctttttataaacccagatgagttatcaccaccttgttctgaacaacacaacagggagcaaattttaattggcttggaaaagtttattcaaaaagaatatgatggtatgtcataggttaaaaaatttattgcgtttttgctgtagtcatgtagtcttgagtttcatttatttaaaaatatttattgaatgctatgtgttaagtactgttctagttgctgggaatacagtgctaataaaagagatgaaacctcatgaagcttatgtttcaaatggggagacaaatagttgactaataaatatataatattatatcagcaaataatacatgctgttaaaagtataggagataaaagaactgaagtgatggagtgttatgataggcctctctcataaggtagcatttgaggagaatcctgaataacatgaaggagcaagttatataaatatccaaggagaaaacattgttgatggaacaagaatagattatgtttggcatatttgaggaatagccaggaagtcagtgtggctggagtggagtattagaggtagattgtaatgtatagaagaggtcagagagggggtctagggattaagtcatta

SEQ ID NO: 6350 - DNA, 1134 bp, Homo sapiens
tctcaaagcgagaacaatctatgttttaaaaatgtccaccactcttctccatactagctgtatggtaatcctgtgttctcatctataaaatggatttctaatagtacctacctcatagggttatggtgaaggtcaagtcttcatagctcttaacaattgtttcttatctgtttcctccaccaaactacaagttcatgagcaacactgacagctctcagtgcataatgtggtgtattgttaataaatacatgttaaacaaatgatgcttctaaggctctgaccacagtgcactgcccaaggtaagcaccagagaagtcagctggggagtgtgatcctgttggggaagaagagagccacacaccctcagtttgctgttttccaggccctgaggaggtttctcctgactgccaaggtgtgaacacaggcatggcggcagaagtgccaaaagtgagccctctccagcagagttactcctgcttgaacccgcagctggagagcaatgaggggcaggctgtgaactccaaacgcctcctccatcattgcttcatggccacagtgaccaccagtgacattccaggcagccctgaggaagcctctgtacccaaccctgacctatgtggaccagtcccataaacattcaataaatgtctccataccatccccttctggagtctcttcagtgaaaggtgggagtgggaaaggactttagagcctagcatgataaatgagggcttctcccagcaaagatacccagccctgctgtggaccctgccatactgttctgcttggcctattgtgggccaaagaactttgacatgactcctaggaaaaatggtcagtaacaactccatgcaatcgggtggaagcctggggcctgtgaaggcacagaggagcccctcacccaactgggaagtcagagaactctgacatggttttcctgccccacagtaggtgtatttaggagcccctgagaagatgattagccctcagagggggatgatctctgcctcttcagcagctctgcctcaccctggagtgcgccatcctggagtaagccccttgcagagggacggatagagagggagtatgttgtgcacagggctcaggcgtcattctatttcttaggtagatgaa

SEQ ID NO: 6351 - DNA, 1189 bp, Homo sapiens
tacaggtgggaccttttgtgttaatctgttttctccccagtcatcttatttggctatgttaaaaaaaaaaaaaaaaaaaaagcgagagagagagatggtgtctcactgtgttgcccaggctggtctcgaactcctggcctcaagtgactttcccacctcagcttcccaaagtgctggaatcacaggcatgagccacagtgcctggtcttagctgtgtttttaattatgccatgcatcaacataacaccgggccatcttcctatcccttcctatcccatatgtttaatgaaaacatattttatgtgctaaattaggttaatttaccagagatttagcttagtgtttttaaactatagaacaatacccctatagaacaatgtacagctgcacccaaggttaaaaagaggtagcagggaaaacaaacttaaactctttgtatatggtgaaacccatccctctcctgccctctaatggtatgtttacattatttcgttattatacaatgtagtggtataaacagtattattaaactgaaggcataagttaaaggaagtatgttactttgagctgatgtaggctcttccacttttatctgtattttacttatttggggactttgtattgctagggcttcagaatactaactttgacacagctcccagagaggtttgcaaacttttggtttccctctcaaatccatggtagtagtttcaaatgagtttgtggataatggatgtttagtccttatcatttgctgtgttttgacagtttttaatttgcagtattcactcacgaactgttttattttaggaataatgcaaaaccaaccttcgtccggtgatgagaatagccgtatgataagagaatttgctcatcgtgctttaaatgattaactgttttaccttatttagtatttcatagactttgcatgatatggtacactcctaattatgcattctttggtttccaaatcttaatctaagatactttgttaactgactggtagcctaagaaagagacttttcttcctgtttttctctctccccattttttggggtaagttttgcaaagatcagtgctgcttctcatgactctaaagtaaagctcttttggatagcacagcctaactttacagctagacagaatggccattaagaatatttccaaaatccaagtttatcaaaattat

SEQ ID NO: 6352 - DNA, 1335 bp, Homo sapiens
catgcatctcccatgctgaaggttaaaatgggggtcatttgccaacaaatttgggagtccgcttctccctgaaggctgccatgccctctagccggtcccgggttggaatattctgcaacaaggtacaaaatattagttttgggggagcagggccacaggcccaaaaagagttgcttaagcttgtccagcccaagacaaggccagggtccaagtgtttccattgtctctggactctgatcttgaggcatgcaaaggtataagcctccgtggctgctttgtctcctggggaagacaggccagcctttgtattctctgtgccccatcagcattagcctccacttgcacactgctttcatgcctcctgagaactcagctgccgtctgcagtggtctgacatgaggctgctcagtagagaaaaaaattctttgcagtaagaaatctggctttgaatccaggttcacactagtttctccaagtcccaggaccccttaggagtattttggatatctgttaacgtggagattagcattttttactcacccatgagtaagagatttaataggtcagtcccaagtgtacagcccctacattgaacacagcctgcaggctacaaccaagcccttgacctcccaactccatcctgaactttacagtggcatctgatacagaggcaaaagatgtggttcttcctcttaaggacctgtgttctgtgattctcggcattaagtgggcaggatgaaccccagtacattagatggttgagggaaaagtcccagagagaagcactatggctctcctcaagccactccaggtgacttatgagggacgatggatgcggtcagactgtttgtgttgagaagaaccttctaaaattggtcatgtaccatacaaagtccctctagcctggcccagcctatgttaacaagcaggcatgggctggttgctacatacctgggcatagcacatcccttcaatggccatcccagatgcaatgtccacctgcaagaaagacgtgctccctggattggtctgaccttgtccatcttcacccacactggaagccagcccaccctattgcctacagacatctatatgagcagagatagctatgagaaggaatttccctcctagagaagaaacaccattcgtaactatgacaaaactgctgggagaaacgagacagactgagacattttgccagagaagaggagttctccttcccatccggctgcctcaccacgcttcctgtcacccgttaatttctgaacctttatgacctgggccctggcaattgctccagcctctagggcccactgactggcacttgaaagcctc

SEQ ID NO: 6353 - DNA, 1205 bp, Homo sapiens
gatggagaagcagatgaattatccataatctaggcctctgttttcaaatatttgttattagtcatttaaagtttctcttgatatggtaatagctaccagttattgagtattatgttttaggatattctaaatccttagctttataaatatttttaatcttgtaaagtggtattattatccattttacacatcaagaaaccgagactcagatcaagtaacttatccaagatcacacagtttgaaaagcaacagagctaggattcagacttaacttctgttgactccagagcttgtgtccttttctccatgccaaactgcctcctaggatatggattattttgtgagatgttgattgattttcctaatcattcattttaagaaggtagtctagattatcaattttagattgattcctgttctggttagaggtactttctgatctcattccaggttttagggctatgctgttggggacccaaaactctattatgagttcctcgccatgaacctaaaaatcatgtattccctaccatggtttgattttgtcttttcttgaatgttttaggaaaacagaacaattttgcaagagttttgaaaatgggattggaaaagaactgcatgagcagctggttgctctggacaaacagaataaacatacaagctacatttcgggtaggtaggctgggctgtgggtatgatttctcccagagccctccataatgaaaagtaaggcatattctctcctgttttggtctcagagatatttttggtgagaccagcaaatgaagtaacgtctcatcctcccttcctgaggtaaattaaggctgagtgtgttcctcctctactgaggtgttgacttgagcccatgctcaagaatgatggccagccttctctgtagatgggattgaggcagaacctaatcaatggtcctgtctgaaaaggatgcaggattaagtcctatgtcctatatcattctgggtccttcactgtcagacagaactgtcctctccagcctcttctctcaccacccaccctgacatacttcctgctaaactcctcattgctccctgaacccttagtctttcattcttttgtgcctttatccatgctgttcccactaccatttttttgcctggcaaattcttcttttaagatccaaggaggatggttttctgtgaaaccttctcagtcctttttcctttcca

SEQ ID NO: 6354 - DNA, 1207 bp, Homo sapiens
ggcctacctggtcaatgcgtatcccctggatatgtcccagtattttcggcttttcaactcaactcgtttacccaaacccagtcgggatgaactcttcactgatgacaaggccagacacctcctggtcctaaggaaaggaaatttttatatctttgatgtcctggatcaagatgggaacattgtgagcccctcggaaatccaggcacatctgaagtacattctctcagacagcagccccgcccccgagtttcccctggcatacctgaccagtgagaaccgagacatctgggcagagctcaggcagaagctgatgagtagtggcaatgaggagagcctgaggaaagtggactcggcagtgttctgtctctgcctagatgacttccccattaaggaccttgtccacttgtcccacaatatgctgcatggggatggcacaaaccgctggtttgataaatcctttaacctcattatcgccaaggatggctctactgccgtccactttgagcactcttggggtgatggtgtggcagtgctcagattttttaatgaagtatttaaagacagcactcagacccctgccgtcactccacagagccagccagctaccactgactctactgtcacggtgcagaaactcaacttcgagctgactgatgccttaaagactggcatcacagctgctaaggaaaagtttgatgccaccatgaaaaccctcactattgactgcgtccagtttcagagaggaggcaaagaattcctgaagaagcaaaagctgagccctgacgcagttgcccagctggcattccagatggccttcctgcggcagtacgggcagacagtggccacctacgagtcctgtagcactgccgcattcaagcacggccgcactgagaccatccgcccggcctccgtctatacaaagaggtgctctgaggcctttgtcagggagccctccaggcacagtgctggtgagcttcagcagatgatggttgagtgctccaagtaccatggccagctgaccaaagaagcagcaatgggtgaggcaggggtggggagcatgcccttgggtcttgtcctcagtgcttgggtaagcaagcctaaatcattctactccaaatctgatttctacccgttcactaggtttaatccatcgccaactccccaaatttttcttttctaccctagcagtctgaacagccacactagc

SEQ ID NO: 6355 - DNA, 1716 bp, Homo sapiens
atgactggatgaatgggtttctatatatgggtctgtgtgagtgtatgtgtgtgtgtgattttttttttaaatttatgttgcggaaaggtaaccacaaagttatgatgaactgcaaacatccaaaggatgtgagagtttttctatgtataatgttttatacactttttaactggttgcactacccatgaggaattcgtggaatggctactgctgactaacatgatgcacataaccaaatgggggccaatggcacagtaccttactcatcatttaaaaactatatttacagaagatgtttggttgctgggggggcttttttaggttttggggcatttgttttttgtaaataagatgattatgctttgtggctatccatcaacataagtaaaaaaaaaaaaaaaacacttcaactccctcccccatttagattatttattaacatattttaaaaatcagatgagttctataaataatttagagaagtgagagtatttatttttggcatgtttggcccaccacacagactctgtgtgtgtatgtgtgtgtttatatgtgtatgtgtgtgacagaaaaatctgtagagaagaggcacatctatggctactgttcaaatacataaagataaatttattttcacacagtccacaaggggtatatcttgtagttttcagaaaagcctttggaaatctggatcagaaaatagataccatggtttgtgcaattatgtagtaaaaaaggcaaatcttttcacctctggctattcctgagaccccaggaagtcaggaaaagcctttcagctcacccatggctgctgtgactcctaccagggctttcttggctttggcgaaggtcagtgtacagacattccatggtaccagagtgctcagaaactcaagataggatatgcctcaccctcagctactccttgttttaaagttcagctctttgagtaacttcttcaatttctttcaggacacttgggttgaattcagtaagtttcctctgaagcaccctgaagggtgccatccttacagagctaagtggagacgtttccagatcagcccaagtttactatagagactggcccaggcactgaatgtctaggacatgctgtggatgaagataaagatggtggaataggttttatcacatctcttatttctcttttccccttactctctaccatttcctttatgtggggaaacattttaaggtaataaataggttacttaccatcatatgttcatatagatgaaactaatttttggcttaagtcagaacaactggccaaaattgaagtcatatttgaggggggaaatggcatacgcaatattatattatattggatatttatgttcacacaggaatttggtttactgctttgtaaataaaaggaaaaactccgggtatatgtatagatgttcttcattatagacatcttctttgcttttcttggccttgggggaggaagggagaagtgctcttttctacttgtggggtctcccattggaaacataatcctatagtcccagaaggattcagtccccagtggctttcccatccaaagagaaagagtttgagtttcttaactctgctgttctgccacttactcccactagacaaccagggacaaggtgcaacatggaagtgtttgacttaagtaggagcagaggagctgcatctaatctcatcatacctggaacttgacacacttaa

SEQ ID NO: 6356 - DNA, 1176 bp, Homo sapiens
tgagtctttccttgtccccaccccttaagtggagccactgaggctgacacccttggggcctgtggggtggggtatccccaattgttgcatcccacagatttgaccaaaacctcaaaccccaaaccagagcaaacggtgttaatttgctgaatcccaaagtgaatccaaggattaatttttttttccctgaattgtgaaccaagtctacgatttcttcttcaaaataaaagagggttctgttcaagacatttcacatcttaactgtgccttttttccccctcctgcttttgcctggggatttttggacaaggtcctgatggctgctggctccaggcttctctctctgggccaggtagggagaggaggtgggatggggtggggtaggagccgctgttctgtggggtgggggttgggggaggttttggtgaagaagtggcaggacaatgagcgctccaattggaaggagcccagggccaggagccagaagacctgtgttcgagtccggactttgctgctctgtgcctctgtgtgagagctgcatctctataagcctctgccaaaatgaggaaaaccgtcctcttgccttcagagccatgaggagaagtcccctggcagtgtctatctgtgcttgaggccagctgtgagaggtggtcagtgacacctgtgtgtttgcacagctccttgcttcattttcttacatttccccagacaggtgtgggagagagatgatatttttcttgccttgggagatctgggctcactcagagtggggccatgacttgcccaaagttgggccctaatttgggtctgagccaggcaccacccaagcttctgattcagggaagcagcaagggcacgagcagagcacaggcttcaccatcagaccctgcttgagctgtgtgacctcaggccatataccctctctgagccacatctctaaagatggaataataatcccaggtgagtgattttcttgtccttgctaggattaaagcaaggactcagagcctgcacacagaagacccttggagagtaagtgaatgaatattaatttaacagggtttgggaaagaggctattttggggaatttcaggatgctggagttatcaggaccctcacccgtaaccccagtcaagcaaagctggtggctgcagacaaccagctgtctccaggtga

SEQ ID NO: 6357 - DNA, 1216 bp, Homo sapiens
caaaacagcctgggaaggtgccagggaaggaaggggactggaagggatgagggagggcttttatcctattatcctttcctgcatcccccatatgaggaaaatgggtcggggggaatgtccttacttttaaaaaagaagcttctggggctctaggagtctttctgcataggagaaatctaggttttggtccagccaggagcactttgtgatttgacaggtgctggtgaggcagattcttttgttgaagggcttttcgtgcactatgcaaacggaccagccccagcttccctattaattatgaacatttagaaatgttcctgagtataccccgagttcctgctcatgaaactctgcgggtcagaggccacatgtgttttgattttcttatttgaggtattatgtgttcaaggtagatttatgctacaacctttgtttattgacttgtacttttccctgtgaacctaatggaacatgacagacaatatttacaaggcacgtgtttccgattaaatcatgtgagacattaaaggccgataaatgaaagcccctttgaaaggccaggttcagagagaaggaagtggtccctggtggggccttgaaggtggagtcaccccctcagctggttgcagaaaatgctgaaggcggcaggcggtccctttgctgggataggactgtttgtcaccacttcccatctagggacctaggctgcatagaggtctgaagaaggacagaaagagcccctcttcctctcaaccatctaggaaagaaggaagggaaaagaacgcatcttttttgagcacctactgtgtgccagactctgtcatgtaagtgctttcctacagagaccagcccgtcagcctaacagctctgaggctgttaccatcttgaaggggaatcagaatggcatggggctaagaatgttgactgcagtttgtaggaagcttccaggtccccgctctgtcattcactgtctttgacactgggcaagttacttaacctcactaagccttgtttccttggtcacctgtaaaattagcataataatagtatcgatctcttaggtgtgccccagagtacattagccaatattattgtcattgttaaagataaactgaggcacttttcaaggtcactgcacatagaggatggcagcagaatccagtccttctgattccagagcctttcccgaggctgcttcggtgggaggtgtggggac

SEQ ID NO: 6358 - DNA, 2422 bp, Homo sapiens
actgctgatacaactacagatgggacagtaaatgttcagcattcttggatcagaagaaaacggactaattagatgcttcctttgtcgtggtggttgctttgaaaactatactttaatgggagaaatcatggaaagaaattctcaacagaataactgaaaactgccttttctgtaccgattgctttttgtgtgtgtggtataataaaatctttattcaattttacagaagcattgatggcagtcgaaatgtctctagctcatataacttaatagtaataactaaaaaacttttagaatttacttttgaaaggagggaagccagttctgaaatgagtataggttgatttcatagtcttcttaattaagagtttagctctttgtaaactcaaaatacataaactttttaagtgtagtttcatttactgaaggataaaaatggtaacagtgcagcaatattcacaaaaaatattgtctaacggacatattttgttaatctgttaggttgggtttttgtttccagggacaaattaaatttgtatgattacccaaaaaagggtctcagtttacagatgctaactctatataaaggaatgtggaaaaactcagttcttaagttacaagattaaaaattcacatttggtctttaagaaacaattgactgacatctatgaatttattttgtatcatgctagtaaacacgaagtattaatgtatgggtattttcccagctagttttgctttctttttctggagcaaaacattaagtgattgcagagtttttcaagcaagagaaaaaggtttgcaaaaaaacccaggaaatgttcccttttttccccaccattcatcttcattagatcaaattctgtgaaacttgtctggtctctcaaagggagcagcctctgtagtgttaaatggctaattaaaataggaagatctttatagccagaaacaacttagtcatcaaatagcaagtgaaaccaaaacgtcagagggattactgtacttggaagtatgttgtgtgtcccaaatgtgaacgaagtattgttagaatttattagatcagcttctttggagatcaaagattggaaatcctagtcatagatattcactggactggctttggactgaaatgctcctttgtaattcttttcctattgtcttttccttctagtgtcccaaaatattttctttaaagtcagcacagtactgtatatgaatctttaatgtggtatcatatatgtctacttttgtctgattcatcgatgtattatatctttataattgaatattttagctccgggtcctgttgccccttcaagcagtacatgccaaattataaataggtgctactggccttgagcatatcactgtgggacagttccccaattgtcaagtgtttagatatgtagactattgccatttgtttttttgttttggttttgctttgtgtctgaagctgaattgatttcttttttttgaatgtgaaagttgaatttcaaacgtagtcatttcttacagatggccaagacagaaaattgtggctaggttgactgagaactgttgtcttccatgtattaacacaattaagctttttatattccactctctgtgctgaccctggctgaggcattttgggagacaaggactctgaatcttctgcttccattaaagaagaactgtgatattcaacattggatttctgagaataaagataggatgattcctttgaactttgacttacttgtataaaatgtccagctaggttaggtttttgccatttcctatatactttgggtaaagctacatttgatgagcaatgtgaatgtttctgagaatgttcattcctgttttctcttaagagaatgtgctgtgtactaaatacaggccacatagtgtctgcctgttgaagatctggaaactgcctccccagatctgtattgtatttggtaggtaagggggtcagtttctttttctcattgtgtgttgataatctacacaccatctgttggaaccagggtgttattatggggaactcctcctgtgtactaggaggaggaccttagggagaccaagaggagagaagcatttcctttgatgaagtcacatcctgtctatgagcccactaatgctgtaacattggcctgaaagagagtgttctttaaaagcctttctcggctgttagtataaaaacatgatggtatcagctcttagcatgtttgcttgacccttatggaaggtataaatccacagaacttccttcccagagaactgggaaattgtcctagaaataaaccttgtacagttgagtggacatggataagcaacaatttgttactttgcaggatttgttccttggtaattgtttggtgtgtcatcctgtaaatattcatgatagtctgtttatatccttttgtatatcgtt

SEQ ID NO: 6359 - DNA, 1484 bp, Homo sapiens
cctgggaaacatggcgaatctgtctctacaaaaaataaaaaaattagccaggcatggtagtatgtgcctgtgtcctagctactcaggaagctgaggtgggaggatcgctggagccccagaagttgaggctgcagtgagccgagattacaccactgcactccaatctgggctacagagcaagatcctgactcaaagaaaagaaaaggaaagaaaaagaaaaggaaaggaaaaaactggggaaaatggggtaaggttaatatttttttcctgtatatgttcacaatatagatttggtatgttcagtcaagtaatacttaaaatagtaatgcagtaaaactggatagattctaatgcagtaattaaaattgccaattagaaataaaatgtgaattgatgagttcattcaaaattgcttagagttagataaattgacgttgaagatgaagatattcatggggggggaaaaagagagactatatcgatctgacagaagaagatgtataaagctctttgagtggagcttgaatgcagtagtaaaatcgaatcttgagactataatcataaatggaaacaatctactgagctttgggtaaatgcgttaaacaaaaatttggtatgtgtagaatttgaaagcgttgctgctagcctgcttggatcaggttgcctcttcagcactggatctgttgttttacagaagaaactgcttttcagacaccaaaatctagccagatgcctcggccttcagtgccaccattagttaaaacatcactgttttcttcaaaattatctacacctgatgttgtgagcccatttgggaccccatttggctctagtgtaatgaatcggatggctggaatttttgatgtaaacacctgctatgggtcaccgcaaagtcctcagctaataagaagggggccaagattgtggacatcagcttctggtgagaattatatattttttaagattttaaatgtcatgttgcagaggatcagacagcctaagttcttatcttgccttttcttttttaaaaatagatcagcaaatgactgaattttctaatccttctccatctacctctattagtgctgagggtaagacaatgagacaacccagtgtgatttattcatggattcagaataaacgtgaacaggtaggatgatatggttataggatttatatttgcatgtaaaattgagaacattaaggatctcacatgagtaagtcatcaggaataagaagcttttttttttttttttttatgcttcgtgtattgactcaaatgaaacagccaatatttgactggtttgagctatacacattgtaatttcatatgacttgacctgataacttcatgtaagaaatatttgagttctttatatatccaaggtgtgcttttaggcactgggaaaaaagcaaacaaaacagagtccttgcccatgtaatatttacattcgagtgaggggaaatcagtgagtaagcaaatg

SEQ ID NO: 6360 - DNA, 1164 bp, Homo sapiens
ggcctcccaaagtgctgagattacaggcgtgagctaatgcgtccggccttgacctgggttttgaaagaagagtgggagatggccagataaacaagaaaaagggaagagtaggaaggggcattccaggtagcggcaatagaggcaaccttgaatgccaaagttcccaggcaactggtgagttttgcttttcctaaaccagccaccaggcctgcctggtaggctcataaagccctgggcacagcaagatgaagttacatgttacaaatggcattttaattggatttgcttccctgtgccttgcttttacagttgcaaccaaggcaatgtcttactacctcagctcagaaaaccacctggacccagggcccatctacatgcgagaaaatgggcagctgcacatggtcaatctggctctggatggtgtcaggagtagcctgcagaagccaaggcctttcagactgttccccaaaggcttttctgtggagctttgcatgaacagggaagacgacactgcacggaaagagaagactgatcatttcatcttcacatacacccgagaggggaatcttcggtactccgccaaatccctcttcagccttgtcctgggtttcatctccgacaatgtggatcacattgattcccttattggctttcctgagcagattgctgaaaagctgttctctgctgctgaagccagacagaaattcactgagccaggtgcagggctgagggctttacagaaattcactgaggcctatggaagtttggtgctttgctccctgtgtttgcgaaacaggtgggtgttctgattagattattcggtattttattgggtgtgttaattctgtcaagctctggggcttagtgggctcaggggcttccctcatcaaatagcacttcagtttagaacttccaaatatgaagtaaaagaccatattgaaaaaaatcactcttccttctcctcacctcttagatgacacttaactttattctgaaatcattttacaaggattagttgtcacagctcctccattaagtagaaaatattattctaacagctttcaaagagaaaatagaaaagacaaaatgtgatctgccaaatatctcttgatacgctcttacagatggggagattagtacccagagtttttgggcctgtttttg

SEQ ID NO: 6361 - DNA, 1185 bp, Homo sapiens
aacctgtgccgccatgcacaccacagcgacctcacagggcactcaaggcaaaatgcaatcaatgcagatatcaccctgtttgggcctttgtcatatccctgggtttatcctagactgatgagggaattagcatatgccagtgtagtgaactcatcatccctcccttctgtcacagatgggaagcggtctcgagcagaagccccactgaagtgtcccctggcagacacccacatgaactcttccgagaaactccagttctataaagagaaagccccagattgccatgggccagtgttgaaacacgaagctatctcaagccaggagtcaaagaagagcaagaagagaccttttgaggagtcagagacagaacagaataactcttcacaaccttcaaagcagaaatatgtatgtcttgctgtggaagactgggacttgttaaattcctattgattagtagatacaagttgacctttctctggcccccagctctagtgtttgagtaaaggagactgaggatgatttactttttgtttgaatttacctatggcattagcatagtaagcagatatttctacttttgtggtgtgggaggggaatgctatggaagtatgtaataatttctaatgtatattttcaatacatagtaattttttcaaataaacatttttgctgtccttaagttctgcttgtggattatagactggagccacaggaaataacacggtttgggatggaaggccaggtgaactaacaaggcagcttagcataactcagagatactgcaggtttggttccagaccactgcagtaaagcaaacactgcaataaagtgagtcaccagactctttcatttcctagtgcatataacagttatgtttacactatatagcagtctcttagatgtgcaatagcattatctccaaaaagaaaaaacatgtatataccctcattttaaaatactttattgctaaagaaaatgctaacaattatctgagcctttagcaagttacattcgttttgttggtggttggggggtcttgcctttgttggtggatggatgctaactaatcagggtggtggttgctgaaggttggagtggctatggaaatttcttaaaataagacaatgaagtttgccacattgattgactcttccttttgtaaaagattttgctagagcacacgat

SEQ ID NO: 6362 - DNA, 1292 bp, Homo sapiens
aaataaaaaatctctaattgctgattctcataactggccttctgtcttaagatattttaattataaggaaaatataactatctctttactgagatatgctgtaatggttacagaatgccttataatagctgtgcttttttaaattgaagtataagtaaattatggcaaattgaatatgtaaagtattctagggaaactgacttctggaagcctggtgtgaattcttttataaaacaaatgatcattttaaatttacctattctataccttaactttttggtatattggttttcttaaagcaagtatcgtaataacttgcaaaataatatatgacatttgtacaacagtgtacaatttacaggacactttcacttgccttatatatttagcagaaagtcaagtatatctgattttattattattacaaaagtgatatagccatgttacagaaacattagaagtggaggaaaaagactttatgccaacctaatgtaatagctattagtataatatttccttctgtaagtatgttttttaatagtttcaaagataaccaacaaagttttaattgtactgttgagctaagtacataaggttgactaattaagaatttcctgtttcttataaaattttaatataactaattgttgattttttttttccagtaactctgggtggattttaactacaactcttgtcctctcggtgatggtattgctttggatttgttgtgcaactgttgctacagctgtggagcagtatgttccctctgaggtaaatttaattcttaccatttgaagactgagccctgtgatatatcattttaaacaccttatttgtttagctggaaaaacaaggcctttctactaatagaaagagagaagatgtggtggttttaatgtggtagaggttggcacacataaaaattacaggtttgcagcacaagaattgttgttctcagctttctgtgatgctaactaccgtggtgacatatatgttgactggcttgagaacggtgtctctttctgactctctaagactgaaaagacctgttgacatcagtttctaggggatatatgggaaagaagactttttttttttttgaggcagagtctcatctgtcacccaggctagagtgcagtggccaggatcttggctcactgcaacctctgcttcctaggttcaagtgattcttcctcagcctcccgagtagctgggactacaagcatgcgccaccatgtccagctaatttttgtatattcagtagaaatggagtttcaccatattgacca

SEQ ID NO: 6363 - DNA, 1167 bp, Homo sapiens
ataataatgaggtatatttggtagacatagactatatttggtagttagggctggggtgtgggttattagaaaggatcttaaatgaaaggttggcatccatcaatttagtaccatagcctagggtctatcccctgcttgcagcattcagccatattatctcagaggtcttagccactgtgtgaattcctctagtggcaggcgctcaccacctcagtcacctattaaccatcctgaagtaggtggtcattcctgaaggtgagttgaaatctgactttcttagcttctggtcttcacttttggttctatcccctcaggtgtcacagaacaaatccagtttctcacttgaggcagcctttttactaagatgctacctggcaggtgtaagcatctcttcctgaatctttttctttccttctttatttttgtggctaattacctcaaaggtgtaaagcaggccctctggctcaccaagaccaagttaatagaaggccttcccgagaaagtgcttagccttgttgatgatccaaggaaccacatagagaaccaagacgagtgcgttctgaatgtgatctctcacgcccgtctctggcagaccactgaggaaatccccaagagagagacctactggtaagttcccccaagtaaagaagatttcctactaatggatcttcgagtcgacctgttgctttaagtccccaaatgtctctttttgtcttcaagcccggtcatcgtggacaacctaatacagctgtgtaaatctcagattctcaagcatccttctctggccaggaggatctgtgtccaaaactccacgttttctgctacctggaaccgaggttggtcatcttgtacaccagaaagccttggtctgttttttttgcctttctactcttaaccccaccaccagctcccatccccctgcccccaaataccgatccttactcccatcattcgtggtctcgttttgtaggctcagacacaccctcagtatcattagccatagcccaaccatttttgtttttaatcactttctaagacgttaattcaaccattaacagtcagccatatctattgagtgcttaggatgtgcttgggaagtgcctaaatgttgaaggtaaggaaatttataataaagcacatgtagcctccgccctcacaatgctcata

SEQ ID NO: 6364 - DNA, 1341 bp, Homo sapiens
gttttggtttgtgcaacaggcaggggaggagtggggacgcgtttgttctagcttgatttccatggcaacagcagcggcacgcttggaccccagaacccagcaccctcatcctgtggccagaggggccggaccactgacccctttcaggattccaccacagcccagaccgtcaccgtgacccggtggcatgcactgttcccaggacaccctcctcctctcctggacctcccttccgtcctggcctccctgcctctccagcccctcctctgcccccaccccagtcttcccagtgagaatcctgccagctgggtggtggcctggcgcagagtgggagaggctgccactgacaggatggctatgacctgggacatggaaacagtgacctccgcgttctggtcccgagatcctcgcatcagcgtcatcgtgtgcaccggcttggggggctggagttccggttttctttgttttttctctttattcgtcctttctcaaagatgggatactgatcagaattgctctgtatatgcttgggactggatggaaagactttggagcagctgtggggggtggggggacaccgacaaccaaacagacgtgctggctccagtcctgtttttactttcaaaaaccaacaagcccgacagtggagcctgtcccctcccgggagggtgctcatggccccactcacctcatcaccccacggaaacctttgtgtcttgccctggaagacacccgaattctttgtacattgacatgcccttctccttcctccctcccctgtagctggtctttgttttactccctccctttctgatccatgtatatcatattatgtgagatatcatctgcctgaaaaaagactttgtgcggattattgggaacattgtagctgtttctgtgttttttcttaccttgtagtctggttctgaattaagagaggaaaaaaaagtaattatgatacattgtagtttgtgtacgatatatgttgataacgttttattaaagggacatcttttttccgcagcccttcctgacatgtttggggaatgtgggttggagtttattacactgattacaaaatgcaaggtgacttcttgggcacagtttttgttcctggtgcataacaagatgttttgtgtttgaggcgtctgccttcttttcctgggcctgcaaattctgtgttcttgtggagtcgcgatggccttggcggaaggtgggttgggagggaaggtatccatctcactttaaatatttgggggccgtctaaaagccattttccatttcttgtcttgcaaacacattttggtccgctggaatgtcttttatttttctggaagtaga

SEQ ID NO: 6365 - DNA, 1203 bp, Homo sapiens
atttgttgagcccttactatgtgccaggaattatgttgggcattcaggagattgttgatgcacaaatgcacagaaaccaagtgtgttttgagagctcaggggttcaggggctctgaggaggggcaccgaattgagagagggactgggctgccgccagctctcttctcactggtttcctgtttaccattagcggctgcccatccctccttagcgcacaaatgcccaagtgaaccttggtatgttttcagacccgcagctcaatcacaagcatgaagcaggcgaattgaaatccatctttagctgccttgaaaacctgcacaggaccccctttagattctccctgcccacgctctccccaagttctgtcttcctctccccgttttgaggacatatggccccttgaagtttttgtttgcttgcagtaggggaaaaacagctttaagtgtagagggtttttccttttttttttttttattaagcatcaagagacacagcaatctgcttggagatagtgtacgtgcataattaataaaatcgcattatttatttataaagagacacacgaggaacgggagaattagggctatccccattatatatgaagagagggagagagagtggagaggcaaaaatactttttgaacattagatcctttcagagaagtgtcttttaatatgcagtgaataaaacggcctgtactcctcatggaagtggtgccctgtgcccagaaggcatcagaaagcagaaacctggttcaggggcttaaaaaaggaacgggatcgatgtggcgctcgcagtgcccagcatgccggcgttgggtagttggcaggagagcaagagagagaggaggcgcggttgagggtttggccgctgggaaagaggattgagagccagtccggggtttccaaaagagagggacttggggcacagaatctctggcaggtgggggagaaacggctaccgtcaccccactgggcaccgcatgaataacccagatgtcggcgaaggggagcccctggtttcgatgagcccactgcaagccagatcccatgaacttggtggtgagggggttttagatagcagctttgcccttggacctctgcatcccggatgcccgggcaagaccgccaatatcaataacccaacttattatataacagcctcggagaccgggaagcaggggtcaggtcctcccaagcttc

SEQ ID NO: 6366 - DNA, 3586 bp, Homo sapiens
gcatgcatgtgtcaagcttatccaattgtgtactttaaattatgtctagtttattgaaagtcaataacagattaaaggaaaacaaccccactgctccattagggaaggcagctgtgcctctggccaagcagaggggcagaagcccagcagtctgagctctactcctgactctacctccactgctaagctacctaacccccaagccccaattccctacctgcaaaagggggataagaatacctgcaccatcttcttcaccaggttaacggggttaaacaagagaaatcctccaaaagccttttctgggctgcagaatgagcagttgggtttctctcacgcctcgcgttccgtgtgcctcctggcgtcctcacccacttctctgcctctgcagcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaataaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccatggctgtggggccgctgcttctgtttaaataaaagtggcctggaagctggcgtttgtcgtttcttgcttgggggaccaaaatgtggagtcagatctgggctcgggtgcaggctgtgccattccccaactcagttgctctcactgaacccatgagcccatggccgagggctagaagaacatgcaggaactgacaggtttatttctatcactgtcagagtgtgattggagtaagtgttgaaaggatccctctgtgtgcagggtggcaagcagaccagtgagaaggccaccactgcagtccaggtgagacgatggtggctctggttagggtggaggcctggctttgtcacttggttgtgaccaattaattttagcaagttaatcctgttgagactgttgtcctcatctacaaactagtggacccactagctgtccattaaaatgcattcctccattctttggacacatagctagactacctttcccagc

SEQ ID NO: 6367 - DNA, 1221 bp, Homo sapiens
gtgggtcgttgggcagcagtgccagtcccagctttttcctgaatagcctctgggtcaggggctgtacctagatgggagaaggaggatgctctctcagtgagggtccctgagacagagggcagtattaggttccatgtcatgtcgaagctgcagggaggaaactaaagcccagcaagcacagtttgtaaagctcattgtttgggtttatacaagagagtgagagaatagggactctcccaggctttgctcccccactgactgcatgccacaatgtggggcccaaggtttcagctcacaacacatcaattctgtctcacagtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaaggtaagccagggtgtcagctgctgctgaccaagactggggaggcatgagtgtgctaggactgagccggttcccgtatcctgaccctggcagccacctcttcaaggctgctgcctgggtcaacccacctggggtacaggcaacaggatctatcatcagaaatgtattagacagtgatggaagctttcatctactctgcccctaccacctgcctgggatgtgcttgtctcttagtggatgtaatctttggtccttatagcaaacccattttatagatgaggaaactgagtcttcaagaggtaatgtaggctgggcacagtggctcacacctgtaatcccaacacttaaaagaggtaatgtaaacttccacaagattcgagtaatcgatttgatgccttggaatctagattgacattccttccacatataccatgcaatttttattagcagttttttctccatttagaaaggatttgtgcttattgtaagagacttggaaaggatttgtgcttattgtaagagacttggaaggtacaaacaagtaaaaaggaaagaaaagactccacctgtaaatatgtcccaaagccagtgttgctaatgtgtttggtacacagttggccccttgtatctgtgggttccac

SEQ ID NO: 6368 - DNA, 2658 bp, Homo sapiens
gacacaatactggatgctcagcaccttcttggaatcagaatctcgaaccctttggaagagcctggagattggactgggaaagctgctgtgacttgggcggatcgtgtatttctcaaggaaagcatttttaagccactagaaggtttgggagctgtttggcagtgggagaactccggcatgtggatcagctgtcccgggagcgtggtctatatgtggattcacatttctgtggagattttcggaaatagagccagtggcagacttttttgttacacgaacatacaagagtgagcataaagctgttgctttctctacgatgctacaaaagaaattcctttggtttttatattttaagaaaaagcaagctgcttttagatatgtgggggcaaatttttaatcttgcagtaatattaaacaggaatatccaatttaaaatgatgtaaagatgtaataaaattccttttcattgtaaaatagtaattaagtcaatttacacagacctttgtatttaatatgtctccctatttgtatagaatttcagatgggtctagatgagaaccctatgcataagcttggatcttgatgaaaggttaccaggatcaggatcaaaaattgggaaatactaagctcttgaagatatttttctgatataattagattgaaaagagcaattttgaaaatgctgtgttctccagaagtacagggtgcattatttgacatcaattacttaaagaagttatgagttgttccccaaacagattttaaaaacagcaaaataaaagcactttaagatataattttactgagtttaacttcacagaattatctttttaatgcttggagacatattgaataaactgtagtcttaaatcatgtgatctgcaatcgtttgcttttgcttaaaacataattactgaaacccttggtattggttgtatatgaagttaactatttgagttggtacacactgcttgtgagtttcatagttattgtaatgcagagaaggaatttgagaatttgtttctcctcaacatgactaattaacactgaaaagtcagtcaaggtttaagatttattttcccagaaataaatataaagcaattgaataaccatccatttagtcgtatttccaaagtatagcaccattcactcatttataccagctcccttttatggtgtgggggagaggtttacacccacatatttcatatatattttgtacattttgtattttgaattgctcacattttcggccctgttttgcctttagttacaggtcctgccttattttcatctcaccatgcacagaactagggagccttaggaagtgccaggttttcactgtcagatttgccaagtcacagaggcgcagccagccctgaagtgcctgtctggctgctgtggcattgtgtgggcatgtggccaggcagatggcatctcattactgtgctctcgccatggcccagtcttttcattctctggcagtgagggtttctgtgctgtcagacttcattgttattctgtgacttgctggaggttggcagtggcctttgtcaaacacactgagaagatggaagggccagcacttaagagcagaactgtacccttagagaaacggacagaggcgagtggcaaacttcagacggttccaatggtcttgcagtttgaaatgtgatgttctaccattggttttgagtacgtgaatacttcctgtcctactgtttcccctaccctattctcaccttctctccgcccacatcctcaccaagagattgtgtgggacatgaccttgaaatgctggcgatgatccacactgggatatcatcgctggcgactgcactctcaggagcccaaaatcaggagtgaaattgccacttctagtccccttatttcctatggaaacaacgccttccgcacccctagcacctgccgtcctcactgtaaagcttcatcaggatcgtccaccgtgtatattatacgcttcagatcatgttgcttatattgttgctgcaatgaccatcgttttcactttgctggtaaccacttgattgctgacagctacagtcaatgaacctgctgatgactttttttaatgtagtacaacagtgacagttatgacaggcttaccttggaagagttgtcatttttactgccaattttttggatgaagatgtttttataaacctttcaaaatggtctgcaaacagagcaggaattgcacaattaactcaataatgctgtgtgttctcaagaagctcccttagtgaggccgatcttaagatggccgattctgcccgttgaaggcatcctgggaaagaaaacaagcatcccagcgggcatctcaccacgacttctcctggagtcctcacacggtcactgacaactacagtcagttttaggaactagagtgccgtatcatcagacttaccctgtcctgccccaccttccctgctaacatcgaggtgtgtgcagttaccttctgagcttggaacaagcagactggaattttcctctgctacctcttgtgtataaaatcttgtttataaaatttcaaaaggaagtagatacactagggaagaaccttaattctaaatttggttcatgtgtggcaaagttcttagcttctaagagtataaaataaatttttcaaaaacagag

SEQ ID NO: 6369 - DNA, 1206 bp, Homo sapiens
ttcagaaacctgattttgaaatcttctagtggtatttctaaatttttagctgtattggattcactgtattagattttgataccatgccattatagttaagcatcttatggtggtaacctttaagagttggatatagtattgtcagaatttgcctggatttggccgatcttggcagaaatggttaagtgaggccagttatcccatcttgtgccacagaacatatttttaaatgtcacttgctatttgcttacatttagacctccctaggatacttaccttctttctcttactccattaccatactgctcccttattccttgtccccacctatatcacttccaagtgagagatccagctaggcccacaactgaagtatcctgacttccatgctaagcagtactctaaagacactcacattttacttatactttgcattttacaaacttagggagtagttaactacttgctggaataatgggccctttgttttagattgtcaagacaagaaaaacttttatttacagatgtgtttcttaatgtcttgttataaagcaaacccatacactgatgtgcgccgaagatactggaatgcctatatgcttttctaccaaagggtgtctgatcagaactccccagtattaccaaagaaaagtcgagtcagcgttgtacggcaggaagctgaggatctctctctgtaagtgtctcttccatgtaatttgctgtgtgatttctatggtgatgatgtggtctgtgacaatatactatttgagattttaaagataattagctaagctggagagaaattctaaaaagaattccaaaaagaaaataaatcccttattgcttcatggttattttcttggcaagaagttgttacatatttagaaacatgcacgtaagttatttcattctagaattgaagtgttttgttttttgtttttttgagacagtgtggtctcactctgtcacccaggctggagtgcagtggcatgatcatagctcactgcagcctcgacctcccaggctgaagcgatccttccacctcagcctcttgaatagctgggaccacaggcgaggggcaccaggcccagatatttggtttgtctgttttttgtaaagataaggtctcccaatgttgcccaggctggtctggaactcctgggctcaagcaatactcccatctaggcctcccaaagtgctgggatt

SEQ ID NO: 6370 - DNA, 1211 bp, Homo sapiens
aacacaaactatagcagggtagataatagtttattgattatattttgttttagtaaaagtatttaattttaaattctgtgtaatttatctaatttgtatttattcatttgttatttttatgttgtaattaacacttatttacctggattaccctaaaaaaattaagctcttgaaaacaaaaaaatgacattaccttgacaggcttctctttgccaaaagtaatgtatgttctgccaagaagcaaatgagaatgttagactaagtttctcctgtgttagtggaaaacaagtgtgtctatctttaaatattctttgaatcaggagtttgcgttgtgtcacatcatatggctttgcagatcttttaaaaactgatgttaaataacttataagtccaacttcttaatatcaagataaatgaatagttcaccaatttgggaaggagggcgggttgcaatttgagatagtttaaggtttaattattgaaagactgccatcttgtggcaccaaaaggtaatttttacatgattatttgtatagtgataagcagtcctgctgtgttagcctggtccattatagatatggcatagttttgggttctctaaatgggtccatacctcttttgggaaaaaacagggccacctcataatatttgcctgattatgaatggaattaccttagaaataaggaactaatcagattacttaaccccaatgacaaaatccacaaaaattttgaaggcagagaaacagaaggaatccagtgatgttttagctccattagtctaataggtcagatattaaaaaattgttcatatcaaaattaccttatatggattattgccatgttttttgagagttaattatttactgttttctaattcttgccagtatttatgaacagctgtagcttgatatttacctactgaattttaggagaactaatggtcacagtttgggttcttttatgtgtatgtttttaaaacagctattttgtgaatctaggtggttggtttttagaagatttcaggagatgcagtccagcacaattagagctggaacattgttacagcaggctttttgttgctcatgggcagatagagggaaagaatcagttgttagccccaaatttccacatttcagtgttgtaaactctgaatgtgataggtagatgtgggctaagaataatttcctccagtgaagacacgggagaaga

SEQ ID NO: 6371 - DNA, 1289 bp, Homo sapiens
gtaggcaaaccatttacaagttgggtttttgttttgattaacctgttaagagacacttttgtaatctctagtgtttacattcctttatactagctatctataaagagaatccagaaggctaaattaatcagaaataattatatttctatgtcagggtattggctatatgtagcatgaacaattctccattttctgcaaatgggtttttcaggacagttttataattctgagtttgctttttcttattccctagacagtttgtactcagggaatacaaattgatttttactgttaaatgagacatagtttagaaaaaatcataagcaactattgtagatttttgatctgtttggatttatctgtagcattgaataatgtgcagtgtactgagttaatgtaggcacctcactttggatttataaaatgtaaaaacctggaacatgcctgccacagacaccactttgtctattcaccgggtactaatttacatcctattaatggttgtaaaagctgagtgtctaaatgctagacatgttcacaattttgtctgtttttgtttatttgtttttaagacccaaaccttttcaatcttgcatttatttacttggttctcctgtgtcaccctgtggctttttaaatagggaatgtaatttattttaatagtagttctcaaagactctattaaaaactctggacgagggatatgtgcaatctgttggtaagtcacatcctatgtttggcctcatttttataactcctaaaatgagaaaggtagattttaacacttctaaggtacctttgagctttaaagttcttttctgcttttccatatgatttgtgttagtgttcactttttatatatttagagtttttatatgagtgtgaatgtttctgttttgatttggtgaggcatgtcagaggtatatacttgaatatttttctaaatacagctgctggaggaatgcaaatggcaaaaatcatccagaaaaccaaacacggtgaaacatcacatccatttggcatgaagcaaagcattacaaatttggagtgatgaaagtgttccatatattttttatagtgatttttcgatctagagacccttcatattgtttacttactattacgataactttgagaggtaaccagagaaagcatttttgccatttccagatgaggaagcaggaccagaaagctcttcataaagctttaacaccatacaagtatccagcagtgatcaattgctctttataggaaaccacctttcctctggggaagaacagtctgaatta

SEQ ID NO: 6372 - DNA, 1141 bp, Homo sapiens
acttttttgaataatacgtagaattttgacaaggttcatacagtgcatacagtgtgaccttttctgaggtgggcagggagggttgctacgttgtgttgatttaaaatttcaaggaggaacaaaaacattctagccaaggagaattgcattgttatttttttttctactaatttaaacgtgcatttttcacagttacacatttaagttttgctaccaaaaatggccatttttctagacagataacattttcctaaagtggaagagagatccactgttctaaaaaaaaaaaaaaaaaaaaacactaaattgtgccttctcccttaaattataagaagagtaatagtaaaaacttgtttaaactatattttctttttttctaatccctctcagttctccttagatctgcctcctacaaatgatcatgttgtttgcatctgcctgattgagttcccttggtcaaacctctccctatcactatcagaagttgttcactaaatgtattttcctatttctttcatgttgattgactttataagtcaccttggtaaacataacatttggctaccttctcatgctttataaatgaatttgatgaatggcagtttttatattttaaccctttaaaaagtttgtcaaggaaacaactcagagctaagaacaaaatctaacttggaatcagtttcttcctttggctgctgaagcagcagcaagtcacgtaacctcatttagttttttgatttacaaaatgtggataataacctacctcacagatgtgtgtgagcaactgtttgaaagcccttgtttaaatacagggtttatatccccacattcaatgtaaattcctttttttaaaaaaaataagtatctttgatactgataggatgagtatcttgatttttaggtaagatcacagtttcacaaattgtggtgttgttaggtgacatttaatatttcttgagacctcaagtattcaaatatcaaacttgtcctgtgttgtaacaaatattcagaatctcttaaaatgttggctgaagctgccttaatgtaccaaaatacagctctcaagactgttcacaaatatctgtggttgtacaatgttttgaacatttaatgtaaagttgttgtagaactgtgaactcta

SEQ ID NO: 6373 - DNA, 1153 bp, Homo sapiens
ctatataattgtttaactctgagacttttacctcttcctcaaaggtctaaggtgaaggaatccaaaattgattaaatgcctaagatgggacaagtgtctttagatatgttattaattcttcaatactatcttatacatatatttataatgatactcttctgattgttgtatcattacctgtttgtcttcctcttagactatgagctattcatttatctctgtattggtgatttttgctgtggtagtaacagatatcccagaatttcaataattctgcaggtcggatgcagctctgtttagttctcttccaaaagtctgctcatgccagaaatccaggctctgggagcagccccatctgggctatgtgattctcatgtcagagggcagaaatacagaagtcttaactgaatgacatatgtatacagtttctgctcagttttgtgtacattatgtctactcatattccagtggccaaaggaaaaaaaaaagtctcatggcaaacccgacaatggagcacagaatattctccatctaccttagatattggcagtgacatggcaaaggatgcagatgaacaatccttttattggaaggacacagatattgggaaccataatgcaatatgttaccatctggttgctcctagaactgcatttttatatgaggaaactgaagtgtagagatgttacatacatatgtggtcatatttatgtgatctgagctagttatctgattccacgtccatgctctttctcattttcagcttcatctctttctgctctaaaacatagactgtcttcttgggacatgctgagttttatgtcattcatccagacactgagtacattcatgtatttgtgactcagtatttgatattacatctgtaattgcagtttcttctttcaatactacctaatgctctttatttttttgtctgaaagctttacttgtttttcttaggctaggagggatgccatttctcagtgttctgtggtgtcctctgttccctcacagtgcttatctctctgcattttaattgtgtgttaaaggggggcctctctcctaactagactggacatttctggaaggctgcgggaggggctgctttttacctatgggtccttacataataggcgacatataaaaagtattg

SEQ ID NO: 6374 - DNA, 1168 bp, Homo sapiens
agaatgaaattttgatgtcaatctattcataaaaaaacttagtattagaatttattcctttgtaagaaaccacattgtctttgcatgaataattcagatttgagaaatttcagtgcttaatatatgcagatttttatataattaaaacttaaaatgttcaataataagtagccatataactttccatgaagcagagtaagcattttgtagtgctcttttaaaataagaagtaatttttaatctttcagtggatggaagaatttaaaaatgatatgctaactgagaaagatgcccgatacctggctgttaaagaagtgctttgtcatctaattgaatgcaataaagatgttccagggatctctcagatcaattgggttattcatgtggttgattccccaattattaatgccttcgtgcttccagtaagtaaatgttctcaaacgcattgtaattgttaaatttattgtccttattttttatgatgttctaattgcttacattattttctttgtggtgcagaatggacaaatgtttgttttcactggatttttaaatagtgtaaccgatattcatcaactttctttccttctgggccatgaaatagcacatgcagtacttgggcatgctgtaagtacctaaaatgaatgttcaggtttggaaaaactgctttgaagttaacaagttaaatcttttaaagaactgatttttttcaggttttttaaaaatgatagacttttagttttgggtaattgccttaatctgctacctgaaaaaaacgtgattggctaattttgagaatttttatggtctttagtatttgatactgaataatatttttcttaaatactatttttatcacctgtctcttttgctaaaacgtaattattctcaacccctaattatttcaaattaaattttaaactttctataattattaatatacttgtaatctagtcagaaaattaattgtagggaagtgatattactatttaagtgggtaaatcatctttcttttttattcattctcagaggatagcttggagcatctttgaaaatgtctagaatgatgtgtcatgtgtaattaatacagagtaataacaataccttgccattttacagtttactgagctttttagtatatgtggcttcccattcataattttaatac

SEQ ID NO: 6375 - DNA, 1354 bp, Homo sapiens
gtgcattttataagttagattttactattctgtatcacatgcttccttccagttattgcaaactgataaagttttactgttgtttttatctaatccactttattgctcaaatcatttgccattaaaatacaaatggctcttccctaactaaaaattaaaaatgaaatgaaaaaaattcaagcttctaaagtaaacgttgcatagtaaatatcgtggtatatatactctggtttatcttgctgaaaggcgttgctctaggggtgatgagttgaaacccaaggtaatttagcctgagatgtgttagaagaacaactgacacgcctatttaataagtgttatagtcccagtttggtaagtaaatattttccacagatatttatagttttttttttgtttcaggtagtcaagtgaaaaaatgagcttcatctgtggattgcagtctgctgctagaaaccatgttttcttccgatttaattcactgtctaactggagaaaatgtaacacattagcatccacctcacggggctgtcatcaagtacaagttaaccatatagtaaataagtatcagggactgggagtaaatcagtgtgacaggtggagttttctgcctggaaactttcatttttatagtacttttaacaacaaaagaacaggaggcctctcaagtaccaaaagtaaggaaatttggaggattaccagcaaatgtactgtatggaatgatgctttttcaagacagctgctaataaaagaagttacagcagtccctagtctgtcagtattgcatcctctaagccctgcttccataagagctattaggaatttccatacttctccacggtttcaagctgctccggttcctctcttgttgatgattcttaaaccagtacagaagttatttgcaatcattgtaggcaggtaaaatgcttttttagaataaaaacttttatattaactttttgcattaatattttgtgctaacgtattaacttttagaaattaatttttttatttataaaactgtacttttaaagaaaccttgccagatcccctgtctccccccatttagctcaaagtgaagtttctaaacagtaggtcctgcccaattttgttctgtatgatttaataatcttgaaacaatttcctgcatactaatttatggtatagaaatatctctttaaaaagttattcttacattttgtataggcattaaaaaaatcttatatttatgactacaaaatcttaggatatatggatcagaagtgctggttatcacttatgtataagaagagtacttacaaacatttctttttaatttgtggaatttaaggcagcaaatcataaaattgaggaactt

SEQ ID NO: 6376 - DNA, 4018 bp, Homo sapiens
gtgtgtgtgtgtgtgtgtgtgtgtgtgtgtgtgtgttttacagccctttaaaatgataaaaaccattgttaactcacaggcctcataaaacataggctgttggctattattctccaacccttgatctagagaattttaaacattagaattttgttttacatttgttaagctttacgtcatcttcaaatgacaccaaaactcagaattatgatctgcatttaagccaattttaaaataaaataagcagtcaatgctgcctcatttattgaaattcagtagattttagtttatttcttagtagtcagagaattgatttatagctattcaccaaacattcttactaacgtttccttatatctaaatcagattgattctatattttgctttgtttgtaatcaatagccaatgaagaataaggagtattggaagaagcagtgagtcagctttaggtgacctggttcttgtctcaactttgtgatttggggagatacagtttactttccctgagccttaattcttgtgtaactgaagtctaacttaacttcttaatgtccttccagaactaaaattttattgttcattctaatcgttggactactcttgtgaagtttatattttgagttaatacagtttccaaattaacatacatttaaaaaaaaaagggtagtatttttccatttctctgtgtgcacttaggataaacagtgaagtatagcttataaaacaattagtttgagggctgagagtgtaagaggaactataccaaaagtcaggaaacctgagctcttaccctaactctgttaccaactttgctgtgtgaccttaatcaaaacacataacctggaccccatgctcctcaccagtaaatcaagggcctgaattttatggcttagtattcccttccaagctccgaagttgcgtgattctgtgaaaggcagtgattgattcctttgtactcatcttccttttgacctgtttcctcatgatatattggggaacaaatactaaaaagtgttttatactagctttcttgattgacatttccctataatactgatgaatttgggtgatggaaagtaatggaaattgttaaaagttctgctctcaaatctgagtctccttgccctgtgtgccaatgtttaaccatatttgctaatctaagccatattgcgaggatctcaaggatgatacttgtcaagagtttggggccttgagagcacagttttcaaaataatacttagtattttctgactatagagtacatttgtcttgtaaagtatattttaaaatacagagaagtgtgaagtacaaatatctcagtgctactatttaaaaaaacacaattagtatataaatccttccccatttttttgacagtataattttagtatgttaaacttggttacttctttctctcttcctccatcattttccctgcttcctttttcttttgtcatattcttaaaacaattttgcaaccacaggtacccacattgctggcactaccagccttgggctactaccgaggataatggagccagggccttgtagaagcacagaggaagtctagaactgagggggcctatgatacaggaagttcaggaggcagagtctcaaaggaacacctgcctttaataatgtttacagaagtggagaaaggactaaaggacttaaagacatgcaggtgtcttcatcctgattctgtctttgttattgcacaatgactataaaataatgacctaatttttttttttttctggcttggctaatggaaatcgacactagcgcttccccagtattagacttaatctaattccaaagtaacattcaagaaaagaaaaaccagtggaacaggatcagtaagctcagactctccatctccattattttagccttgaccattcttctctaatccttttaaattatcttcagtttccagttcaagttacattgcttcagttacagtttgtttgaccctgtattcagagctgcattatgattcttgtgggccctagatagttttgccatcttagaccccttcttccatacaaaattaaaagtgatattttacaattgtatctgtatgaaatgaatgtattaatattttagattaaaacattttgtttagaagttcagttttttcttatgaggctaaaaaaaattaaaacatttttgtgggcttctaaaaaactgtgggccttaggtactgtgcctaatggataagttggcattgcctgtattctgaagggcatcattggaaaaatagcagtcattattctgtccccttctcccaccaccacagtccttggagaagcctttgccactccatccaggagcactgcagtttccacggttatagatctatagacttgaacttacttccttcccaacctaacgaaaactcacaaggattacttgggaccattcatcctcaaaaaagataggaggcagtggtttgttttagtcttcagatatttttgttttggtcagtccctaatctgtagttttgaaactcgtgccacacttgaaagggaaacatcctactacctttctttcctctccatttcccacaaaccctttccttcatcatcactccctgcattcttacttctcagcatataaatacaagacccttctttctattatttgttgaaagctaggcctgtaaaatagagatggacagaccatgcatgtttccatgaagctatttaatgctgctcccagtcttctgtccataccattccttccctgcccctaggagtggggttgaggtctgtgacatgcagactgtaagcacagtcagaacctctgcagctctcaacccaacagaggagactgtggcttcaacatgccaacctgagcaggtctcctctgcattaccttcctcccatttctcttcctgggtcctgatgaggtgagctggaggaaccaatagtcaggatgccctggaattgatgttgctctgttttgtgctcacaaaacagccatgtaacacatgagcacctgagttgaagccatccagtcgcaagtcagcagacagcagttgatggaattctcagtagaaattcagtaagggtgcccaaattttattttttttttcacctatactctaccaatatatggtatttaggaaaacttcttttatccaagcacaaagaaaagcacacacatttttataatcatctgcttcatcagggtaaataaataatttaacaaatttgatcagcatctctagtttaccagtactttaatattagttttcttacaaattaatgtattttgcaatatttccagaaaatcactgtgggagaataatgtaatatactttaggatatatttcctgaccttttcttaaatggcttcatgtgctattcccccaaattctgctttctctattttcttttttatttaacctataattatactttctagtatattctgagtctatcttctaagccaccttacatttttcctggaacaagggagggaataaatagttgcctccactaaatcaggaaaaaataaaaatatcccaggggagctgtgattatgccaagagctctaaacagaagtttgagaaggtaaaaattaagttgtagtatctgagttgtttttattttcttcctttggtgtttatgaaggtattcataagaactttaatttcaggggaaaaaaatgcctgatttgctatttttgacatttcctcgtctcttaagaagtcagttaaatatgttttcatagtttatattcctgtttcatagattactgtgaaacatgtatttaaacctatgaattataaaatagtatttagattctagcgtgagttaaatagattagtcatatatcttttagatttgtggatttgacatgtaaattatgtgttgtgtataagtaagttagttactaaacatatggcatggttattgataaacttgttgctatttttttccaaatgctatcagtgtttgtggacttttaaaaattagtttgaattttggaatgttctgtgataaaatgt

SEQ ID NO: 6377 - DNA, 1184 bp, Homo sapiens
aagctcttagaagctcaggagggcccgggcgcggtggctcacgcctgtaatctcagagctttgggaggccgaggcgggcggatcacctgaggtcgggaggtcgggagttcgagaccagctgggcaacatggtgaaaccctgtatctactaaaaatacaaaaattagccgggcgtggtggcgcatgcctgtaatcccagctacttgggaggctgaggcaggagaatcgcttgaacccgggaggtggaggttgcagtgagctgagatacgcgccattgcacccaagcctgggcaacaagagtgaaactccctctcaaaaaaaaaaagctcaggcgtgggccacttcccaaggtctctacatgtcaacaagttagaaaggaccaagccccaggcctctgggggcgcctttgctctggaaaccccgcctcccggcacgggaggggccggacgacgcttcaatcccgccccgtgacgcgttaggccctgcccccgggccatcttcgtctcgcgggatctctcgggaggacggacggggtcaggtcccatcatggcggctgaagaggcggatgtggatatcgaaggggacgtggtagcggcggcgggggcacagccagggtgaggcttagagaccgggtctctctggggcggagaggggagtggattgaaggagcgggccctgggaaagctgcaggtccggcaagggaaaagggaacagaagactgtcccctgggccagggtctcttgttggcctgggaggcacctcgcccgccggcttgtcccaagcccagcgggcagggcggttacctggagctcaggtactcctgggtcgctttcaccttttgccggatgctgtgagggcaccgatttcgcctaccacattgcgtttgatttacatttagattccttcttccgttccctccttttcaggatctcatcgacagtaactagaacaagagcggctacggacgagacctgaggtcagggactcttgttctatggcttgctagccgtgtgaccttgggcgagtcgtttcatcccttcttccacatggggatagttgtaaaacttcccgagaagcaggttgacttaaatgggccaggttttagagttggacagttctgggttttccttctgcatttgctcgccctaccagttaatagcaatgtgaccttgggcaagacactta

SEQ ID NO: 6378 - DNA, 1617 bp, Homo sapiens
agatgaggaattaggctggccatcttttcctgtaaaggaacagatagtaaatattttagaattgaatgaccataaactatgtcataactcctcagctctacaattatagcatgaaaacagccatagatcatatgtaaattaatggaaatagctgtttcaataaatctttatttaatgaacaggcaagctagatttgtcctgtgaaccatggttttctgaccactgagatagatcaatagaagctatctaatctgaaaaatacagaaaagtaactgaaaaacaataagcagtctcagggacaagtggcctgatatcacaagatgtaacattcatgtcatcagagtgaaatgacagaatgatagaaaagagaagaaagagattagtattagaaaaatatttgaagaaatcacggctaaaacttctcagattcgggggaattcatgtggaggtcaaagtggaaacaggtgtgagaggtccagcagaagaaaacatggctgccaaagtgtttgagtccataggcaagtttggcctggtctaagctgttgcaggaggcgtggtgaactctgccttatataatgtggatgctgggcacagagctgtcatccttgaccgattccgtggagtacaggaaattgtggtaggggaagggactcactttctcatcctctgggtacagaaaccagttatctttgactgccattcttgaccacgtaatgtgtcagtcatcactggtagcaaagatttacagaatgtcaacatcacactgcacatccccttccagcccgtcgctagccagcttcctcgcatcttcaccagcatcggagaggactatgatgagcctgtgctgccatccatcacaactgagatgctcaagtcagtggtggtttgctttgatgctggagaactaatcacccagagagagctggtctccaggcaggtgagcgacaaccttacggagtgagcagccacctttaggctcatcctggacgacgtgtccttgacatatctgaccttcaggaaggacttcacagaagcagtgggagccaaacaggtggctcagcaggaagcagaaagggccagatttgtgatggaaaaggctaagcagcagaaaaaggcagctatcatctctgctgagggtgactccaaggcagctgagctgattgccaactcactggccactgcaggggacggcctgatcgagctgcgcaagctgtaagctgcggaggacatcgcctaccagctctcacgctctcagaacatcacctacctgccagcggggcagtccgtgctcctccagctgccccagtgagggcccaccttgcctgcacctccacaggctgactggaccacagccctgatgatatttaacatcgacttccttctgcccccaccccagaaatcactgtgaaatttcatgattggcttaaagtgacggaattaaaggtaaaatcacttcagatctcaaaaaaaagaaaaattctcagatttgatgaaagtcatagatttacagctttaaaaagctcaagaaaccccaaacaagataaattcaaagtaaaatacaccaagacacatgatgaaactgaatacaatgaaaaacatcttgaaagaaaccagaaa

SEQ ID NO: 6379 - DNA, 3835 bp, Homo sapiens
aacggcacatcaccaacaccagaagaaatctctctgttaaagtccctgctacaacatctgattaaactgcaaaaaaaacaaaacaaaacaaaaaaaccacataaaatagaagtgtccttaaaatattttgtacctttcaactaactaccagattgaaaaagagtttatgatgcgggatatcaggtattttaaaatcaacatgcatcaaattaattttgccagttgactttaaaaacaaattatagaattagccatctctctgagggagcacatttgaataattggagatgcagttatacacacatttcaaacaaacatttgtcttttgagagtattataatttcaaattggccttgtatattttagttaaatgttttcagttgtattagtaacttaattaattttcaatagctattcagtaatacttaatcttagaacattaattggatttgtttaatctttttttgttttttgttgatttatatgaaaacagtcttgaggcagggacatggagaactatgcaagggtgatttctttgacttaatatatacaaggctttacttctgtcccctaattcttccattgaatgtgtacctctaccttgtcatgtcatggaagatacaacatttggaagatctgacaattggaatgactttggaataataaaattgactaattggaaattttgcatattctgaaaatctaatctcatagttctaatttgtacctatggcaaataagggcttctggacatcatgtttaaaatgttaagcataagaaataaactgacatttgtaataggtgactttctgatggaaagcaagctatatatatatatatatatatatatatatatatatatatactttttgtgaaatgtctatatactttttaaggtaattaatgaagatttcagttattgcttttaagcataaagttgtatttagcttctgctgaaaaattgtatcatataataattttgcttcattgaaaagggatgttgcagtgatgaaacaaggtgggatcagtttgattttgtttacttattaaggagtttatcttgggctcagtttgtggtattcagttcgtttctgcccaaagctcttattttcagaggtgttacttttgaacttttggggtcatttttaaaagttagcacttttgaattttagttgtgttaaatatgtgctgtcgtatatcatagccatgagccatatatgacaatttaaatttaattaattataaactcagtctcttggttgcaccagccacatttcagatgctcaatagccacatgtggctagtgggtaccatattggacagggcagctatagaatatttccatcattgcagaaagttctattggatagtaccataatctttttatagtaacttggaaatactatttgatattagatgttagaccacaaaaagaagaaaaatgttaggactatttcagatataaaaaggaactgaattgtgacataattagcatcttacattccatacagttgaataccttatgctgtgacaaccatagttaatcatttcagtgctgttcaacatacatacctatcagcagtgtgtttagaccaggggtctgcaaactttctgtgaatggacaaagagtaaatactttagtaaatgtcttaggctttgtggcctacatgatctttgttgcaagtactcaactctgccattatagagttaaagcagccatacacaatatataaacaaaatgggcatagttgtatttcagtaaaactttatttacaaagacaggcggtaggccagatttggcttgcatgctgtagagctgtggtctaaattttattcatagactttctttgcaaatacagtgtgagtattgttccatttacagtattattattttttagatacctggtttttagattcttgcctggtaactttttactgaaaatacaagaatttcgtactgcatttgcatctccgagattagggagcacctgtcaggatatgttgttctatcagggttacttctgttgactacctcttagattttgatacagttatattgttgagtttcattttcatatattcttgtagtgtctgcttgcctgtgacttctggtaaaataaaataagcctttgaaaatattttagcatggtatttaacattttctaaatattatggcattttgacatattttagtcagcgaagacatctgcccctttggtgtttctacttgcttatgattgagattttacaagcccttcaaactccgttttaaaggaatttattgtaaaacattaactttaataaattagtgttttcacagatcagatcattatacttggaacttctaaatcatgcaatttctgaataaggacataaggctagattcatttttcttaatagagaaaaaggaaatttctgatttatcacttttctagttgataagtaggattcaaaacgtttgatatgtaagtatttatataagactaatgtaatttaaagttctgtattattgtgattaatcatacagaaattcaggaactgatcagaagtgagattcttttccacatctggttaatgtagtgagttgacaccctgtgggtggtaaagcattataaacatttcatcttgaaccatgatttatacacatctgtgttataagggaggcttgagtacatataccaatgaagagatattcagcatttgtctatttgataaggaattaaatgtcctagtgattataaagtaaaaccacagaccaatttgcaaatgatcttcaatgttaagcacttgctctaagattaaaattccttttctttttaaggttaagggtgtgtacgtatggcagtgatgtctatgttgagattaacttatgtattgaggaaaatttgaagtttattttttcgatgaataaggctgtcaaatgatttagtatagattaatgacatcttttttagaaatattaaagtgagtattcctcattatgtcatcatttctgataattagagtgctaatttgaatgttagataatgtttccacatctatacctatttctttctagggcacttctgaccctggggcttggggatggcctttaggccacagtagtgtctgtgttaagttcactaaatgtgtatttaatgagaaacattcctatgtaaaaatgtgtgtatgtgaacgtatgcatacatttttattgtgcacctgtacattgtgaagaagtagtttggaaatttgtaaagcacaaaccataaaagagtgtggagttattaaatgatgtagcacaaatgtaatgtttagcttataaaaggtcctttctattttctatggcaaagactttgacacttgaaaaataaaaccaatatttgatttatttttgtaagtatttaggatattattttaaataaatgattgtccattatcaatataatagttgtgaaatgatttaagtaaataaactttatgcttctgtgtctgttgattttgatgggtttttagtgggcataaatgcatgtttatttgctgcattaaatagaggagtgaaaatatgtaggtttgtaaagaaaaagtaattgcattcttctaattttgtttttccttttaattttttggggaatgaaaagatatattaaatgatttgggaatatgtctttttatgtctccattttcacctctggaacctagacatcttgcattaacacggaatcaaaacatttctggggccgggcgtggtggctatgcctgtaattccagcactttgggaggccgaggcaggcaggtcacttgaggtcaggagtttgagaacagccttgccaacacggcaaaaccccgtctctac

SEQ ID NO: 6380 - DNA, 1106 bp, Homo sapiens
ttccctttagttatttggttggggactctgggaagaaaaagttggtgaaacaccaggtggtgcacaaaacccaggaggaagaggaaacagctgtgcccacaagtcaaggaactggcacaccctgtctgaccttatgtttggcctctccctcaaagtcactagagatgagtcatgatgagcataaaaagcattcacatacaaatttgagtatttcaacaggagtcaccaaacttaagaaaacagaagaaaagaaacacagaactctgcacacagaagaactaacatccaaagaagcagacttaacagaggaaacagaagaaaacttgagaagtagtgtgattaatagcatcagagagataaaagaggagattggaaatttgaaaagttcccattcaggtgtcttggaaattgaaaattcagtagatgatctgagtagcagaatggacatacttgaagaaagaatagacagtctagaagatcaaattgaagaattctctaaggatacaatgcaaatgaccaaacagataattagtaaagaaaggcaaagagatatagaggagagatctagaagttgcaacattcgtttgataggaattccagaaaaggagagttatgagaatagggcagaggacataattaaagaaataattgatgaaaactttgcagaactaaagaaaggttcaagtcttgagattgtcagtgcttgtcgagtacctagtaaaattgatgaaaagagactgactcctagacacatcttggtgaaattttggaattctagtgataaagagaaaataataagggcttctagagagagaagagaaattacctaccaaggaacaagaatcaggttgacagcagacttatcactggacacactggatgctagaagtaaatggagcaatgtcttcaaagttctgctggaaaaaggctttaatcctagaatcctatatccagccaaaatggcatttgattttaggggtaaaacaaaggtatttcttagtattgaagaatttagagattatgttttgcatatgcccaccttgagagaattactggggaataatataccttagcacgccagggtgactacaaacaatatgctttcc

SEQ ID NO: 6381 - DNA, 1617 bp, Homo sapiens
atgagctatacaacaaagcctctaatcctgataaggttgctagtacagcgtttgctgaaaatagaaattctgagactagtgatactactgggacccatgaatctgatagaaacaaggaatccagtgaccaaacaggcattaatattagtggatttgagaacaaaatttcatacgtagtgcaaagcttaaaggagtatgaggggaagtggttgctttttgatgattctgaagtcaaagttactgaagagaaggactttctgaattctctttccccttctacatctcctacttctactccttacttgctattttataagaaattatagagtgagtgtattttccttgtgtatatattaaacacacccatacaaacattggtaaagttgattacatcaaagaatctttagcttatcttttgaagctactggatattattggtctctctaggtttttatataaatagtgaaatttgaattactgaaaaccatgttaatttttagaactcattttcctcagtagagactagtgatgcattagcttctgggaacaaacttgtatcggttcttaattaaattatccaaaacggaggcatttaaacacttggatttacaccagtcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatgtatatgaatatttgaattttttacttgtatatttttataaatacagctgagttttcttaaagcgaataagtgtgtgtatatatatatgtatatatatgagagaataagcatgcataattacctttattactgaatactttctgacagtgcaggagtttttcaaagaggagaaattgtgcttagtccagccaagctgtcatacttaaaagaggtttataatgaaatctgttgcatctaattgtcctttaaagtagacatgatttaatggaatccaaaactggaaaagttaagatgatgctttgggcacacataaaaacttggttaaaatttcattttaaactagtatactgaagtggtaagtgatgaatgatttcatgacttgttaatggacattcttggtactaagtttttcctagaaatgattctaaatatgtaaatgctattggggtaacactttaataccccatttcaacaaggagtaccttctcaattaaaaaaaaatcgcagtaggctgggcgcggtggctcacgcctg

SEQ ID NO: 6382 - DNA, 1249 bp, Homo sapiens
gcttgctgcattggtggattagcggcttggggtggcgaacaggtgggaaaaagggatggataaagtaagcatagcagaggcctttacgccgctgctatcgctactgccaatcgcaaggctttcgtatcccggaagtggctgatctgttggatttgacgcggaggcggttcctcttactacggtggccggggtgctcaaagtacctgtagctgcggcgctgaggtcggaacgtctgcgtgtgtgcgggctggttttgtggcggctgctgctagagctggagcatttgccgggttggtggctcctgcacatttttacagttctccagtccttctctttcggtgagggatcggcttgaggctaaaggagtcaagaagtttgggacttagcgtctctggtccccgaatgactgggtttcttgcgggggtccgccttcagtgaagaccctgtggccaaccatctgggttctctgagggttttggcgccttccttgtctctcctttctagtgtcatttgtcttctaactcttcctcgctttgtcctgggttgcagagataaaccgtaagcctaactgtgggcagctgttcctcctttccttgtggttttcttagatgttgcaggcaagactctttcccctgatctatcgcatccatttgacccctcctcatgccagtgctctgtcggccctgtttttcctcgtttaaaaaataaaaaaagggaaataataataataactggatccccactgtctctctgttctcattcctagcctctttctccctttttggtgtttgttactgcttcaagccataacacactgccttgcatatattaatgcctttccatctaaatattaacgttcattcacttcatttggttcccgctcaccgtgaactctcccaaccctacccacatctaagggcttttgaggttggaggtgtagaataaattcttacatatgatgactatattcatatatgagaaccttcagcggtcaactcagcatcactgcttattgagtttatatttcttgtgatttctttggcttaccttttcgttttgtattggttatttacccacatggggctcactgctaccctatagttacagaagaatacctcgtcttacatctttttatatccgaattacttaggagttttcttatgttttcctgctcggaccatatgtccccggtgggtttttggcaatgattttgtgtcagttgatggcagaaagagacaagggaatgatc

SEQ ID NO: 6383 - DNA, 1186 bp, Homo sapiens
gaaaggtgtttttgctgcatataggattctgagttaatgattttttttcttcactactttgaagatgttgctgcactatcttcttcttttgtttccagtgagaaatctaatatcgtccttgtctgtgtcccctcttcaaagagttaattatgtatagaatataggatattattattaataacaagagtattgttgataataccttatattagttaactctacagtatgtaaaacatttcagcattcattctaacttgattttcataggcagtcaggaaaatctaacttgattttcatatctttattttaaaagataaaattagaaaaaaaggattggaaagattgtgacatacttcacatcttaagacagtaatgataatgtttgttaccattatagacatttctctggttatctttagaccgtatgtttattttttagatgaagataaaacgttacctgcagagtcgggatgtacaatagaggatcacgtaattgcaggaaatgtagaagaatttcgtaaagatttcatttctagaatatggctgacctacagggaagaattccctcaaatagaaggctcagctttgacaacagactgtgggtggggctgcacattgagaactggccagatgctcttggctcaaggactcatactacactttcttggtagaggtaaatcaaatttctgtttttgttttgttttgttttgtttttttgtcgtcgatatttttccatttgaattccagcttacaaactgcatgaaattccctgaggttaatttcttgactgtgagattttctaaggagttgtaactaatttggtgtattgcattttttttgaactgggtcagatatgacttatatgtaaacttccctgattcccttttcaaaaatgcaggttaaatatacctgttattcttggtcaccattatgagttaagttagttcaatttttagtaccctttggattttattgttcttactgtttctttccttttggttgaactctggattatctccagtttagttaagtcctgggcaggttagtaacagtgattttgaggacatatgtaatatttttaaaattttaagagactttactctggtttctttattttctccctacatgtcaataatggtttaaaagtatttttatctttattagtgtgattatactcaattatatt

SEQ ID NO: 6384 - DNA, 1388 bp, Homo sapiens
cggcccgggcctgcagctgcagctcaatagcctgggcgccgccgcggccgctgcgggcacagcgggcgccgcgggcaccaccgcgtcgctcatcaagtccgagccaagcgcgcggccgtcgttcagcatcgagaacatcataggtgggggccccgcggctcctgggggctcggcggtgggcgctggggtcgccggcggcactgggggttcagggggcggcagcacggcgcagtcgtttctgcggccacccgggaccgtgcagtcggcagcgctcatggccacccaccaaccgctgtcgctgagccggacgactgccaccatcgcgcccattcttagcgtgccactctccggacagtttctgcagcccgcagcctcggccgccgccgctgctgcggccgccgctcaagccaaatggccggcgcaatagggacgcgccaatggccgggacccagggtccggcggcggcctcgagcaacaaatgcacctccaggctgcgcgccctgtcccaagcccggtcccggtcccgctgcccaatcctggactctgcctctccccaatttcctttcccctgagcccccaacgcctaccttccgcggcctccatcccctcgcgcacacctaagctggtcgagcaaactcaccgcgcgcccgccggggatagctttccatacaggtaaaaccgaaaaccgaattttccaaaaatgcaccccgacggcgcctgctcttagtaccgtggggatgggagggaaattctttgtatatatttgtaaaaaaattattgactttccttttggggtttttatttttttaagaaaaaacaaattccgtagatttagagctctgaactttcattttttttgaaggttcactctccgaagttttatctgagaaaagaatgtatagagacgttgggagattttaaatataaaaaattttcaaaaaggcaaaaagtgtcattctattataaaagtctgtttatatatgaatgaatatatatggtattctaaatgttattccatcgtgttgtacacaactttgtaaataaatttttaaaatgcccagcctagtgttttatttagttgtctgaagtaaatggcaagatttttaaatggtatttatttgccttttctcctccccagaaaatcaaggaatttcaagtaatggccttttcaaactttttaaattcataatttgagtgtaagaaaattttaattggagaaaggaaatagtatgcctaatttaaattgtgttactatttttcttttagttttcacataaaatcaggatgtgagtgatatcattcatatcaacccattaaatctaaatgaccagacatttctgtagataaagtaagctgtcatttaaaaaaagaaaccgaaacaacagcag

SEQ ID NO: 6385 - DNA, 1162 bp, Homo sapiens
tttatctgatccttttcttaagctacttgtttgtatgatagagaaaaaaagttccattaacggcatactggaagcagcagttttccaattattatgaggagttgacacctctgtgcctgtgtctaggctaatttagtctggactgttaacaaaatgaatcagtagtccatatgaagaccttcctggctgtttttaagctaccgctgaaaatcagacagataaaatgtatttatattttttacaattaggagttgaagttatattctgtaatattaaaatatttttttctttacgattttagaccagtctgcttagttttaagtgaaattccttttatgtctacttggtttttacttgtgtcaacatttaggtaagtcatatcaatttccatatattttcagtataattcttgtaaactaatttaaaacttttttatgaagtggttatggtttgaattgataattctcttgtgatttttaaaaattttcctttacagtatgctacctcttctattgaaggatgaactcctaatgccctctgttgtgacaacaatggcattttttatagcttgtgtaacttccttttcaatatttgaaaagacttctgaagaagaactgcagttgaaatccttttccatttctgtgaggaaatatcttccatgttttacatttctttccagaattatacaatatttggtaagttcaatttttaagaaatgacacatttttcagcatgtcactattttaaaaaattattgaagtagtgattttcttttatacctttttgagatataattcacataaatccactcatttaaagtatacaacttagtggttttaagtatgtaaacagatttgcacaactatcaccatcatctaattttacattattttgtcactcccagaagaaattctgtacccattagcattcattcccaattctattctcactcctaactcccttccttggacagccagtttctgcctctttagatttgcctactttggacattgcatataaatggaatgtattagtctgtgatagctgccataacaaaatacaacagaaatttattttcttacagttctagagactaaaagttcaagatcaagatcaaggttctaccatcagggttggtttctggtgaggcctctcttcctgg

SEQ ID NO: 6386 - DNA, 1198 bp, Homo sapiens
aactgggctctatctacatctgccttcctgggccaaacatttataagcatcagtgagagaagattgcctggatttgtttactttgtggtcctgaattttcagacaagcgcaaattcccatgaaagaagaacagacaatagctgtatcccagtagatcatttccctgttaccacctgtgctgaatttgcatttcattcattcattcatttattcagtcagtcattcaacagatcctgttgaataccatgttcagagaaatgtgtggactaaaaggatgatgcagacccaagagttgtccttaaggagcttacagcagagtgggaattttaggtgcccagatggaaatttgtccatttgggagtagtgtggggtgggaaggaaagaattagttaagactaaaaaaaaaagttcttaaaacttcatcaccctttagccattgccctattgctcttctctcagccaacctttgtaaaagctttctgcattcactatttctcattctcacctccggtttactcgccatttcactgcttctgccccctccactactccagtagaattgctcttgccaaagttactagggacttgccagttgctaaattcatggaatacactctggtctaatcttatttggcctttctgctgcatttggcagtgctgattttgtactcttgtaaagttcttcctcccttggccttgcttactctcctgattctactcacactttttggaagttccttcatgggctgcacattgactatcccctaggtttctttcttctttctttctttcttttttcttcttcttttttttttttttttttttttgagacggagtcttactctgtcgcctaggctggagtgcagtggcgcaatcagctcactgcaacctctgcctcccaggttcaagcaattcgcctgccttagcctcctgagtagctgggatgacaggcatgcaccaccacacctggctaatttttatatttttagtagagatgaggtttcaccatcttggccaggctggtctcgaacttctgatctcaggtgatccaccctcctcggcctcccaaggtgctgggattacaggcgtgagccactgcgcctggcctattccctaggtttctacgctcaggttgttctctgattttgttcactctctctactcactcgggatttaaatatgctactctttctcttgt

SEQ ID NO: 6387 - DNA, 1237 bp, Homo sapiens
ccttggtcttttatgatgggagatggttgctagcctgcatttagggatagctatgcttatacagaacttctcacacagagtagtactgcttccctgggtttggaagcatttttgattttgccagaaagattggcagggggtggggtggggtggatgcatgtgaagccgggggggtgtgctacaattggcacttggtgctccctgaaccaaatatactaaatatcttgtaatggatgcatcagtcctacccagggaataattctcccactccggagacccagtatctcctgtgtgggatcccccatctacaagtatacatgtaaactttcccctgggccactgcagtgtccctctgggaaacatgaatctgttcctggcacctctctagacactctagaatggttcagttgttttatccctatacatacttgacctccagaacatgctatttatgctactcccaaagcttatagctgaaaacaaacatttctaccctatttttcttcccttgaaatatcctctggctctgaggtcatttaaggaataggcagcccttgcagatttttgtaagtttcctcttcgcatgaacaataactgcaaaatgatccatctgatctggctaccattgttgaaggcaagaggatacaaagagcattcatcgggccaggcgccttctcaagaagggctcatcaaggtggaaaaccaagtggcacatacttgtggagaaagtttgaaaggagtaggggttaagggagtggtagggattgaggaaaagcctaataacatggtaataggagataacagactacaaaacccctgtgaaaccaggaataaaagagccccatgcttcacaaatacaagattgaatgagtttcatgtttaatgtaaatacacctgccatttgttctctgaagcactggttacaggttttgagataaaatagagttttgaacattgtgccagtgtaatttgcctttgcccaggcatagactgtacactttgttcctgaacagtccttagagacaacatagtgctctgatcagctcaaaggtcccacctcctgatgtgagacctctgcttccacctggcctgcatctgagactccttggctattgacagagtagggggaagtgagacagtggcccagggtgccagtgatctcatggctaaagtggatcattttactctcctgcattgaagttactcactgcattaagggtaaagagcaaaaccctca

SEQ ID NO: 6388 - DNA, 1128 bp, Homo sapiens
gtcatatgactaagtcctcaccaagaagatccaagtagaagtgttttctggaaccccaagaaagactcctaaaaggtgaagaggaagaaccttcagcccctccccgctgctctcctctccatccttcctgctgtctagaatgcagacgcactgcctggggtaccagcatccgtctttctaaggatggcagagcagtaagatagaagaaatctggccttttctgaccgtgaagctactgtatcagtcttatatttttttgagcaaaagacacacttccatttatactacttactttaattttaactttttggatacatgtagctgagcctagtcctaactgggacacttaggaagtgttcaggtatgtaatctcttttgactttaacagctactctgtaagatatgatcatccttatttgacaagtgaggaaactgagattcagaggtattatttgatttctttaggggcatatagccacctaagtcttctgacagagttcacagctctttgctaccagatcccacttcccttagcaggcacacagcaaatgcttattaaatggaattcgcccaaactgcactgtgtttctatacctgctttgggttgggtttcatagcaagagttcagtgtcttgttggcttccctgggataaataaaatcaattctatcctctttcttcatacatatacctacatatgtatatgtgtgtttatataaaaactgacatagcagtctgaattcaacttacccattccaccaattcttcatcaaatatttatacaaatcttattgtatgtctagaactgtgccaggagtagtgaaaacaaaaataaacaaaaataaataaatcacattcccttccccactcggagcttacagttgatcttcgagggttctgacgaatttatttcccttcctaattctgaggtgatagtagattaatatgccactttatcagtttgtatgaaattagttgggcttttcaaagaaagcccataccctcagcagtggggcagttttgatggcacaccatgtgctgatattaacacgtggtggtctgatttaagttgtgattcttggtttctggatgtgtgctgtcacatttcacctactgtgtctgagcacct

SEQ ID NO: 6389 - DNA, 1107 bp, Homo sapiens
tctcccaggcatggaccatgctcagctggttgctatcaagaccttgaaagactataacaacccccagcaatggacggaatttcaacaagaagcctccctaatggcagaactgcaccaccccaatattgtctgccttctaggtgccgtcactcaggaacaacctgtgtgcatgctttttgagtatattaatcagggggatctccatgagttcctcatcatgagatccccacactctgatgttggctgcagcagtgatgaagatgggactgtgaaatccagcctggaccacggagattttctgcacattgcaattcagattgcagctggcatggaatacctgtctagtcacttctttgtccacaaggaccttgcagctcgcaatattttaatcggagagcaacttcatgtaaagatttcagacttggggctttccagagaaatttactccgctgattactacagggtccagagtaagtccttgctgcccattcgctggatgccccctgaagccatcatgtatggcaaattctcttctgattcagatatctggtcctttggggttgtcttgtgggagattttcagttttggactccagccatattatggattcagtaaccaggaagtgattgagatggtgagaaaacggcagctcttaccatgctctgaagactgcccacccagaatgtacagcctcatgacagagtgctggaatgagattccttctaggagaccaagatttaaagatattcacgtccggcttcggtcctgggagggactctcaagtcacacaagctctactactccttcagggggaaatgccaccacacagacaacctccctcagtgccagcccagtgagtaatctcagtaaccccagatatcctaattacatgttcccgagccagggtattacaccacagggccagattgctggtttcattggcccgccaatacctcagaaccagcgattcattcccatcaatggatacccaatacctcctggatatgcagcgtttccagctgcccactaccagccaacaggtcctcccagagtgattcagcactgcccacctcccaagagtcggtccccaagcagtgccagtgggtc

SEQ ID NO: 6390 - DNA, 1144 bp, Homo sapiens
atgttctggaaagaaaaagaaccggcttaaaacccacagcaagagacctcccttgtgtttgtgctttgtgcagagttgtttgagtcatttcctgcctgtcgacatggttaaaaacgagagaaacaacaacacagtcacatttgtgaagatgtgaggctggttctgaaatggaggggaaataagcctgatgaacagacctgccataacactaatggaaggtaacagaaggcgaacctccaaacacagagacggaacctgcaagtgaagctgagccagaggaatgttccaaagagccagaagcattcagctctccttaactggaagagagaaaaatctgctcacccagagactggaatgtggcacatgcagatacaaatgtgtgcattgaagatttcgctttgtttcttagcggtacctggataccacagttgctgtatggaactcatgttatgctctaaacgatgcatctcagaatttctaagtaaaggattatttttctactatttattgaactttcaaacattctcaaactttggggaaaaggaaaggaaacacaggagaagttttcagcagttgccccgagctgttttgtgtgtaatgaagtggttctttgattaaggagctctatttcttatttaactgatatcccactgccccactccacaaaataggaaaatgaagaaatctttctctctgacttgtttacatcatttcacggaaacacatctttgtttgtaatgcagtattctttctctgtgtttgacagagatggggaggggcagaggaatttaagaggttttaaaagaaatgttatgtttcttatgacttgtttccactcctcgtacaatgctattcttaggtttctacgaaacctaatgttagaaccgcatcctttcagctaagggagggttggatttattttccttgttttagagactacaaatttttaaatatcccattttgactgagaatattgacatataagggaagaagttttctaaattgtgaaagtctggttcttaattaaagaattttttttttaatatcacggttaaaagctgctgccagttagccaagacattatccaccaaattgctttgtgatttatacagggattaatcaaatctggctactataacatggg

SEQ ID NO: 6391 - DNA, 1285 bp, Homo sapiens
taaggagtcacagtatttataaccattttgagctaataagctatacctcactctctgctttctctctcactctttttgatagtgtgttagggtgaaaaatcagttatttaacccaatttacttgtgaaagaagttttatctttatggactatgatgacttttgacatcaccatttcttgaagaccttggtattaaatgcatgagaaaccttttgccatctagaaatttctaagtttgtttatgttataagactgtaattaattgatagggaatttgggatctcaatccggggctttttgaaatcagatcattaaatatctcgtcactttggggacttgttatttttaactatgatgtggatatcctgttttaattatgaagtctagaattggtacatatgttgtatgctttgtaaagaatttcacttggtctaatttattgcatatactagcttctgttggaaaatgactgacagctagaaagtttaaggtaatttctaagtatactacctataagtaactgataagaattaggcatcattcagtgatatagcagatgactaatgggtttttcaggccctgcacttctctttcccattttcctgttgcattcagcctcttcaatgcttagtcacacctccactatagtacaaacaaacaaacaaacagaagaaaggaaagatggtgaattttgcaacagagctgcaaaaagtcagtcagtcaaagcaggaagaggttgaaggaactaaaacaaacaaacaaaggtgtctggactacagcacagtggacatgccatccatactggcctgtgccccgttatcaatcactgggcacaacagtgaagaagtgcaaatcaagtggtgtttgtttgtttgttagtagtaaggaccgtaacccaccccttcctccccccaaaactatactgttatttttctatgtaagcaaattgtttgaaatgctttgaaaatgaaatcttaatattaaaaggcatatgcatgtaaagtctttagtatatttatttgtataaagagtaaacaaagtgcatatagagtggccacaggtttgacacagagaccttggtgatgtaggctatgaacaaatttaaatggcaacttcattgctgccactgaaccaatcctgaatttgggctcaacaggtgaaaagtaacaatatcaaacgaatactaaacagcataacaaaaagattttcagactcttggtcataaagaccgtaatcgttcacattgaatcaatgactaaacatttttgattacccagctacctcca

SEQ ID NO: 6392 - DNA, 1198 bp, Homo sapiens
caatcctccccacctcagccttccgagtagcaggaaccacagacatgtgccacaatacccagctaatttttaaattgttttgttgagagaggtttcattctgttattcaggctggtctcgaactcctgggctcaagcaatcctcctgccttggcctcccaaagttttgggataataggcatgaaccaccatgcctggcttattttattttaatgattgataaataggatgtgtattttaaaaaaaaccctcaaattatattcagaatgtttaacatagtagggaagatgccaccagtagatacaaaacaaaaactaacagatatattctatgttagatttcagttagcaatgagtaaatcaaaaaagaaggcagtttctcaaatctagaagggtttattacgtagacagtgccaaaggtgctaggtaaattaggttttactcttatttttaaggaaaaatgactaacaaaggtgcttttatttaatttaaagtgccatccaaggtatataatttggtaggaatgtatttgactttctgggaaagttaatgtgaagatactgtgttgacctcactgattcagtttacttagcaagttgtgggctattggcagaggcaccatgtatacctgtttgtaaaacggtgtcttcagagttgtgtggaaattaaatatcttgtaaatcagataatactccagggagttttgctggtaaggaattataagagtttaaagggactctcaaatatgtattcagtttctatggaatgcccttttacagtttctgtttccataaacatattttgctttcctaaagcaagatttacccaaaatgtaaaagtgtgcaaagagttggcccttcctcctaatcatagatgtgtgttttaaaatattttaaatgtatttccttcttggtgatgtatatgttggactggtttcttgggtctgggcattatttatactcaagaacagttgttgccacgtgattggaaaagcgctattgatgtcattctcatcccatatgctttgacagcaaaggagttagctgtatcttcccttgtcttcccactctagaatgagaaagacaagaaagctccctaatttgatttgtatggagggggagtgggtaggaaagtccacttcagctgaaaaggctgacctgtaggtatttaaaacataaatttaggtctgttattttcaca

SEQ ID NO: 6393 - DNA, 2918 bp, Homo sapiens
ataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtataacagctttatgattatgagaaaacaaattctttattttttttttctgttccaaagattcatcctatggggtggccataaagtctagaattagatactaatattttgtcattcattataacatatcaataaaccatttgttaaaagatttgcctggtttccagacttggtggccaccttgaataattcttgctgtcttctgggaaggatgatgaaatttattcctgctgccttaaaaatatgtatcccttcttcacccatcatgactgtccccagtgagtgtcctttactattcttgggagtgactcctgtctaacttttcatactggcgagaagaaaagaagcctattttaacactttagtggtgttgaaacacattacttactttctgaagatgtcccagtgaatcctctgtcaattcactgccatatgtaatctatatgataaggaatgcatcttccttctaagtactgcccaaactcttgccagctcctctcccattgtcccttcatgtgaatatttcttggctaccttagtggaaatatagatcagttttctccccatccatcctctcaaacataatgagattgtttactttttagatttatgcagtgaaaatgcccagtcaggtctgaatcgtcagtgcattatattgactctgagcactttagaatttagagttgcaattgaatgccagctgtggagatggggtgcatatcagatatataaataaagctcaggtttgctagggaaccaggtatagagaaaaataagtctgatatgaggaaaattgcacaatttagagtagttatgccgtagagaaaatttccacaaactaggaaatgtagagagttattctatagaatactcaaaagaggaaagtatgtgatttttggaaacaggaaaatcttcaaacttctttcttcacttccctttgtgtttagctgaccctccaatgtgatcattgcctttggagtttgggagaggtacgggaagtggcctgatccctgcttccatacttcactcctccatccatccttccctccctcttcccctccagctaaatggacaattctagccaacattgagtcactcaataagtctcaacagtgggtgtgtttgctgagattgtccagcggttgagcagtttggtctcacctccctcgctagttgagaccaaaaagagacaaataactttttcatggtctttgaaacataatgcttatttcgtggtcaatggctttaaaaaaatctgtttcttgttttcttcaacaaactcactagttttcccttaaatgatattgtaaaaattaaagtaatcttgaaaatgttttgacaaaagtaaaattaaagggacatcttttcttgttttgttttttttttttctattgccacacatgaccgttccttcacctttaagcaaagagagtggttcagatggtttctaagatgccaacctgacctcgcattctgtcattctacccagctcttaattcaatttgcttccattatcctaacaggcttctttcttacttagaacttggaaaggctgctgtatttaataccctccaacactaacgcagacttaagataggtactgtttattgaaaacctactgagtgaaatgtgcggttttaggaccttcataaacatctcatttaatctttctagcatcctgtgaaacagccatgatttcacgttgataaacaaagaagacaggggtcccagggatgtgaagcatcttgcccaggcttctgctgctggtgaccagtgtagccaggactccagcccaggttttcctgactcagaagactgagctttttcctggatgttattaatagctaattgtgtccaagcaaccaagggccttgagtctgcttggttctgcttatggcctcacatcaagaaatggagctagtccatgtctgtagtcccaatgctttgggaagccatgatgggaaggttgtcggaggccaaaagttcaagaccaggctgggcaatatcacaagactccatctctacggaaaagtaaaaaattagccagtcatggtggtgtacacttatggtcctagttactcaggagacttaggcaggaggattgcttgatcctaggaattcgaggctgcagtgagctatgattgcacctctgcacccaagcctgggcgacacagcgagaccctctctcttaaaaaaaaaaaatagcagagctcaccaaagtgatgttcacctttttatgacattcctttttcttagcttaagaaaagaaagctgctagatgagagtcttagttttcctgcataagacctcctttatgaatagaataaaagactgtcaaagtaggctgggcttgggcccaggctaatctatgaaggaagcaagctcgtgttccttacctatccttttggtgtccattggattgtgccccgaagtggcctttacccttgagccgtccccagccatggtgctcacacataggcttttgagctccttggagctatccagatcctgctcacttttccttcctgagatcagaacaaatcacccccttactcccactccaaacaaggccttgatgataaactaatccttcctaaaatgctggtaggtaaacaagcaatgatgaagcattgaacacaggttaactcctgacttttgtaccattgtctattccattacacattaacatgactctgaatgccagatccaaacctttgcccaccatctgcttgtcgtgcaacagttgaggcagtaaccaggggagattcact

SEQ ID NO: 6394 - DNA, 1819 bp, Homo sapiens
aacaacatatttgcttcagcctggaatctgtttttggtgctttggtgcagagacaggaaatgggcactcagagtcacactggtagttgcacactgtatctacagagggcgtgtctcatctgtactctgctgggttacaggatttcagtaggtatttgtgtccacctgagaattctgtttattacctttcatttgacagtgtctttcctttctgcagttgattttgctagagaggcaattcataaggtgaggtcctgttcatagtatgacttgctttctcaatatctccttcaatttttagtaactcttggtctatttggtgtctttaaaaaaaataacctagtaataaagacttcttttaatgtggaaatgtggtctggtagtaagttatttctttccacatgtaactgacccaatctggtttccaaatgagaagtgtgcaggccccagaggttgagaagccatatttcaactgtgaaaaaaatctgcttcctgcatctgttgaaatatagttgttcatacttgccatcccttatctttcttgtaacaatttgcacagttcttgccagaataaatgccattatctgtatgtttcagggagttccccaatttgatcatttttgtgtgtgtgtggtgtgtgtgtgagagagagagatactgcagtaaaacatttctaaaggatgaaagctcttgtatggcatagatatgaattccttcctctggtaataattaggttattcccagaagcacagtgtcattctttaaataaaagctttcctgtttaaagcttttcaaaggagcagaccaccttgaagattccccctagggttgatatgtgtctaattcattttataaaaattattcttgtcttcattttaaagctttggctatatagtcagaaatgtcctaaataacaaactattttgtatttaatttagggaagactaaagggaagaaaaatgaaaactcagtctttatgtaagctccaaggatattagggcttaaagggcttttctagttttatgagaatttgtactactgatttttatatattcctgtttttgagatgaacagatctctggggaaattgttgagttacaatggcatttcactgtgatccctctcaagctcagatcagttctataacccaatgacaacctgtctctttggtttactgtcctgtgaaatgtcagctcaagtttcccagaagtcgtgtgtttatgatgagtcagagtgcttttcctcggtgggacagttgctggccctcttaattttggtgtatgtgcttccaagtatctaaacctccagtctgatctgtatatgctatcctaactgttaattgtattattgattatgttgattatcttgcttgaaggttcatacttttcaatttgatagaaataaagtttttttctgcttatagctagcgaattcatttgtttgtatagctttttatacttgataatataaagtttcacaaatactttcattgatgcgtctctgcaaccactacattaccaacaatgttgtctccaatttgcagaaaagcaagatcttgaaccaagaattattatccccagtcctgttttcttttctgctacaccatattgccttattcgtatacccttaaattccttatttgtccagcactttattgtttacaattttaatgtacattctttgtttttttccccctaaccactagacaaccagggatttttctttttcttgaaatagataatgtgagcagattctctccctgttttacacattaggaaactggatcagattatatgactcttaaggttgtagcatctggg

SEQ ID NO: 6395 - DNA, 1153 bp, Homo sapiens
ccttcacacctggcaccattccttttttacagcattttagaaaaaatttttttcaagtttggaaaaaaaaagttttgtcaggctgttagaattcccgtagcagtagaatgcattatctgcagtgtttgttgagatgcaaaaacaatttcagtacttcagacttttaaataaaaggctctatttagttcatgtgaaaacttttaaagctctgcccttcccccttaaagctaagagactgatatactgattgccagtcttgttttcctcctctgggtttaggggaggggattagggccagactttcattggataaaggtagttgaggctggggttaggctcttttcagaggaaaaatcaagatattaacctgtcaccagaaggaggagggatggatggtgggtgggttaaaacaacagatgtcaggtgtacataactgggatggactttatctgctgcactattggtgcaaaatcctttcctcttatgtgtctcctggtgttcctaaggaaagtataaggaagtcacctgcagtttgtagggaatgagctatttactcatgcatgaactgtgttctctagttaaaaagggattgaaaagaagaacaatatcagagtccctatccaaattatgaactccttgaggtcagagattgtgtcttgtcacaattatacctccagtgtttgatatggaacctggcatacatgagtcattcagtgaatatttgtgagattacttggttttttgccttgttgacttaagaaaactttttattttgaaataatcatagatttgtccgagagattccaaagaaatgtacaatgatatcctatgcatccttcatcctctagcctccctgaatgttcacatcttataccaccatagtacaatataaaagccaagacattgacatttgcacaatccatagaacttaaggtttcaccagtcacacatgcactagtttatgtgtgtgtgtttatgtttgtagctctatgctatgtactatgtgaatacatgtaaccttaactaatgaccacggtgatcaagatgctcaaatatcaccacacactctcttgcattacccctttatggccacctccatttcccggtccttaacccttggaaatttagtctgttctccatctttataattatg

SEQ ID NO: 6396 - DNA, 2426 bp, Homo sapiens
tctagtcagatgaccttgcagaaccaccgcattccaccctgccctttggggagcctactcagcattctacctggggaaatggaaaacagaggccaccacccatgaaggcataacacccatcacattgtctgagaataggattaatgagcaaaagttatgataatagagttatatgatggtttaatggtttctagatttttcttggaaagatataatttgagcagtggctttatgcagactccaagaacaaaaccaccaggtatttttttttaagtaaaaatttactaaggcctttagcataatactgtaaatgtcttttggtcaagagaactaacaaatataaaggaacttgaaatgtggggagtgataatagtccagtgattaaactacagtccagtgattaccaccaactttctgactaagctaaaaatgaatgaaaatggtggctaaagaaaatagggactctgaagatgtcgaaatctttattcctggttaggaaggtgggccgctacccttctttccctttagaaaactgtgattaattaaataaaaagtcttactactataacaactctaaacctggtttaaatgaaacatctaattttgctgtaaggcttaatgctcttcttttgtttagccaagaaaacattcttagttggaaacaggtggtaaagtagtttggcctgttcacaacttatcaggaccaatatctagtgtggactcagtgttctctaggtttgtgagcagttgtggtaagagaatggaaggcaacactgaataggagttaagggaatggcacgatcacagtgagagagctgcactcacctgcagacccagtcagatggcttgtcagtatctgctctgaggaaccaggtcccacctccccacaaggcaaatctagacccattaaattattacagtgggcttttttgttttaaaagtggttggggatccacaggaacgacattcatacagggacatttgtgaaagcaaagcaagaatgaatgctttcccgatctcagactggctggattcagatcagtgtgttggctggttctcattttaaggggtaagcagtttgctattctgtgactttagtagatctcttttgtgtgcacatatacaatgtgcattatacatatatattaaatatatccacaaagcagatgggcaaaaagattttcatgctaatcttcaaaggttcatgctcaatattgtgaaaagcttttaaaagttgttttgaaaagacaatcattttttgtttttgttttaactttcttgtggcaagctataccggaaaagcggcatgtcaaaaatactttaggttctacatagatctctttctctcttttgttttgtttgtttgtttgttaaagttcattatttattttaccttttactgacaatgtgaaactcgaagaaaatgttctctttttaaatatacagtcataaactgttcaaggtaaccataacaaactaggtgttatttattaacgtattataaaataatgtttgatccagtatgtgcttgtcttatttaaaattggaatgtgagacatgttgctgtgacctgtttttctttctcattcacatttgtagatattgtgtgaactacagtatataatgataacaattaaaaggatattctgtggatgtcacgtattttgaaatgatagaactacattagctttgtatcatgtttggataattcatcaatgttcacagtttaaaacatcattaaacattatgtaattacaatgagaaagaatcttacttaaatttggagattttcccccacatctcttttccggatacattataattctggacccctatttatctcaaaactcttaatatatgcagaccaacaggtctttgcattccttttaaataactggttgtgacaaagcttgttgttgatcagattcactgtttcatcatatttattgtaatatattttttgttttgtaaatatgttacaacaaaatgtgattggtctaaaatatttgtaatgtatattaaaaggttcaaaaatatttgtataaatctaagttatttgggtacttgtaggaatacaatgaggagcttgaatgccaccttctgacatgatttacttttaaggaaagttatgaggagagaatacaaaaagcatgcaccaaaatgtaatctgacaggatttctggatttatacgtaatcactcctgccccaacacacacacacacacacacacacacacacacacacatgcacgcacacatgattttgattatgctacatgatatatgtttcaaaaagaattagcatagaaatcctggtctcctagccaaaaaaatcaaaggattttcaaaaaaacgaatctgtatgttgaggcaaaaggattgaacctggaagtctgggactttatcatagaaacaaagtctcagat

SEQ ID NO: 6397 - DNA, 3399 bp, Homo sapiens
atttagggtttattctaagctcttaaaaggtttcaagcatgcgtgcactcaaaagatctttaccgaactagcttttgcaagacactctactatgttctatagggaaggcagaaatgaccaagttaaaattctgtctttaaagaaattgtggctcagtggtacagaaaacagtaaagtttctagggtatatattatatagtggcttcttaacacaatataagctacctacatagtaattttaaaattatcactacttatctatccctggtagaaatcatcttatgttctaatattcacaattaattaattttttgacctaaacatttaaaatagcaatgattttgaaatagtagtatgtctttcatttaaaatgtaactgttacttttctttttggattttgcctgggtccaactgacagcgtttactggcccttattcgtcctgattttccacgccatctcccccatcccccatttcattgccaaaagagtcacctatgactcagatgcaaccagtagtgcctgtcgggaactggcatatttcttcactactggaattgttgtttctgcctttggatttcctgttattcttgctcgtgtggctgtggtaagttttattttctattgttttgcccaaccgttgctgagtttacttcagaggcctgtgtctgggacctccatttcatgctcattacttaggctttatactcaaggccgtgtgtttttagtttctctgttcctctactttagacctgcctaacagtagttcggccatgccttcagagtgctttctttatttctcttacaacttttagccagacgatatgatttcttactttttctactttaagctattctctggaattgttcttaaattcctgcctcttaaatcttacagtaatccacagatactatgctagcagtacttttctagttgcaagatgaagatatttcaaattcttctcctgcaaatgggatcatggactcaactctcaactcagtataataggtatatgttgagggacaactgtgtagcttccagaaaatgcagtgaataagttgacatcttcacttccaagacaaaaactttctttttgtcttcagagtacacattgtaggtataatttattcaattatttgctattcactgtctttcctactatttgattttattccctccaattacgttctattttaattttatgaaactcttatttgaggcattgaatatcagataagcgcaagtcttgttcattcaataaatatctttgcaacaactgctacttgtaaaacaccagaaataagaaataggtactgtctctgctcctgaggaacacagaaactagcttgctgggtaagtatactataagtgtactaagtgagacggttgaagcatgatcagaatgccataggggcaccaagaagagagaaattccgactggcatttgatatgggcctctaaggataaatagcatttgtattgaggtaggatggctgttgtatggaatgacattcaagtgtaagaatgcagtatatagaataaagaagaatccagtgtggtagagctaaaagaaagttgttgaggttaaggctggaagggttgtgaaacctgattagcaatggtcttgaaccccatgccagtttgatctttgtctagataatggggaaagattgaaggtttttgaatacaacaagattgtcatgactttatttttcttgtgctttagaccagcccttcttaagcgctgcagtaaatatttatattttttcctttcaatactgccatcatattttgtgaagaaactttcattgatgtttctcttgcttaaagtaaaacaaaaaatgcccactagagggtactctcacccccaaatgtgcttctgtaaaaccatctacaaaccatctactaagctggaaagcagttttcagttgtatgaagactattatttaaagtcttttcttgcctagaaaagaaacacacaaatttataactctacaatttttattttccatgaaagaagttgatgtgtgcagaactttcagtacccaatattgtaattgcactatttataatcttaccacttgagttttacttaaggcaatcattgtcaattaaaaacaagtagagaaatatgtctaattgggaacatgttaaggatgataccagacttaattaacaagcatcacagaagtaattagactcattactgaacagttcattgtctcctgttacattattaagccttttagcagctttgtgtaacatttcattggatgtttctaatgcagaaaataatagggattgcaaagagtacaatatgaaggaagtaaggatttaatccttcttttcttgtctttcagatcaaatggggagcctgcggccttgtgttggcaggcaatgcagtcattttccttacaattcaagggtttttccttatatttggaagaggagatgattttagctgggagcagtggtagcactttattctgattacagtgcattgaatttcttagaactcatactatctgtatacatgtgcacatgcggcattttactatgaaatttaatatgctgggttttttaatacctttatatatcatgttcactttaagaaagacttcataagtaggagatgagttttattctcagcaaatagacctgtcaaatttagattatgttactcaaattatgttacttgtttggctgttcatgtagtcacggtgctctcagaaaatatattaacgcagtcttgtaggcagctgccaccttatgcagtgcatcgaaaccttttgcttggggatgtgcttggagaggcagataacgctgaagcaggcctctcatgacccaggaaggccggggtggatccctctttgtgttgtagtccatgctattaaaagtgtggcccacagaccaagagcctcaacatttcctagagccttattagaaatgcagaatctgaagccccactctggacccaggacattttgatgagatccaaaggagttgtatgcacatgaaagtttgagaagcatcatcatagagaagtaaacatcacacccaacttccttatctttccagtggctaaaccacttaacctctctgggtgttacctgctcatttgtttaaaaaaaaaaaaaaagtctcacctgctttcatgctgaggacaagttcagatgttcaagcctataatatttaggcagttcctcaaatttatgaaaagtgttctcagaattgggagacagtcaaagggtacaaagcctcagttaggaggaataagtgtgatttttttttaaagatcacttgcacagcatgctaaatataggaataattgaatgtatatttcaatattgctaagagagtaaatttctaatgttctcataaaaaagttaaatatttgag

SEQ ID NO: 6398 - DNA, 1522 bp, Homo sapiens
tctctaccttctcatttgaatatctttagttcattcagatttactaattttggtaaatctgaatgaactaaagatgtatctgtaccttctcatttgatgtattaatcataaaatttcactacaaggtaatttttgcttagtttgatggatgaatgggaaactcaagtccaaatttctgcttaataccaatttctctgagtttcttgaaatgtctttaaaacagacatttttctcaccaaacagtttgagtatctttattaaggaaacccttacgaatcctgaaaattatgctagcatgatttttttatatatagaagtttaaaaataaaccaggtcaggtttgtatatgtaaaattgttgacatcaatgatgtctttccatattcttatctgggcttaagaaatacattctgtatttttccagattctttgtagcctttgaaagatttttacagtacatatgtcttgactgagctgtcctttcttaatacaaaagcgtgtataattttcttaacttgtacagttggtaaacttttatgagaggaattgttattctgagtctgtcagctttcattttattttgctaaggtttttctaatgaatttttaagtgtttgtgtagtaattaagtcatatttcttatccaggtggttaaagcattcataaaggattataaaatttttttttttttttttttttttaaatttctacttaagggcaagtaatttgagaattctgaaattaagcatgatgcttagattgcagtttgttttgcatttgctataattttcaaaattatttttgaagcaagacaaaagtttaatgtcagcttaagtgcttaaatatatcatgctgaccagaatcctgttatttttatatgcatcataaaatttcccatttctgcattaaataaacagaggaggggggtcaagtgatacttagatattggcacacacaaggaacaactgttggcaggcagtatcgattttatgaagagaaagtgaagtttgaaaacttttcaaacttttctagttacaatccaatttttcagatttgataatgcttttccaaagtgaaaataagatacacaataatcattgctctgtgtgattacagataggattatccatctgcatagccttgtaaaagtgccattttatttttagtgctaaattcttgttaaataatgtagttttatatagctgatagaccaacctatatccaaacttttataaaatattaattattcttgtttttctcacacaggcatactccaaatgcttcttccagttcatttttcagccatcagttcaagagccaatgcctttttaaaataaagcttctgtggtcttgtttttaatggctcaactgtctgatgtaattgagtgaaggtttgcactgagaaattagcattcaggccttacccccatgaagtattactgttaacatatgttcggactgcttcccttcaccaatgtgaacaactttttttcccaaacagtgttaaaagccactttgcaacac

SEQ ID NO: 6399 - DNA, 1313 bp, Homo sapiens
actcagaacactggcagttcctacagagacactgaggtgtcttgattatggaggaaataaccattcctttgcacttgtacaatctgaggattgattgctgccttttaaaattttatgaagagagaaacttataattgactctattttaaatatgttgtttgaattaatttatatcagactggaaaaggtactgggctttttaatttatttttcttatatgccgacagtgaaacatcagtgttttgaaagtattttatttcataatttgatatccaggtgtccctgagagctgcatatgtaatgtttgccaactggagcttcatcattcaaattgttgctgcatctggaggcagtttagcctttcctctgctggaaatgcagacgaatatgtgaaatttctcttctttgaatcttatttcttatgattgcattgtcttcatcatatcatcattccatttgccaaggaaaacaactttggcactataaaaatatgtggggctttgaagtgtattgctatctatgttggcttccctgactttcataggatgagcagagtgcattccttgaaaacatgttctttttttgttgtgtagaatggggataatgaagggggtgagaaagtaggccttttactaatttttcatctatttgacttattgattcaactaaaatgttttaagtatatgtgccaggcattgtgctaaatgctggggatacagagatgtttgcagaggtagttgaaacatctcactcctgccatagtgactcaggtaaggttgagaatttagctctgttaatctattcagaagatgtcactaagagtaagttgtttcagcactcaaaagccgcaaatctgtaaattggattaagaacacctgccctacctacccggcaatagtgtgaatccaaatgctgcaatgtgagatgaggtacaagtaaagagctgtgttttgtaaaccagtgcagctcagcattgactccctctctaagtgaaaattgcagacaggcaagtctgttttcccttgccaccttcctttgggtttggttgctctttggatgaatatgatgaggtcccacatttctgaatttattggtttgaggggaaaggctggttagacgtctttgtattgtcaatggttggtttttctctggcagtgtcagtgttagagctatcatcttccttcttaaatggcatgagcaatgagcaaacttccctcctttcaacattctcacctacatcatgtgccccttggctcacctactgagcttgccaacttctctcaaaaccaatgctgcattttgggagagcagct

SEQ ID NO: 6400 - DNA, 1205 bp, Homo sapiens
acttccttccctctctgctgttaaccagtgttctactttctgtctctgtgaatttgactactctaggtacctcatataagtggaatcatgtagtatttgtcctttcgtgatgaacttacttcattaacgtaatgtcttcaaggttcagccacgttgtagcatatgttagaatgtcctccctttttaaggctgaataatattaaattatatgtgtataattggtttatatcttttgagttactttgagaacacctatgttcttcaagtgtttcttaaaaaactggtacacaggatgaggttcttaacatagcctacaaggtcctagataatgtggttcctacccacatctccagaggcactattcacgtttccctcccctaaggtgcagataaatcaacaatgtgggttccggcttctgtgtctttactcccattattccctccatctgggctgctttttctcttcctcctctcacccagctcctgaaaaactcttacatttccttccgtattttggcagaacattacctcttctctgggcagccttcacactgccccccacttccctctacataattgatctctctcctttgtgcctctcctaccgcatctttatataccccctttatagagtgtccatctgctgctgctgctataacaaaatacctgagactggataacatataaaaaatagaaatttattttctcacacttctggaggctgagaagtccaagatcaaggtgccaccttaaccactgcatcctctgaaggggaagaacaccatgtcctcacatggcagaagggacagaaggtcagaaagggacaaacactgtgtgaaacctctctcataaggcatgaatcctactcacaaaggcagagccctcatgacttagtcacctcctaaagggcctgcctcttaataatatcacattggtgattaagtttcaacatatgaattttggaggacacatacagaccgtagcaaaggggctctgcattacatgtttacatatcactctcttccactagacagttgcttcttgaggacagtggcaggcaagggtgcctaacacagtttagatattttagttgattgaatcaatggaaacaaggaaaatgattaaatttcttccttgactgctagcttcaaaaggaaaaataactaaaacattgtattttaagaaacatccttgcagaaaaaatat

SEQ ID NO: 6401 - DNA, 1196 bp, Homo sapiens
tgaagaccaactcccagttcctaagactcccccagagctggcttgcctgtcctctagctgcagccagaccgatggtggcacccagagatgacagctgctggagcaggggctgggggaattggggcaggctgtgctggttgagggcacactgactttaaggcttgaagcctcaccactcagagcatgagggagtcacacctcatctttaactgatccagagtcagcttatcaccacaggagaaggtgagtgggtgaagagaacttgaggggaaaacagaaagggagatgtgctgaggctccagttcttccagagagtcagcgagaggtgcctcatgtgaggggaggtcatctatgttggagggtaagtagccatcatgggtgggaaggtcacctgctgggagcaccgtccagggacaggctgggttttcgggctttgggtcggagcccctgctctccagcaccttgtacagatccaccagttgtctgctctcagcttggagagctcttggaggtggtgggcttgaggcactgtgcatcatgtctttctcagaggcctgatgaccttggattcctttttccctttgtggccagttggagcaggggggatgtctgaaaactggggtcacttgatgaaggacttcactgatgaccagcggttcaggatcttcaggcgtgggccagtctatcaggagcctgtccaagggcagctgtgtcttctcctgagagaaaggaggaggaagaggctcacactgctgtagaagtgaccttcacaacctatttctccagggttcccaaaggcctcacaacctgcactgtctcctcagccctggctggaacatgttgggcactggagtttgcgaggtaagagaaacagttaacattgttggggaggcagaggggcaggagccagagactcctctcaacccccagccagtgagtgattcacagccctgctcaaccttcaacctgtttctttctttcttttttttttttttcttgagacgaagtcgccttctgtcacccaggctcaagtgcagtggcatgatcttggctccctgtaacctccgcctcccaggttcaagcaattctcgtgcctcagcctcccgagtggctgggattataggcatgtgccaccatgcctggctaatttttatatttttagtagagacagggtttcaccatgttggccaggctgg

SEQ ID NO: 6402 - DNA, 2720 bp, Homo sapiens
cacagtctcggctcactgcaacccttgcctcccaggttcaagcgattctcctgcctcagcctcttgagtagtgggatcacaggtgcctgccaccacacccagctaattgtttatatttttagtacagacaggatttcaccatgttggccaggctggtctcaaactcctgacctcaggtgatccacccaccttggcctcccaaagcgctgggattacaggtgtgagccactgtgcctggccaacagtaagatttttttagagttctgtcttaatgtagacactagctaacaatgtaattttgaagaactgagaactgtggttaattttggtttttctttttcagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctcacttcttaaaagtcataaaaacaatcaaataggatcatgtttattgtcatgtgtttcctggtttctgacctgtgtgcacacccctgtgtgtttataatttttaaattgaattttatatggggtttttatttgctaaaaaccaggctgttgaatcacatttgggaagg

SEQ ID NO: 6403 - DNA, 1076 bp, Homo sapiens
tagtaaccttatatgtcatctctccagaggtcttcatcaaggattcacatggcagtcctgatctgaagggcatatttaaaatgtacttgtccagatttcactgctaaagattatgattcagtaggtctaggatgggcttcagccgtttgggttgattgtgatagcatacatgtctttagttgaggactgctggtattacctgcaattttgagatagagaaaagtgcaggaaaatcttcctccaggatcactaaagctgagccctagcttgttacctgtggaggcattgagacatttgttcacagaaagtacagtttggatttttggttttttttagaagaaagctcattatttagaaattttgcaatgttacttttctactaataacacaatcatcttcacttatatttttaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaaggtaatttaagactttcttttccttttacataatttaaggacctcttataagtcactggctgggtcagacttatgtcacttttgggaacataagtagaagtagtagcagtgtctttaagaaaccgcatgttaggttatatttatgtttaaagcacttaaatgcctttttgtgtagtgctgttagtagtgttaagttaccacccttttgagttctttctaggtgccggtcatggtgctgggctaggcattttatgtacttaatgtcatttaattcttgttactgtgatgacattctcattttccagatgagaaaattctggtatagtgaatcaggttaactcttggcctttgctaaggcttacctgaaaaccagtctgttcactttgataattcctaactgctttttaggtctccacttaataaccattgtgttccttgtataattcctcttacgacacttaggattgttgacacttttttcttttactag

SEQ ID NO: 6404 - DNA, 1097 bp, Homo sapiens
tctgtcaaattttacttgtctctgagataagaatgaatgctctcttctgagagttactatattacaagataatgtcttatgggatgggtttgggttatagtatattgaatgaccggttttttaatatttcgatatatttgttactcattttttcccccccatatgtatttgtagcttttcctgaaaccccacaataaggttatttgggtattctgattatcttagtgtccttaatagttcctattctagcttttgactttgttgtcattacaaaatttgataagctagtaaagcttcattttataattaactgccttgttctgttactttttaagtatgaagtatatgaactaactagtttatattgtttacttttcgacgtcttctggggagtatatttagtaagaaaggagttagagaatgtgagagcttatggtatttttgtatgaagaacttttcagctacatgtaaatggacctagatgcctttctttttctttctttccttagagagtcccccaaatacattcagaaacaaatatcttataattacagtgacttggatcaatcaaatgtgactgaggaaacacctgaaggtgaagaacatcatccagtggcagacactgaaaataagtaagtggtattgcgtgtaatagtaatgacccagaattgaaagcactggagttttaccaataagataacccatagatttaatgctgttacttgatggctttttgtttttgacaagggagacttactgtaccctcatccctcaaagagtatttgaaagaatgctttttttttctttttttaatagagacagggtctcactatattgcctaggcaggtctccaattcctgggctcaagcgttcctcctgccttggcctcccaaagtgctgggattacaggcatgagccactgcacccagcccttaaaagagtggtttatgtgtatatatttgactctaacgctttgaaaaatagaatattttaatgtggttatttctgtttgattagtcattttaccattgtcatacaactgtacaaattttactttgagatagttaaaactagaaaatgtggccattttaacatta

SEQ ID NO: 6405 - DNA, 1160 bp, Homo sapiens
atcctaacaataggtcacactgcttatacctgactcctgttagaaagagagaactcagtattcatgagattactttcagtctttggctggtgcctttagaaatgctaaaacttgccatttcctttttttctcgttgatcctcattctactccttggagctatggtgagaaaatttgagctttagtaaagacaatgttaaaaacctaaaatgacaaactaaatgaagtaaagaaccatgtagcagcaacaataacattatctctgcgcttttatttttcttttttgataattaaaaagcaaggcaagtacagatacagcaatcatcacccccatcaaaaacctcaccagagggactcaaagcctgggggagccagggctgcgagtcagcggcaattaccctcccactgtgaagtcagcaggacccatggctgacttaacctcaccagcctcactcaaggtgcatagcaaccagcattattatagtctacttaatagtgtgtgctacctgccaggattgtacattaagaaaaggaaagactagtgggacctgtttgtcaggccctaaaactagaattttcctggttatacacaccacaaaatgagtgtcagcaacattaaatagtggcaagagtgatgggatcaaaaagtttgactcgtggtctgctgtcattattagatgatgtagcacccacgtagactgacaaagtcacatttctaacttagaaacagtctacctcttactttagctttaaggtgtacatttggcttaaattagagctctgagcattttcttgaagctgattttgaatttattaaagagtgtttaaaccttgagatggtgatgggtgacttcatagaaaatgtggactccagagctaaaatgttccaagcagctgattggaggcgatgattgaaaactttcatctcctccaatagatgagtcagtcacttctacgtttgaactttccccttgcgtctcagcttctaaatcctgttgggatgctgaagtggtctgagtttgaaatattaaacagcatatctgtgaggccagctgtaggcttttaatcatttgtaattgtgactcctggatgataataattgatacaaaatgaccagcaagcctaacagactagatatctttcctagttctatcttttggc

SEQ ID NO: 6406 - DNA, 1198 bp, Homo sapiens
gtggataaaacatattctaaatctagatctttctgatataatagagcaaatgggaatttttgttggtgtcatttgagttttcagtgactgtagctttgcttattgtttgcctgttgatcagtttccgttttttcatagaatgcactatgagcatttgctctagccaggtaatgcactaggtactggaaatcaaagttgaataagattttgactctgcccagaaggagtttaccaaccggcaggatagtttatattttcatggaaggacacagacaatgggaggattggatatttccatggaaatgagctcacttacacttgttttattcaatgagatcattcatgtaggagtaggtagggcatcagagaaagggttataggccctcttggctgagccagtgtggctgtggccaggttcactggagtcagagtacagcccgggttcaggagggctgagctgactcaccaggaaaaagcacaatcaggagtcaggccaggtcaggtgagcaggctgggctcacctgcagggcaagcaggcacggagcacgtggctgtgcagactcagtttgttaaatactgggctgcccccagtggtatctccctagacaccacaaaacccacttgcattagaagccctctgtgtgtgggtttatgaattgccagcaagggctgagccaaggtcttcaggcaaaaggttgagcaaatggccctgtattcagggagagcagagtttgaacctggtaccacttggagctatgggatcgtgagacagagttatgtcagctttctgaggcccagtttcctctttagcaaagtgagacaggaatatctgtggctcactggggagatgaaataatgtacagtgagtgcctctgtatagttgatattcattagctgtttcttttcttgtaggtgtgggttctgctttgcaagaacttttattccctttcttcactgctctgtcctgtcacccattcccctcccctatcacatactttctccagtcttgaagaaacctccagttgtggcgtgatgagtaggctcttcctgtgctatggaggggtacctggaacctagaaggcactcaacacatatttgtgataaatggtcagatgggtggagaaatgaacaaatcctccatttaaaggcttctactgccactatagtaaccatgtgtagtggcgcaatctcagctcac

SEQ ID NO: 6407 - DNA, 1134 bp, Homo sapiens
ctgtttgcagaggtaacattaccttccccagccacaggtatgtggaatacggtgaggaaaaaaaaaattaaaaaaaaaatgcaagctgtcaggatgcttaagctcttttcagacatctgcagtttcatccctaccttgttcacataccatccaagaggcacataggctacccaagagagccttggattcagtggtacactccttgggcccaagggctttagcagctggatatggggttccttgattttcctctgggcccaaatatagccctcacactcttggaatttccaggtatgggggtagccccaaaaggaggaatctcctatggccaataaggtatcttgactttatcaaagtagaagagagggtcacttcggagtcaaatcatacactaggcctttgatgctttaattcttcttcagttcattaaaagtaactactaaggaaaggttaaaaacttcccctcaaaaaggaatcaaccccaggaagtaattatttacaacgattttcccaaattttgtacaatctgtcctggaaagcaaaccccttttaaaatctaatgtctgggctttgagtattagctcatttagggtggacaaatgcattactgttttcaaactgctcacatttattcagtatttctccaagttgctatctactcagccttatgaatgcccctcgcttttctaaggccatgtgaaaatcacggcactgcccttagccttgtgtcatctgctttttcgttctgcgatatgcccagttcccaaatcaattataggtacctgtttaggagagaggaagattttacctctcaaagggtgagatttgaaatttacactaaaaagacaactttacatttaatgcttcacttaatgagacattcttttttttataagtctatttttctactcagtttcagaacactaatctgattttcactctgatttttaacgtttctttaaatatttataatgtagcttctttcaaaatattttcatgaaaaattacttttattataccattatgtgcatgttattggtagcaggcatagtttattatttagtactgaaacatgctcttttacctaacagtaaacaagtatgttttgatatatatctgttaatatgcttatag

SEQ ID NO: 6408 - DNA, 1963 bp, Homo sapiens
cgtttaggagcgatctggcaggtagaagtgaggaggccagtttcttgatgcttgggttatttctgctgacaagcagggtggtgggcaagctgctcttagggcaagtggaggcatcatagtgtccagtcactagcaacacaggactgagaagctgcatggctgcagcagcctcttgagtctctactccccactgggcacccgtgggcagttctgcagtggtgtcttggagttgttcccagggactgtatcgtgggcctgctcctccagccccttccaatgattgtacaagcacctaattctctttattgaagctcattctgctaactttgccaagatcaccttctgtttgctgtgactgaaccttggctgattcacaattgttaaatctgttgctttgtaaactgcaaataacttataaatattagctattatttggattattaccatgccatcattgctggacatcccaaactctaaaacttgaagggaggaaggagttaagacataaaattctttctctttctccccaaagttgcaggttatgaggccagggtgcttgaacctgcggtcagctgcaagtgctgccctggtctggcatagttatgagagcaaagagcaaaagagaacatgttgctggcttacaggcaaggcaaatgagagggagagatgaggaggggctgcacagagaggtgggaaatgtggtttcgggtagggaagacagagtgtctagagctttacaaagagaagtttacataggttcacaatcagcagaatgagaaagaatgagaacacctctctctgaaaacctcaacagagctcattctgtaaaaacagcaggctttcagatttggaaatccttttgaggtccctatctggtgtctttcattagttgattttatctgccatccagggtacatgtccctgaataataataataaagataataagttataatgattaattttgacaattaccaccatttactgagtgctgagtctgtgccaggtaagtaaattccatgcagcattgcatttaagtctgtcaacaactctaagagatgaatcctattatttctgtttgacagatgaagcagagagaggttaaaaaattcttgcccaagatcacacagatttacatggcagagactcagggctacctggctctcaagatcatggtcttacttaccaccctttgttgcctgcctctgaacagcaagaatacaaggaaggggctgggagaaaggagaggccaagtatcagccagaagcactgaatacagaagacatggcctccattcaggggttgctgttattcagacaggttatccccatagcaaatcagcaggaagcgtgaaggcaagtggctttgacagaagacccaagcgaaggagaatcaattgttcttatttctaagaacaactgccccagattctacataggaatattgctaaagacacaagatgattctcctgtgcccaagagaagttggcaaggatccatgagaatgagccaatcctcggcaataaatccagaggagagtgagctgcagagcctgggcagcgagttcctcacttcactgtgtgtctagaacacctggggcacttgtttaagaaagtctgattcagtagggctggagaagggcccacagatctgtattcaaaggcctcctagatgattctgatataggtcctctgaagaaatggcttatggtatgatcagagtctccgcctcttgatcctccccatgtttattcctgcctggggattaaaaaatgtcaatttaaaaggacactactcggccgggtatggtggctcatgcctgtaatcccagcactttgggaggccgaggcaggcagatcacttgaggtcaggagttgagaccagcctgcccaatatggccaaaccctgtctctactaaaaaaaggaaaaatcagccgggcgtggtggtgcatgcctatagtcccag

SEQ ID NO: 6409 - DNA, 1336 bp, Homo sapiens
tttcaaagctctgaataagcaaaaattctaacttcttttaattaccttaacctacaggattaagtgttcttcagactgaaatttttcttaccatttaacatacttctttgctacaaaagcctgattttgttaacagccattgctttctgaaaagcatctcctccctggcatcagtgatgctagactctcctgttcttgccctgtccagtgatattcctttggtacagctctcgctccttctcctgagtaggtattctcaggggctggaactctagcacagtgaacatgtgcttttatagccagataaattcaaatcccggctcatcacttattacgctaagttgctgtacttctctgggcctcattcgctcatttgtaaaatgggaaggaataacaatagtacttaccttaaagagttgttacaggatgaactgagagagcacatatgagttgctcagcacgtgcctgacatgcactggtcctcaggaaaggcagatgatgctctctccaccctatgacttcagctatgaccaacccacttcacatgcagccctgacccttcacctgaattccaatgtgtaaatgacagcctgtttaattttaagcttgaatggtccacagttgcttcaaacacaacacaggtaaaacccaatgaaacaccaccgtctaccctcaacctgaccaccactgtcctggtcacagaggcctccttttgcttctgccctctttctaactcctcagaccatctttgtcctataaaaatgtgagccacgtatgtgatttaaaattctttagtagccatattaaaaaaaaaagtgaaattaattttatttagcccaatatgaaaaaactgatatgtaatcattgtaaatattattgaaatgttttttgtactaaacctatgagacctgataaatattctatacttgcagcacatctcaatttggacatgatagtggctgccttactagacagtgtgacctgaaactctggactctgaaaatcttaaattctccactttgacaacccacccccacccccaacccattttaactttccccattctcctgtcttctattttacctgagtcttggctctctgcagctcaggtcagggctaccgcctgagccttgtaacagcactcctgcccctaatccttcttcaatctgatctaccctgaccactatgctcagatatagtacccctttcagtttggtcctctctggctttcccaggaacccccaggaaaagtccaaagggcttggcttcacactcaagatcctctctaatgtttttgccaccataataaaaatcctaataataaagcagctaattt

SEQ ID NO: 6410 - DNA, 1268 bp, Homo sapiens
tctcggttcccttccaatcagctccgggagggcaacgtaatcgactttattaggaacaacagaagagtcggggaactgtgcccggcgcaaacccggagctctgttacaaggctgagatacttgcacggttgtaaatgcatttggtcgtctttgctaggggctgagggtttgcaatttggggtcccgaccttcgcgccctctgctttcccgccgcactccaccccacgctctgccgtggacaggtccgaattgtcggccgggaggttgggtgggatggggtggggtgggagggagtccttgaccagcgccgcgggaagttggagaggtcggaggggaaaagcgtatccgaaaggtgttgcttttggcctcctgcccactcgtgaatatcccttcccccactacttagagccccgagagccggtgactgtgaatgtccccgtcctcttttggcgcttaggagagcgccctcagctcccaccacagccccccgcaggtgacagctcgccggcctcctcggcgacagcgcccgccccgggagacctcccctggcgtgcacctcccggacctctctgagtcaaacaggcttccgggtgaagaaaaccgcctcacggaccgtccactcggaaaaactcccttcccctcactgtctccccatctgcatccatcctcccgcctctctgcacactcgcgccccccgccccctcaagatttgggacatcccggcacaaacttcaatgccaactttgcagcgggcgcggacgggaggttcggtttccttacttcacggctttgttaaactttgcggagtggggagtccacggaggggctttctccgcgcgtgcctttacgggcgcccacgcgatgtggggtgcggggaaaacgcccgggggcgccggcggcgtcgctgccagagctgcacaggcttgggcacctccagtcgtgtgcttggcgttttgtctccagacttgggtttgatgggaacaaattaaagggagtttggtactgtaaatcacggtaacatccaagccaattgtcttaaacaaaggagagtgggtgaagcttcatcaaggagagaaatacctaaaggagacagtgctcttttctctgtgtgcatttatccacaaaacagaaaagggttcagagttttcaaacaatctcttatccccagtgtgggccaaacagcttcacattttctttctggaaccctcaccctcaacacacacacacacacacacacacacgcgcgcacacacacacacgggttggct

SEQ ID NO: 6411 - DNA, 1277 bp, Homo sapiens
ttctaatgtttaaatgttcagatatgaaaaggggcaaatagctcaagcatggtggttcactcctgtaatcccagtactttgggaggctgaggcgggcagattacttgaggccaggagtttgagaccagcctggccaaaatggcaaaaccccctcactactgaaaatacaaaaattagccgggtgtggtggaacacacctgtaatcccagctacccgggaggctgaggcatgagaattacttgaacctgggaggtggaggttgcaataagctgagattgcacctctgcacttcaggctgggcaacagagtgagactctgtctcaaaaaaagaaataaaaataaaaaggggcaaatagaaaaaaaatacagaaattttatttataaaattgcaaatgaaattagatgaaaaaccttgttaatggaaaatgtttacattctcaatttctctcttttgtttagaacattactactggatggaaatccattccgagttcctcgagcagccatattaatgaaaggaacagctgctatacttgaatatttgagagaccgaattcctacttaacatggagttgctttataacccttgtcatgtattattaaccctggttaattctaaggaggatgtaacatttgttttagtatcatcttaaaaggtgattattgtaattgatcttgtagtttcccagtatcacctacctgttggtataattagcctgggccatattcactgccagtaaatatttttacatttttatttaagatttttgtaaggtgttgtatacatttgtaatggtgataaccacaatgtgttcatacatttgttctaaatgttttgcttatgatttatcctgctaactttcattttcttatagcaagcagttttttcaaaaatgaatttttatttaatgtggttcagtattataataacaaagcatttttgtagaactggttttttttctcatttatttttgtattccatacaatgtgaccaattgacttgaatatgactagccagtttctatgtttttgttagatataaaattaaatcgaattttgttgaatactgttctttggcatttaaaaaataagaccttcttatcttgggccacatgtcaaaagaaaaaggaaacaaaaatatattaaaaataagacttttcattacccatgataggacttttgtgatatggctaatctcagtacacatttcaacttaaaacctttttatttacagcaccataattttaaaatttacttgcaatcttggtaagactaaa

SEQ ID NO: 6412 - DNA, 2111 bp, Homo sapiens
atcctgtgaaattgagtcaggctcatcatctaaacaagttaaacctgttgctgtacattttactgtcattctagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaagtatgtttacaaattgatttatttttatatttggggtgatgttggtactttcagaagttatttttctttggagaagtttacttttattattctccttggcaaagcaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaacttatgttcatgttcctgtaaaaccgtatttgtatttatttacgctactgaatgtatgacatttacctcattcattttacaaattctttccctttctgtccacatatttcagtatagtaaaaagaggaagtctatcactgtagtgataattgccatcaaaattgtcaaaaatgatttaatttctatccaaaatagtccttttcttagcttagtatcattttattgcttattttttgtgtgggaatggggttggataaagcaatgaactttagtataaacaaatcccacctatatctagcaaatttatattttcggtgaaatacagatatttgcctttctggagtagtatagaagctgtcaatatgtatctactgtacagtactaaatagtattcatttatgaaa

SEQ ID NO: 6413 - DNA, 1406 bp, Homo sapiens
tccagaagtatacacaagattgattactcctattattttttttaaatcacaggaaaatattgatttcattgtctccaaagtgataaaatcatgtattactcatttttgcacttaaaatttttcttatttattccaaggtggtttgaaggtccaagtatgaaaataaattagggggattaatgtataacagttataaagtatcatgttgtattaaagagcttacttagattgatgtttttaaaatgtatcctgatgaatgtctcaagaatgcatctgtcaagttttttagactgaccagtagcttaaacttttttcaggattttaggtaatttgaaaggagtttagagacccttattgaaaatatgatttaaaaatccaaagcataaaccgtaagaaaaattttaaataaacatctttaaagctgcatcttccatactgatacatgcattgcgtatgttgacattaaatacattttataatgaagaaaaataatcatagtaaaaaattgaaagacctaattactacgttacatggacctattgaattttgggggaacgtgttagtaaacccagactagctttgttgaatagaagttgatcgctgttatttaggaaatgggtagatcaaatgacttagagactgaattatcctatcagtggttacatggggttggagacactgaaaggcagtgatcactgttgcttctaggctcccttactttgtaggaatatggtatactttcaggaatatgctatatatgttttcataagtacagacaccttagggaagaaaaaaagtgggtaattgaagcttatggttgattaatttcctaacagcacagctatgaatattttgctggggtacactggaggtaggaagactactggaaatttttgcacttgaattttgtttttaaagcttttttctttaaagaatggtagaaacagattatccattccaaaatgtcttttctctgatcacaaagagcaaacaaatgtcaatatctcttatgatggtgaaaaaaaggaattaatcgatgcaaataaacttttcacagtattacttttaatgaagatttttcgaaatgtgccttttaatccagttaatgaatgaagctatatgcagtgtttcaaatgaataagtcaaaacaccatatgttttcataataccacatgaaaaatcaagattttgcaatgtaggtacacaaaattctatatgttcttctccatttgtgattttgaaactgtttaaattggtagggggacaatcgtatagtcatcttcaatagccatttagaaatggttaatattcttgcccactggtatggtatccagagaagatatggtttccatctttgagaaaataattctctgatgagacaatttgccctctgtagatattcacat

SEQ ID NO: 6414 - DNA, 1168 bp, Homo sapiens
tccaacggaggctgtggtttccgaccgcccacaaaaagcgcggttggcgggagtgcgggttcggggtcggctggcagctgggagactccagctctgggcggaaacacactgcctcggaggcgccggcgcctagtgattctgggaatagaaggtgcgagggagggagcgggtggctcacttatcgcggtgttttctctctcttcactcctgggggagctctcgcgagaggagcaagaggaagatggccgtgccctgtttttcggtgtaaggcagcgacggcggctgcgacggcgagactgagatcctggtgtcgtgggcacctgagttctagcttcccccagcgagcgcgcgtcccttcgtgcctaggcgagagccggctcttccccgggagatgcgtttgtcccaggctcgggggctcagtgggagttcatgctgcgctggaggctcttggccaccgctctaatcgccttgtgccgccgcagcgccagctccgtcgccagcggtgagcctcccgattcccccccttgcccctggcggcggcgatgaccggggagaagatccgctcactgcggagggaccacaagcccagcaaagaagaaggggacctgctggagcccggggatgaggaagcggcggctgccctcggcggtacctttaccagaagcaggattggcaagggcggcaaagcttgtcataagatcttcagtaaccatcaccaccggctacagctgaaggcagctccggcctcctccaatccccccggcgccccggctctgccgctgcacaattcctccgtgactgccaactcccagtccccggcccttctggccggcaccaaccccgttgctgtcgtcgcggatggaggcagttgccccgcacactacccggtgcacgagtgcgtcttcaagggggatgtgaggagactctcctctctcatccgcacgcacaatatcgggcagaaagataatcacggtgaggagtgctagcccctctccacctctctccttccccgagcctagggtgtgcctccccaggcttctggaatcctaggccccctccagcagactcttctttttgcccatcatccgggccgttcggtaaatcatgatcgactcagtaatagcgtgccagtggtcaaggggttggttcttgtgggtgcaaaggaatg

SEQ ID NO: 6415 - DNA, 2494 bp, Homo sapiens
aaagtctaaacatcagataattttatgtgtgtaagttcctatctcaatttttaatttttttgctagcatcatggtactgaattttgtatactttcacagtcttaagaatgaatgctgagatttagctctagcttactagaatgcctactctctccattatgtcttacagacgccacaggtcatcatctggatcatcccattctggttcccgttcaagttcaaaaaagaaataatgtattaaaatttacatcttaaaaaaatccagtacagtgcatgaagcatatttttaaagaagttggtgtcttacttggtcagaagtgctaaatctgctagtagaggtgcatgcctttcattgcttttcaaaacaatacagctgtgtttatttgtgaagttaaaagtaaatagcattttaagccataatgtcccaaaatagatgttctgtcattcattatttacaaccatttgcttcatttaaaaccatttcagctataacaaagtactttgcttcctaatttaaacccatttttgtcatttccaaatacatcctgtccattggctaagacaggattacctaggcttgcctgaactttgggcatggaagaaagactggaaactagttggaaacaacatacttatggaaaagaaagtcagcctttttatgctgttaacagatgtcagagtgattctcaccaaaaaaagttaaactatgttgtaagcagccaactgtaaatgtctattttgaaattccctatgctaagggtgccttagaatcattgtgtctcttttatccagctttacttttttgctccacatttaatgcaaaagaatcttgtgatgtctacaaggagagaagtgggatatattttcctttctgacacataatttggggcaaaaaagaaagtcttaagagtttatcttttctctgctgatacggttgcttgataaagacatctcaaaatgtttaccaatgttttaagaagctttgtgtgatattcttccaaatgtagttaccaaatataatatggtagaaaaggctaaatcatacttaatgagcaaattgaagtaagcttttaaagtatatttctcttttggtgaaaggccaatggagacattgtgaatttaagtgaacatttgcctcaagatgttaactataaacacactgcatacaattttcttctgaataacaaatgaatgcttattgctgcatgatgtaagcaaaagtcattatttttcctattcatttgaaataagttatggcttaaaatgcttttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaagatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagcatcaagtggtgtttgttagaaataaactagagatttttaaactctgatctaatgttcatttttaaactaattacagttttctgttacctttgatttgttaattttttacactctttatattcacctaccttttatatatgagtgcttggtattttaaattccaaagccattatcactgcaacctcagaatttttaatttaacctttttttcgttttaaatagagagctcctaaattagttgcacacttcttgccagaacattacatccctcattccatgtggtaaaataccatatcgtagtgtgcttcctgaattactcttaaactgtcaccttatataaagcactcaactgtcagcttaacagctaagttttcttaagtttctatttggagtcctttcatctaaacaatattgaatgatatctggtaataaatgtccaagttcagaactagatctaaatagaagatcatctctaggcacaattaccaagctaaattagatctctgaaaccatgtcatctcccct

SEQ ID NO: 6416 - DNA, 1206 bp, Homo sapiens
gaattttgtgagttttaaaatttgtacgaaccatgtctcccttgtgtcatattttccaataatataattacctaacaatgacagaattatacattttccctttaattctctaagcattgagtaaacagaaaaatatagggatgaaatacacacatgccaacattcaaaactttgtactaactagaaacaaaaatagaaggggatttataaaggaaaatgatggagacattttagagaaattaagtataaatcgcaacattctgttttcttggatgtattctgggtagcttctagttacttgtaaacaaagtattcattgtttttgtaataaagtgataatgttttgttttatagttgagtggctttagggtaatttaatcacctggaaagtgatatttttttaattaccttttgttactaaatcttatctaatttaaaatactatgttttgaaagtatatatcttgtatagttatctttttatatgaaaatgaactctaatacatatctttctttcagtgttcatatcacaaagctcaattaaatggtcctggaaaaaaaaaatcgttccatgttgttccaggtcccgttcaagaagttcttccagttcgcagtcaagatctcgttccagttccagagaacgttcgagatctcgtgggtcgaaatcaaggtgaatgaggtagcatctctctgtaaagcagagagaaaaatatttaaaggctgcagaaggtgttgctgctttttttccccttattttgcttctacttgtcgattttattttagcattagaaaactaatgcacttgcctcagcttaattttctcaccatgaaatgtttccattgccagcagtgtgccaagacattcccatgattgaaatcaggtggctattttgcaatatgcagcgtttattattttggcactaagatgttatgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtctcaaaaaaaaaaaaaattaatagtagttcaaataaaattacatatgtaaataaaaagaaaaattttcttcattat

SEQ ID NO: 6417 - DNA, 1171 bp, Homo sapiens
acatctgaagatgcacctttttctccaactattgagcggctactttctttcctctttccctcacagctgtctcccaggcagatgattttagtataatatctgtaatcactccagagctctttcctgatgtgtactttgttctctgaaccctttaaagttgtagcccctctgattattttggtcccagagtttcatgccttttacacattgttattctaaattccacgagtcatttacttgctcataatccaggtctttcaagcctctttgagtttgcacactcggttccacactatttgtctccatttttgtatcattagccaaattgactaatatgaagtctgctcaggatggttcaaaatgaaaataatgtgctagctgaagagtaaatattactgagctatgaatgatgaagatttgctcagaaattttgcttatgagtagtttgttatgaagcatacaaaccctagcattcattagattttttttttagtaaaaaggagtaaatcttttcttttgtatgcaaaatgcacttttcctttaaatttatgaagtttattggctttttaattttctttacaatataatatatttgcaacaattaatcctatattcttcctctttgaaatacacattttctaaaaacatgttgatcatgaggtagatagaataaagtagcttacttgatagcttttccaacaaccttctgatgttttttcttgtgctgtagaggctggaaagctgaaaaatgacattcccagactccattgaaattagatttccagaggtgatttatgttccacacatcagatgtatatgctcaagatttgtttaacagggaaggaggcagtggtgtgtgggtcccttttgctcatgtgaatcttacaggtatgggtatggctctcaagttcacagtgctggttactgcttgctgatctcaacagtctaaagcagtttttttttccagaggcaacagttttgtgatggacttcctaaattatccagcttctttatattggccaaagtagtagtttccttgatgagaaaggatacagtgttctgggagctaattctggttagcctagatagagcctgttatcacagccctttccaaaacaattttgtcaactctaatgccttgtaaaaagtcactttctgcttatgagaccag

SEQ ID NO: 6418 - DNA, 1312 bp, Homo sapiens
ctgagaccgttgctagagaaacaagacaacatccaagttctccacatcatggttttccgggcgccagccaaggcgctccgggggcgtggttacgtgggcgacgcacggagggggcgggtcagaaacaaccgggcggaggcgcaccccagggcgcatgcgtgctgtgcggcgcggtctcagggaaggtggggctatggcagctgctagggaccctccggaagtatcgctgcgagaagccacccagcgaaaattgcggaggttttccgagctaagaggtaccagagaaggcaccggagttctcctgggcaatgcagagggagggtgcttttacgtgccaggaggtttgctggactgtcacttcccgtttacttctcatctgtaggcctatgacgctccccaggagtagctagctaataatccttttgagttttttattcttttcactgtccctgcttgacatgcttgttgcttactttattcttagtagtatagatattaaaaatgagggcggaggaagaagaagaaaatcttactagtgaagttatgcattgattagctcattaataaaagttgctttaaataaatctaaaagatacgaagcacagtattttgaactttatgagtagatgccagccccctatctacttcacgctttacattacgttcatctacttctgtaatgtaaccgtttgttgagggagtaacagaacatggaggaattatggattaaaaattaaaaggaagaaatttgttatcaaaaaattggctatgacacttaatccctgtacacctgtctaataaaagtgattatatttgtgttgcagtgactgcttaaaaaatactgggactaattcttggataacagtaaaactttcaggactattagattctagctgacaagttctgtttgttaactaattaaaatgctaaatcattttgtttatcaataaagagattccaactgtctactaaaagtgcacactgtcttttaaagatgtcatcagagagttgggaccttctgttatccagaattttatgttatattctaacagcctatgtaagtttgcatggttcatcttaaagtaatagaaaataaagtacccacatttataaacagcaacattgagggaagggatctttgggttgtgtctttcttagtcacctaacaccaagtgtccgtgatacataagaattgatttgcaaagctggagatttgtttatgtttatctcctcttcttattgaagaattgaggcaatagtctttggcaagttaaaagtcgctctcttaatcaagaaacattatgtcattcag

SEQ ID NO: 6419 - DNA, 1312 bp, Homo sapiens; identical to SEQ ID NO: 6418

SEQ ID NO: 6420 - DNA, 1206 bp, Homo sapiens
taagcacggggccctatgcaagctgcacaggttgcacatacgtgaggcttggtgctttaagggaaatgggtgccttcccactcaactgggtgtttaaccctcctccccacattgagaaagaggcagagtgctgcagattctgtgatgtgccaggacttgactcctgctcacatgtggcgcccttgggttccaggacaatgggtagctgtttggaagcctgcaagggtggatgttttggaagctagggcaaagatctcagtggctacccttagatggagtaaaccgtagtccttttcagagccacttgatttcaaatgtgagcaaaggcagtgatgagcaccacgttttgaaaacaagggctttctccattttgagatgagttatatgatttgctgggttaagtgttgaagagccatgaaaaatgatcaccatctttattcttatagatggctccttgagcaggctttaatttgactggagttgcggggagtaaatattacactcccatataaggtgtataatagtgactattttttagttatgatttttggcttttaaaaatgggctttgaccttcaagcctcttctttccatactctactgggcttctgtcaacattcacgcttctctaatgcaataggattttaatattcacaaatgctaatgtttttaaacttaacagtcctttaatgtcctgggtttttatgcattctattcttgccaagcaagaatttatgagccctttttggttttgcctttaatgtggttgaatttaaactataactttaactcattgcaaattttatttatttattcatctattttaataacattttttggaacagttttaggtttacagaaaaattgagagaaaaagttcagatagttcccatgtacccacttcatctgcccacacatgatatcctttatcttatatatcctacatcttacattagtgtgggactttttgttacaattgataagccaagattgatgtttcttgactaaaatccatatttcatgcctctcttcatctctcttcaattctgttctctcctgtaactattagtctattagtcctatattatacctacttatgggcctattctccatattgtctaatcttttcatcccccttcaccagcttctcttcatctctatgtgtgtcattctgtgtcattcactcgggttattgtttagttaactc

SEQ ID NO: 6421 - DNA, 1209 bp, Homo sapiens
gggtaagaataaaagactgaaggagacagctagctaagaacagttcagaaaattagacaaatattttggccacattaaactttagttttcccaaactttctgaaatgtaaatatcttttctttttttatattttgaagactcttctccaaaattttgataaatggctttttataataacttaaccaatctttagagaattccatattttcagactttcacaaaatcaggttttggaatctgtagaggctacagaccctatatatggtttgattcggttttatattacaacacagcttatgctactgtctaaaatgttgaataaatcaaagtatttatgtactaaagatatttaacctacacttatatttttcttgcagatttatgaaggtacttcacaaattcaaagacttattgtagcccgtgaacacattgacaagtacaaaaattaaaaaaattactgtagaaatattgaataactagaacacaagccactgtttcagctccagaaaaaagaaagggctttaacgttttttccagtgaaaacaaatcctcttatattaaatctaagcaactgcttattatagtagtttatacttttgcttaactctgttatgtctcttaagcaggtttggtttttattaaaatgatgtgttttctttagtaccactttacttgaattacattaacctagaaaactacataggttattttgatctcttaagattaatgtagcagaaatttcttggaattttatttttgtaatgacagaaaagtgggcttagaaagtattcaagatgttacaaaatttacatttagaaaatattgtagtatttgaatactgtcaacttgacagtaactttgtagacttaatggtattattaaagttctttttattgcagtttggaaagcatttgtgaaactttctgtttggcacagaaacagtcaaaattttgacattcatattctcctattttacagctacaagaactttcttgaaaatcttatttaattctgagcccatatttcacttaccttatttaaaataaatcaataaagcttgccttaaattatttttatatgactgttggtctctaggtagcctttggtctattgtacacaatctcatttcatatgtttgcattttggcaaagaacttaataaaattgttcagtgcttattatcatatctttctgtattttttccaggaa

SEQ ID NO: 6422 - DNA, 1156 bp, Homo sapiens
cctgttaagagttgagcagcccgatttctgaacccctctaaaaagctgtggctgattggtggcttttttttttcttggagagggggtgtcaaagatttctttaaaatcgttagtgatgtggtctcgctttaagatttttaatgggatcagaagaaaattcggtacttaatcacttccggtaatcttcatgacctgttatagtgactgcagtgtactctcaatgaggaagatatagatacgaaaagaactagagccgcatcacatggggacttctgcaaatacagagactcggattaaaggtggagaagatggagctaaaggaactgcttatttaatacatttgaacaacttttggggtacttagaaggtgctttgaaacctgcatttgattaagcaagaattcgcttgcaagttaagggttagatttttttattttttaaaaatatgctttctgccacatgtaaaccgtaagttgtcctgaaatgataagctttgatattctatggtgtttattttttacttatctttttgaatgaaaagtgaacaacaagaaatgctggtggtaattttttgggtcaatgatgagttggcatgtattctgaatctaaagttgattattactactttagctctagaattactctgagacctgaaaattacctgaatcgtgactaagacgaagcctgaatgatttaagttcttttttgttggatacaatttgttgttgttgttgttgttttggttttgtttttgagtcggtctccggtcgcccaggatggagtgcagtgacacaacctcagttcactgcagccttaatttccctggctcaagcgatcttctacctcagcctccctagttagttacaatttttaaatggaacgttttcctattacaagatgaaatcaagtgaaaattgagatgtatgttgaatctatgctgtggggcagaagaacgttgtagaggtaaacattgatgagattaccactttattttgaaagggcactccacagaaggatgttattatcaagtcagatgcaccggacactttgttattggagaaacatgcagattatatcgcatcctatggctcaaagaaagatgattatgtatgtataatttttttatgttggaaagtttattttaaagaagtgtgaca

SEQ ID NO: 6423 - DNA, 1156 bp, Homo sapiens; identical to SEQ ID NO: 6422

SEQ ID NO: 6424 - DNA, 1023 bp, Homo sapiens
gctcaagtgattctcccacctcagcctcccaaaatgttggaattataggcaagagctactgtgcctggtcaatttgctgttatttttgacaaaggaattttcttgggaagtaaaggcacttcagatttagctttcctcctgactaccctaaagtgaaagttaagcttgaactcaatttaaagtggtagttgtgcagtgtttgtttttagatgactcatgtatgatttggtaacacctgccttgatttgatctatttttattgtaggagaaattgacacaagattctctttttgtgcggtggcaactttggctttgttggtaagctttgaatatttgattgaaatgattaaagttcatgaatactctggaattttttttttttttgagtctgatctgctgaatactctggaatttaacaggcatctttttttttgtttgtaggggaagcttgatgctattaatgtggaaaaggcaatcgaatttgttttatcctgtatgaactttgacggtggatttggttgcagaccaggttctgaatcccatgctgggcaggtaatttatgaatacagatgaaaatgtattgtcattttggaagccagtgtagtaaaataagaaaattggttatttcagtgtttgtcaaatacacataaagttaattcgactgtaatagggcatcttacataagaattgcttaattgctatcattactttgctttatatactatatacctttctctgtcggtggattcgtctgacctaagcaaacataagtgggtttataagcaccaaaacacttttgttttccattaatttttcactaaccatacagataaaaaaaaaaacaacacatttttctttctttcctaagataaattatgaacctcttttcttgtgccagagaacactgaatatgtgaatggatggctgtgaaatactagccatgaagaaattttgacaataatatttcagtgcagaattgcatactagtaatagtatgcttggattttttcagatatgtggtat

SEQ ID NO: 6425 - DNA, 1094 bp, Homo sapiens
tttatagacttctgtcaccatattttgaagagcaagggtttagttgattttaagcaggtgtgtacccccctggacagtgcttgtagaaaaacagaactatacccatggatttcatgattatactgctagcttcttggttaaggggctgagttaggcattcattgcagatagaaacaaagcagatgcatgcttatcagtgagtactgagatatttagcatggttacctatgaattgaagtttggtctcttcttacccattaattgattatctttcattctaagcaagtatttcataccctgcatatcagtatatccctggatttcgtccttccacatggtttgacactttgaacatcagattacctaagagtgagacttaacccacttttaaattgttctcaaaattagggaaataaaagagaatgaaattgtggcaacttttttccctcctagttaccagatgtatgctactcatggtgggtcctggcttccctaaagataattggaagacttcattggattgatagagagaaactgcgtaatttcattttagcatgtcaagatgaagaaacggggggatttgcagacaggccaggagatatggcaagtaatatttctgacatatttctataaattatttcagcgtttgcattacttcatggttccatggatttccagggtggcattccgagtgttgctttgaaagcagtttttttttctatttattgtagagtgtatgaaggatatagaacaatcttacagaaatttcttgtcgcttgttgctaacaaaattagtatatggtaaaggtcaggtattcataatttgaagttaaagaagttttcattttgtgatctgtatataaattcttttttaaataggtggatccttttcataccttatttggaattgctggattgtcacttttgggagaagaacagattaaacctgttaatcctgtcttttgcatgcctgaagaagtgcttcagagagtgaatgttcagcctgagctagtgagctagattcattgaattgaaagttgcatagtatagttttgccattttaacatttctgtatttgaagtgcttatcgaatc

SEQ ID NO: 6426 - DNA, 1212 bp, Homo sapiens
tggtggcaccacttgtgtctggaaaaatcagtttgtgattatttctaaaccaaggaattttgttcctgctgattgcatatcaaatcctttctcacactttggaccccccacttctttgctggctaacagggagaattaggggtgcaggaaacagctttcacagttagattatgctggctttggttacaaaagttaatgcattagtgctagagttcactatcttaattactgggttagtctcatatttaaaaagtcattatttaaggattaggaatggggaaatcgaagactggtgaaagacgatagttttttttcgtgttgatgattcatagccttgttttagacttttataagtaataaaaagcactggatactgctgatttagtctcttcctagaggctcatatttgtgtaaagaaggaaattactctgtaagttttcccttttgctttttcctggctctctctttctgtgcctttgtctatattgaagcctatttttctgatgttccttcttcatctccagccttcatgccccttcccaatacaggtgttgcagggatcgttagctagaatgtctaaggaaccatactatcaacccaagagaagggaagcttggtgaactcttaaaaccaagtagatgaaaccttcttgcagagtcccgggatataagccattccattaggaatccttccctgggaaatatgaatcattgctatgcctgatataaaatcactgacatggtgttcatgacagctcaccatgtcatccctcacacctttgccatggcctggaggctgactacactactacttgtgtttgttcttttattgctgaccttgtcaaccaggtcattctttctctcttcctatttctaagagaaaattcattccccagaaccagcaagtacctgaaccattgccactttatatgtgctgccttatttatttttcatctcattctttggctgggagtaaaagaacctttctctcctaccctggtttatgttgcctgattatctgttcgtcggctggtttgatgtttatttaattctgccatgctgcttaaccttagaagcctggttttgtggcttgatttgagccaagatttctgcatgtgacttctaacttgtgggtaaattaaggtttgtttttctctcacccatctttgacccatgatattaaaacgttatttgaagaaaggacatccaaccc

SEQ ID NO: 6427 - DNA, 1445 bp, Homo sapiens
aattggcctaattttggttttctgactgcagaagtggatgcttcctctgcctgtctctactctcagctcttattgttttttttggtgaaagagattaatccaatgctccgtggaagtagatatcaagaactcttgagcagagagaagttttgcattctgcctgtttgacatttacaaggtatttcattaacactgtgggcgattcaatccccttttatttttggctgcccttgctgtgcctctgaaggaaggaaggccattcttttgccaggtaaggggcaggaaaatgtgtgactccaaagctacctggagcctgatgggggttaggttggtccttgctgcccctgctggtcacatggtccctgcttactctgcttgccttttgtcttcctctttgtggactcctattgatccttgtacttcctctggcagagtgtttatcagattatattgaaattgcctgtttacttctgcctctcccacagaacagtaaaaacctcaaagactggggctctttctttctttcttttctttctttctttttttttttttttgacaggttctctctctgttttccaagctggagtacagtggtgcaatcacagctccttggactcctgggtcaagggatcctgccaccccagcctcctgagtggctgggactacaggcatgtaccaccatgcccagctaaattttaattttctaatttttttttttttttttttttttggtatagagggtcttgctaagttgccagagtgatctcaaactcctggcttaaagtaatcctcccacccaggcttccaaagtgctgggattataggcatgatccaccgtgcccaggcttgttttttattgtacacttagggacttgcctatggtaggtactcagtaaatgtttcttgaaataattaatgacttgggttgatttggatgaaagacggaatggacggagggcattttttagtagcctggagacttggtttccatgcaccatgctgggatgtccctggcagcccatctactgagctggcaccagcatgcttaccagtctcctttgtgacagtcccaatggatatttttattagccagcatgatttatttcataatgctgagttgcagcacccttcatggctagagatttttgctgtggagataagttcttagaactatctccatttccagaaaagagagggtttctctcgtctgttgcccagaaaagaagtcagtttacgtatgcatcttccctgggtcaggctaagaagtagccccagcactggcatgctagacttggagagtctaatattcttccagccaaaccctgaagcaaaccacacctcctaggtcctgcaagtccccattaagtgtgcttaagtcatttgaactcctagagaatccatgtcagaggaggagaatcagcattcaacaaaagatagcatgtagt

SEQ ID NO: 6428 - DNA, 1150 bp, Homo sapiens
tgaatgattggtatgcataaataatactagcctgctgacatttacacatttgcattaatacatcttaagactgaaatatgatggaaatgctgtagggctgatagtggcacattgtgccacacttaacaatgaagaatgtgatcatgttcctggcacacacatatgcaaaaggaatgttaacttttctagagaagcagttgagagccaatgtgagatattctgctttcctatgggtaggtgggcaattgcagcttggatttcactttagaaatatgcttgcaaatataggcacattatttaattaagtaataattgagaaagcgatagtccccattaaaagagcaaagctaattctgggctgttaaaggactctgagctgccctaaataggtcttaattagctggtgccaatgtggctccaccttcagggatggatgaaattaatgaaagctagcagcaaatagaatcaatatttcaagatgttcctgcctcaggtgaagaggatgaaaagaaagggagtcattttcaaagactgtttaggaaacaatgcacataaatcaatttctaaaaacataaaatgggacactgatttgtgaatacagtatcaagatctctacctggctcatctttgccagcctgttccatccattcccactcaatcttaaggagagaaaaagaaatcagcgatgtgtcattcctcactatctttgggggtgacagttttataagctagcaagggttttaagggcagcccaggttttgctatttcagcttggccattttgaaagtttcttgtgtcattgcgtggtcaagtgtagagatgaaattggctctcatccctcaggtttgcaaacctttagtaatatctagagtggaaaggggtttcaagtcttcttccttgaaaatttgggaatcctcttgtaggtccctctgtcaacacacaaggaagccgccttaacacacacagtgtagcttgaaggtggagggcaaaaaccaaaaccaaaataaaacaactatgctagccatatcttagagtcgccatggggtacagaaatgtgcatagtttgcccgaagaaatgccatacctagattccacaaacaaagatgtcaggttattcctaactcagaataaatacctgctaaccccagga

SEQ ID NO: 6429 - DNA, 1571 bp, Homo sapiens
gtagcaaggactggtgagaagggagctgtgagtgcttcttgaatgtaggacctgctccttactggggagaatagctcactcatttctaccttcctccaggtctcatgaacatgcacagtcctgtgtgttgcatctcctaatctcatctgattctctgctgtttgcctggtcttggactaatttccctttagcccacatgatgatctttaagttaagtctcagcctatttagactcaggctgcctcactcaccttgcagttgccatctttattatattatggcagtcaaaggttattttgtttggacagagaagttactctactgtatggtggactacctgtcctgaacgttcgcaaacatatccttttgttttctggagttcctcctggtttgttttctgatggatttctgttgactcccagattgaaccaatgtttatcctgtgtttggtgtatcaggcttttctgttctggttgatttcctgtagctaatttctagggagacttcaattcctcactgaagtcaagttccttgtcatagaggcccagtatttctaactcccattcagacagaaaatttgtttttattacccacaagagaaaatgatctggctttcctgctctaaagatacccctagtactactattttttccagtcttgtgttttcagatatttttctttaattgaccttctctatggtcagattcgtgactgtattccttcccctagtttattaattcttttttttttttttttttttgagatgaagtctcactctgtctcccaggctggagtgcagtggctcgatcttggctcactgtaagctctgcctcctgggttcatgccattctcctgcctcagcctcctgagtagctgggaccacaggtgcccgccaccacgcccggctaatttttttgtatttttagtagagacggggtttcactgtgttagacaggatggtctcgatctcctgaccttgtgatctgcccaccttggcctcccaaagtgctgggattacaggcgtaacccaccatgctctgccttattaatttctaagagtcttcctagaacactgtaagtatgcttaacctggtattatagagacatgtaacagaactaaatactttccactccacaaaagaagaggctattttgaactacatgtatcttcacagaggttactccagtaagtaacttgtggaagggagggtcattggaatatggaaacagacaaaataaaatctgttcccttttcctcaaacctcacatagcctcatacaattaaatgagatcttggttacctctcagcctgtaaagattcccctgagtgtgtatgtgtcaactcctgtcttggttcattttatgctgctataacagaatactgactgggtaatttataatgatcaggctgcgtgacttatgatgaacagaaatatatttgggttatggttctggaggctgagaagtccaagagcatgctggtggtatcttgtgagggccttcttgccatgtcataacatggcggaagccatcaaacggagtagagagaacatgcgcaagggtgggataga

SEQ ID NO: 6430 - DNA, 1213 bp, Homo sapiens
tgtttcatatctataacctcttggtagcttccccaagaatagttaattgtccatgtgaccaggactttatatccttatgtcacctacttctgcttccttcccccaccagtttctgggaagaattttgccagatcaccagatgcacacagttagctactaaagaatctcttgtctgtctctttagcttctccataaatacacacatttcttcatttgtttttaaggcaatgctgtatgtgtaatcatgtgtgaatctttattgaacacttatggaataagccacctgttcttacaaattagctgagttctcaagaaggcccaaattagtgaattagttgatgaaggaaatttgttgcggagacagcaggcagctaagaaatttttcagcttgtcaaaggtattgttagtctcacagcttggcaaggagagaagaagataccattttgaagaattttaggtagtgtcttaataccttacactcactaaggacgaaaatgaaattgcttgtcttatcagttaaagggaagctttgctgatgtcagaccatagcccagaaagttaactaaaagttttgtagaagtagataatcttttcctggtgatcgatgtggtgagattggaagtgagttgccaggggagtcatggggaaataggcttaatcattttatttgtatttgtgctgaaggcagtgctgaacaaacctctgaagtcacttagccatgtcttttccagggggcatgcaaggcgactgctgatttctacagacactttttaagcgattaccagtgctggcaagtggaactacctttccggtcctcttacaagcatccagtcacttgctgaaatgtcataagcgatataaacctgctgacaggccaggatcattgcatctcctgcctcctccttccacgtaacaaatctcattgttgattggcatatggcagcaagcatcccaacacccagagtggtgttcttatttctgagggagcagggtctgtgtgtgaattgcacacacagggagcaatcccctgccctgatacaggcaacctgagtgcttagttccttctctgctcagaacttagtgtgactatgtggcctacctcacattgtttgtgttacacctacacaggaaaaaggaaaaatgtccttttgattccatgcttgtagagatgttcatccaatttgaatgaacatgtagccaaggtagtgtcttc

SEQ ID NO: 6431 - DNA, 1168 bp, Homo sapiens
gctcgtccgcactctgaacgcggccaaggtgccggccgacaccgaggtggtttgtactccgcctactgcctatatcgacttcgcccggcagaagctagatcccaagattgctgtggctgcgcagaactgctacaaagtgactaatggggcttttactggggagatcagccctggcatgatcaaagactgcagagccacgtgggtggtcctggggcactcagagagaaggcatgtctttggggagtcagatgagctgattgggcagaaagtggcccatgctctggcagagggactcggagtaatcgcctgcactggggagaagctagatgaaagggaagctggcatcactgagaaggttgttttcgagcagacaaaggtcatcgcagataacgtgaaggactggagcaaggtcgtcctggcctatgagcctgtgtgggccattggtactggcaagactgcaacaccccaacaggaccaggaagtacacgacaagctccgaggatggcttaagtccaacgtctctgatgcggtggctcagagcacccgtatcatttatggaggctctgtgactggggcaacctgcaaggagctggccagccagcctggcgtggatggcttccttgtgggtggtgcttccctcaagcccgaattcgtggacatcatcaatgccaaacaatgagccccatccatcttccctacccttcctgccaagccagggactaagcagcccagaagcccagtaactgcccttcccctgcacatgcttctgatggtgtcatctgctccttcctgtggcctcatccaaactgtaccttcctttactgtttatatcttcaccctgtaatggttgggaccaggccaatcccttctccacttactataatggttggaactaaatgtcaccaaggtggcttctccttggctgagagatggaaggggtgggatttgctcctgggttccctaggccctagtgagggcagaagagaaaccatcctctcccttcttacactgtgaggccaagatcccctcagaaggcaggagtgctgccctctcccatggtgcccgtgcctctgtgctgtgtatgtgaaccacccacgtgagggaataaacctggcactaggtcttgtgaaaaaaaaaaaaaaaaaagagagagctattgtacaacatg

SEQ ID NO: 6432 - DNA, 1467 bp, Homo sapiens
ttcatttggaaaagaaacaattgtgaagacattaaattctcactaacagaagtaactttggttaattattttttgtatatcctcccaatcttttgacttatgcacatattttttcccaatatggagatcatatggaatgtactattttgtaatgtcttttttcattttacaatgtattatcaaccttttccctctcaaaaatacattgtgaatgactgcatagtattcactttatgaatatttaattcatttcacagtcttctattgttggaccacttacattgtaccaaatgttttcctttggtttattctttaatgtattaatattttactgctggtcactcatggaatcctgcagctttaattaaaagcaaagatgaaaaattggttttttaatctatggcactgacaatctccaggaccttatatgtttgttgtcagtttatttgggaaattttagacctttgataatttcacgtactgactgctcaagagaaacataccccattgtttttcatttgtaagcgttctgtgatcttctacaattggtcacgtcctcttcattttccatcttgaaagagagagccaacaaggactttatttcattctgttttaggtaaacctccttgcccactggctgtatctatactttccttgagaaaaatcccataaagtggatggacctgtgaagaaaatgtatgcttatggcctagccttcatgtctggctgatgtatcctataaggcagtaagccccttttctagtctctggtaagatgcaagagctcatatccccatcactgacattttagtttggaaataatattgagactgtgctatgaccaacccctgatgttgttttttcttttcaaacttttgcatatgagtagaggaaaagcctaaaagttaagtatttatgtctggggggataccttcaggtgtcttatctgttttatgcaagaatttatgtgttcatctttattcagtgcaaagatttttttttaaattttgtttataattgtaggtaacattaagacaactcttcctccacaagaaaacctcctaaaattaatattccttaagatttgtttttccttttgcacttataatattaccttttaattgcatgcaagattgtcatacttttcaaaaggcaaaggattgactgtgttatctccctagttagaacaaatgatattgaggctttttgccagctctgaatctttattttaattgatctttttattgatgtgttatataaatgaggaagaaaaattttgtctgattatgtgaaggatctttctgtacatgaaaagaagggaaaataaacttgcaattgaatagactgattatagtagcactgagacacaaaaagattgaccatgttgccctccagacactcatacaaggtcgtggacaccacggtgaggcggagctatttagggtggtaaaggaattatgattgttct

SEQ ID NO: 6433 - DNA, 1277 bp, Homo sapiens
aagaatggcttttatgtttttgaatggttagaaaaaataagtctaaagaaaaataacatttcatgactagtgaaaattacacaaaatttgaatttcagtgttgcactataacagcagagctgcatatttacaactgagaccatatggcctatgacctacaaatgctttaaatatttactatctagctctttccctaagcagcctgaggtaatctgtgaaaatggttcgctactcacttgacccggagaaccccacgaaatcatgcaaatcaagaggttccaatcttcgtgttcactttaagaacactcgtgaaactgctcaggccatcaagggtatgcatatacaaaaagccacgaagtatctgaaagatgtcactttacagaaacagtgtgtaccattccgacgttacaatggtggagttggcaggtgtgcgcaggccaagcagtggggctggacacaaggtcggtggcccaaaaagagtgctgaatttttgctgcacatgcttaaaaacacagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaaataaaaaataaaaataaataaataaataaataaatatttactatctggccctttacagaaaaagttgcccaacctatacattagaataattatttagaagtggacttgctgggtcataagttatgtacattttaaattttgctagaaacaagtaaattgctatccaaaatgactgtatcaatttatactgccaccagaaatgcattaagttcctatttcctttcatcatcaccacttaaatttttataagaaatagtatctcattgttttaatgtccatttcccttctaaaatcacctttaggtgatcactaacatgagtcttttcctcttcttaaactgtatttcttttttcttctatttggtttgtcttttaaaaaattaatatgtggcgttatttcgataatctagacagaaattctttgaaatagatgttacaaataacgtcaccacactttttcttctcttt

SEQ ID NO: 6434 - DNA, 1160 bp, Homo sapiens
gtttgggggaatcacctgaacttgggacgttgaggctgcagtaagccgagatggtgccatggcataatagcctgggggagaacgctgtctcaaaaaaaaaaaaaaaaaaaagcaaggtaatggaaaggacactggagtgaaaattctgggtcttagtcccagttgtggaagtgaagcactcagtaagtgttgacaaagaactacctttcattgcacattaggagctagtaaatgattcgtgtgtcttactaacttttgtttaatcctcagttcctctatgaggttcattactattatgttctccattgtatacatgagaaaactggaggtgcagagagtatgttaaatatgttagctctcaataataattactgtgtgtgggactggagataccaagccgtgtccttatggaggttataatctaatgcagaagaccagcaataagtaagtaaataaaaactattacttcaattcaggcagggataaatgctttgaagataagtaatgctcagagaaaaataataatgggagaatggggaatagtctgccattttagatggaataagcaaagaaatcctctattggccagggtaaattcaaatagaaaccagaatagagcaagggaatttgctgcatgaataatctgtaggaaggggcagaaggatagcagtagcacacgggccctgagccagtagaccgtggcttgttctggcaacattaagatggccagagtagcttaagccaaatgagcaagaggagagtagtagttgatggcgtcgaagagggcacaagccagctcagatgtggccttgaaaacacatcattgtaaaggagtttagattgtgttctgatgtcttctacatacacacaggtctttcgctagacagagacctctaaggtcttttccagtattaaaatcttatgactttaaagtagtgatatcatttcaagccattcaaatcagtaatgtgttctagagaagagttgatttgcacttctagatactcttcaggggcaaagccatttacccttgctaaatttttcaaggtggctgtcagctacagccgtagaagcctgtaaaagatggctggacctttctgcccctctgctgtctcattttccttacctgtgcagtcagagctgtgctgggcatggactgt

SEQ ID NO: 6435 - DNA, 1204 bp, Homo sapiens
ggtaagccctaggaaaagaggactttcttcttcagaaaaggataacatagaaaggcaggctatagaaaattgtgagagaaggcaaacagaacctgtttcaccagttttaaaaagaattaagcgttgtcttagatctgaagcaccaaacagttcagaagaagattctcctataaaatcagacaaggagtcagtagaacagaggagtacagtagtggacaatgatgcagattttcaagggactaaacgagcttgtcgatgtcttatactggatgattgtgagaaaagggaaattaaaaaggtgaatgtcagtgaggaagggccacttaattctgcagtagttgaagaaatcacaggctatttggctgtcaatggtgttgatgacagtgattcagctgttataaactgtgatgactgtcagcctgatgggaacactaaacaaaatagcattggttcctatgtgttacaggaaaaatcagtagctgaaaatggggatacggatacccaaacttcaatgttccttgatagtaggaaggaggacagttatatagaccataaggtgccttgcacagattcacaagtgcaggtcaagttggaggaccacaaaatagtaactgcctgcttgcctgtggaacatgttaatcagctgactactgagccagctacagggcccttttctgaaactcagtcatctttaagggattctgaggaggaagtagatgtggtgggagatagcagtgcctcaaaagagcagtgtaaagaaaacaccaataacgaactggacacaagtcttgagagtatgccagcctccggagaacctgaaccatctcctgttctagactgtgtttcagctcaaatgatgtctttatcagaacctcaagaacatcgttatactctgagaacctcaccacgaagggcagcccctaccagaggtagtcccactaaaaacagttctccttacagagaaaatggacaatttgaggagaataatcttagtcctaatgaaacaaatgcaactgttagtgataatgtaagtcaatctcctacaaatcctggtgaaatttctcaaaatgaaaaagggatatgttgtgactctcaaaataatggaagtgaaggagtaagtaaaccaccctcagaggcaagactcaatattggacatttgccatctgccaaagagagtgccagtcagcacattacagaagaggaa

SEQ ID NO: 6436 - DNA, 1202 bp, Homo sapiens
gaacccaggaggtggaggttgcagtgagctgagatcgtgccactgcactccagcctggcaacagagtgagactctgtttcggaaaaaaaaaagtgtgcaaagtaaatacagtaataagtatcaggagagattgtagaagtctatagataatgtgttatgatgaaaaacttttgcctttttccctgttgaaaatgagatctgagaagacagtgtaggatagtatccttcggagatctttttagctatggtttactgtcacataattgcagttattgtggagttttaattcagaaaattcggttgtaaaaagtgcctttttaactcaaatatatatgttaataaagcgggactgacatgctattaccctagggttttatttccttcaaaatataaatgtaagtttaattgctaataccacaaattcttatggttccactattaaaataacatctcaataatttttatggtatagatgttatataagttacaattaaaactttttttaaatttaaggatttgttcaagtgtgctatctttttttgttatcaaggattttaaaatacccagtaatacaacattaaaaactcctctggttgccgtatttgatgatctggatatagaagcggatgaagaagatgaacttagggccagaggtaaattaatcctgtgtaacgcttctttgtatggcactgcccatttctttagaaaaccatataatgtaaaagtttcaaaatgtggaggtaaaatgggcttgataattaaaacaaaaggactctgaaatttggcctagtaaaattttatttgcaaaacaaacttttggtttctctggtgtcagtttaccaaaggtaggatcctacttactcttttgcagttgagccttatgatctttttgtttaacttgccttttgaggtctgtttgaacagtgtttctcatttttctattgtcagtgatggggaggtattaggtataaaggtattcccttagcagaagttccggggaaaacatttggaaaaagaatcaggtgatacacttctcccttcttcccctaaattgagaaccggtctatttggatttttcatattcttttaggcccactgttcttagtataagcttaaaattttctgttttataattgatactagtggtacattgaatgtatatttagataattatctggaaattaacactttggtttaagctt

SEQ ID NO: 6437 - DNA, 1689 bp, Homo sapiens
atcttctttgaattcaaaccctacaagcctaaaaaaaggtttaccagcaccaagtgttttgctttcatggagatggatgaaattaaacctgggccaattgtaatagaactatacaagaaacccactgactttaaaagaaagaaattgcaattattgaccaagaaaccactttatcttcatctacatcaaactttgcacaaggaatgatcctgacatgatgaacctggaacttctgtgaattttaccactcagtagaaaccatcatagctctgtgtagcatattcacccttcaacaggcaggaagcaagccgtacccagaccagtaggccggacggagtccaatgcaaagctgtaccacagaattcagagtccagcacatcactgacgtataggactccttgggatacaggtttattgtagattttgaaacatgtttttacttttctattaattgtgcaattaatagtctattttctaatttaccactactcctaccctgcttcctggaacaatactgttgtgggtaggatgtgctcatcttcagacttaatacagcaataagaatgtgctagagtttacacatctgttcacttttgctccaatatgctcttttgacttaatgtcaagctttgggttgatgtgggtagggtagtgtcaaactgctttgagaggaatgggaccagttctgctgcctaagaaggtctgtctggatgtttataggcagcacctctgaagtggcctaaattcaccctgatctgatagttttcctgcttagaaagtgtgccttggccagatcagtatcccacatgggagtgttccctaggttgtagctgtgattgtttccagatgaccagattgtttttctgaaaatgagcatatttttagtcatgtcgattagctgttcttctacatcacattgttactctttctgatgatgattctagggttaacattggaaccatctcaaaataattacaaagttttagatgggtttacaatgtcttctaaacaatgtaatctaaaaataattgagtcagatgctaacgagatactgcaggcataagtgctgtttttctgacaactgattgtgaaaccttaaaacctgcatacctcttcttacagtgaggagtatgcaaaatctggaaagatattctattttttttatataggtagataggatcgccatttatttcctatttagatatactgacattcatccatatgaaaatatgcaggtcattagcttactataatttacttttgacttaatggggcataaataaaactttcatagtacaaaaaaaaaaaaaaaacatttatgcacataaaaaccaattatatcactatctattctcctttctccaagttatgcaactctaatttcttcatccttttctcacactatcccttctatacacttattattttggctgaacatatgaacacaggaataattattttattttattttttttagttttttttggtctctttttttagagatggggtcttacaatgttccccaggttggtcttgtacttctgtgctcaagggatcctcccacttcagcctctcaagtagctgggactacaagcatgtgccaccacacttggcttcaggaagaattattttacagcagagttgtataacacaaagataaaacctgtctcctcaagaagtactatgtct

SEQ ID NO: 6438 - DNA, 1168 bp, Homo sapiens
aaaagagcattcctagcagagggaagaacatggatcaaggtgcagagtggagcctgtttagggaactacaagttctttgatatgttttggaaacacaatataggtggggagtggtaggagatgaacctagaaagctgggcaggacataaattatgaaggtccttgctttgtacctttagacaaaagggagccgttgaggattataagaagtcataatcaaatttatgagtttgaagaagtctggaagtgtggctggcacagtttaaatattttatccatttttgttgctgctcctttataagattttattgagtcagtgagacatcctttaagggaaaattagagattttgccagcttagtactgactgcacaaattctctggcagagcataggaaaagctgtcaagtagaacctcttgaccactagagagatgttattcttcttttttggtaagcagccagatagaacatttagaaatactgaatgaacttggcaacaagaggaaatacctcagcctaacatcttacatcaaatgtcagccccaagttgaagctctgagaccttgtcctctcccattcctgcagaatcattgtggttggaggataaactccctgagggtttatttttagggaatgatatgaattgccagcttaagttgtatactcagacatctaaatatacagagtacacattgtacaacatatgagaaatttggcttagtaatttcctcccatgtgtaaggctcataatcttatttttaaagggtttagtaataacacaaaatgaaatctaactggtattatacaagttaaagtaggttcagagaagaaagcaatataatgaaaattgttggggtcccagaaacatgagaaatttctggtgcttgcctttgcctgttttgtgttgaagttatgtcttaacagcttggatttctatgtccaggaccatcactgcccatataaggcctttatgtgatttagacaaagggccatccatgtaagccccttgggaggggacctttgtgccaagaagaaggtccactttccttcaggaagatgcaggtctagtatttgggctggatttctgccccgacttattcctgtggcaggggacctttgtgtaacatacagaatgaccagttgtacctcgtggccctgctcaagtctc

SEQ ID NO: 6439 - DNA, 1113 bp, Homo sapiens
gtggtggttcatgcctgtaatcctagcactttgggaggccaaggtgggcggatcacctgaggtcaggtgttcgagaccagcctccccaatatggtgaaaccccgtctctactaaaaatacaaaaattagccaggtgtggtggcgggcgcctgtagtcccagctactcgggaggctgacacaggagtattgcttgaacccaggaagtggaggctgcagtgagccgagatcgcaccactgcactccagcctgggcaacaaagtgagactctgtctcaaaaaataaattaattaaattaaattaattagttgggtgtggtggcatgtgtctgtggtcccagctacttgggaggctgaggtgggaggatcacttgagtccagaaggtcaaggctgtcatgagctgtgattgcatcactgcactccagcctgggcgacagcaagaccctatctcagaagtgaataaataaaacaaatacagcatttaaatgaattgacattgagaaatttacaatttacaaatttatattaactgtagtttccaaaatatgttactgttggtcctgtaagttacaaagagactgaagaactttctttttatacattagagcattttcccctggaatgagtattgattaaaaagataacatttattaattaataaaggcaatttaaaatttagtgttatttgaagactgtcaacatctgaaggtatgaaacttggtacagtgaaataatttctcctttctccttccttttagttattcccacagaaaactcagcccagtgggaatttgtcatattatgcccatgttttaaaaatattcatagtttgaatcttattgacattttaaagaagagttttttcctccctggaatgtaaaacaaaaatattttttaatgatgtggaagtatatatttcatgttcattatgataaatctacaaacaaatgaattgtttttatgggtggagttcttctataagagtatattaaatgctttcagagttgtattaattttgtttctaaataatataccacttatttggagtgactaactcagtatgtaagtagatgagatttgttgattttgcccctaaaacgggctttagtcatttt

SEQ ID NO: 6440 - DNA, 1145 bp, Homo sapiens
aaagtgggcgggaaaagcataatcttttaagatttgtaattttctgtatgtgccacatttatgtaaattaactataaaatatggaattcaggatcatgctgttttgcatgtactttataggttatatagcatgaaacatacaaattatcactgttctttagtatatagctccttgccttttcttacatagatgcttaatttaacaattacctatttatagttcttattattgacgggaatatgattagaagtaccaaaactaaaaattccattatgtactgtttactttttatttaatattacatgtttttaccttgttgcggtatctttggccttcacacacacatgtgtgcgtgcacgtgcatttcattaccatgtagacaagacagttattgcttatagtaatttacccatttgagggctaagtgttttaagctgtggttttataagcaaagctgtaagtaaatgtaatttattttagaaagatattatttgaaatcaattttgaagaattgcactatttgataatgctgctactacatgagataactctggggaattaattttatgagataagatgaatggctttctagaaggtgttgctttttgttttttctttttcttttttacatttcatcttagaaaaagttgcttatattcagcaggttggtttgtcaaattcagtgtttgagtttgtttctggtcagttcagtagctgctactttagcaagatgtggcctttcacaaaagaggtaagagtgaccaaatagaattttaggacaataagtataggaaatatctctttatcgtaagataagaaacttgaactttttaaaggaaatgtcctcttgaaaagaacatttctgactgcatgcagaagggtacttaagacatatataacaggccaggagcagtggctcacgcctgtaatcccagcactttgggaggcccaagtgggcagataacctgaggtcaggagtttgagaccagcctgaccaacatggtgaaaccccatctctactaaaaatacaaaaattagccaggcatggtggcgcatgcctgtaatcccagctactcgagaggctgaggcaggagaatcgcttgaacccgggaggcggaggttgcagttagccgagatcgtgcca

SEQ ID NO: 6441 - DNA, 1968 bp, Homo sapiens
gttctagtatgaagtttaatagttaaggagttagctatttgttatctttaagagtagggtattgacgtgaacaattgcagtattttgcatgatactgttttatagatgaccttttaggaaagtggtgcatttattaattgaactgaagaagtagttcagttgaattcagtatcataattcacaaattggaggctgttgattttgattcatttaaggtttaaaatctttattaattgcaaacagtgcaattatttatacttcacagtgccttcccagaccttccaccttaggttctgctgcaaaaagcaccaggtaagcacaacctaaggacatatataaataaatatttcaatacattaatgttgtccctgtgaggtttttgtggttgtgtattcaaaggcaatctgctactgcttccccaaaatgtattttgttattttatgctaccatcttagtggaaagtctgtaagttgttaaagcaactgtttacatttctgggtaatgttttttattttacttttttttttttattaagacaagaaaatgatgagtagattgctgcagtaattgaactacatccaaatctttttgtattttttccccaaatatagaagtgttaatattaagaaaggacaattacacagttttcaagatttaggaaatcacttgtttagaaacttcaacagccttcacaatctgttttatatgatggacagaaaatttctttgccctccaaaattataatttctttatttttttcttattcttaaactataataattcagtaaggatattatgggttagaattttattatgatttttttcttagacaaaagttatatgctgaagaaggaaaaagttataaggcagtatgttttgataaaaggcatgtgcatcagtgaaatgttaactgtatagcaaataacctttcataatctgtagcaatcagtatttttctgatttaataatattttaataactgacgctgcatttaatttttttgccagtttaaaatgtttgtgtgtttttatagatgattttaactggtacatattttgagttaagttgaatgtatgaaagcagcatcttatcagttttgtttattcgatttctaaaatgtgctgatccttttaaaactcctgcttatctctgcaacaaagaaaaatattcaaaaatactgccttcattttcacacacagtgctgaagatgctgcaagcaccaaatcatagctcataaaatcaggtcctgagatagttacccataaagaggaatcctttgagtgtatgccattggtgagccgatgagcatggaccatagaagggctcaatgtagaaggtaaaattggcaaatcataattgagaaatatgaaatgtattcccatacataatatggtatagggtgtaatgtacctgcttttgatcacttttcattttaaagtgctattcacttgatcttaaatgttccatgaactgttaaatttcttaagttacatagttactacaccacatttatgtgtatgttatgttttaatagtcaatgataggtatgtacaattgataatataaaggggctcattgaaacttgagagcctgttgagttttggttagttgtagattgcatttttataaaaaaaaatacagatagattgatgataatagatattggggcattgtttctgtctcatgagaattcttttattcattaccataagccttcactgatactataagcattattttaaatgacgctgatcttaagtctgaaataaatggaaagcagaaaaggtgagccagttgatttgaatgcattggatattagtgttagaaacaatgtatagtttagattgaaactgaactgacttatttagcacttaaacaaaaatttgacaatgtttttagttttttttaagacagcttagtgtggtgatacttagaattctatggtttgatgtttcttttagaaatgag

SEQ ID NO: 6442 - DNA, 1167 bp, Homo sapiens
tacatgaccactgtttcagacctgtactgctgctataacagttaacctttctgttcttaatttgataatacttgatttccaagactgtttcggcataactaattttaaacagttttcagatagtgaatatgagtagtctaataagaacagtttttttccatgtgaagcaactctttcaatgtatataatgttagtgtgtttctttctaaatttaggatagaaaagtgaatagtgtgcaaaaagtatagctacattgcatctgccattgaaacataaatggggtatggaaacgttcaagctttttttttttctttatgcagtatagataagctttgttttgtaaatgcacaagtccaatcattgaatcaacttaatttttttatgtacttgaagtcattttattactctttaacactcatgctgaagttctgatattttgttgaaatccattgttttactctttgcatatttgttggctctttgcatattaatatattagactacatgcaaatacagtctgtcttgccattgtctgttgaagtgcaggtttgatccagccagtatagaactagctctgtaggggtgaggaggactgtgctgtgtatcatccttgattgtgttccttcaaggagcattgcactgtaagtacatcagaatgacaaattgatgaactgcaacagtatctttttgtcaatgttccacataatgcaaatgccatacgttgtgtgaatattatgttggaatacagtgctgatatcttggaaaaccataactgcctcttaatttaacatagaataatacatagttctgtattttttttaaagtgagcttaatgggtaagtattttttatatgctttagctatagctaaagaaaactgatacttaacaaagttgaatagtattattcactggtgctcctaaaatattgtttttcagtgtaaaatatgcatatcttctatatttaatatgaaagtcttgaaatgtatcagacagaaggggatttcagtttgcaaataatgagcaatgtagcaattttaacacatttcataaatatatattttgtcattggtggagagcaccatttgttgttttgaatatactttaaaggaagaggtacaaggacataaatgttgagattacctacaggatggaaatagcagtacagt

SEQ ID NO: 6443 - DNA, 1152 bp, Homo sapiens
ttaccaagcatgacttgagttgtgctaggatataggtgtgcaaagttggggttgtgttctatagcaaaagaatgcactcccagcgtaagcaacactgatggaaggggctcacagggtacaggatataatactcttaacaactaatttttggagaatgaaagggcttttctttccctcttgttggctgattgggatggtataattaatgggattgaagagtttgagtaggttaaaaggcagattcatattgggtaacttggatctgccaggattgtatttttgagcactactgggtggttagcatgattgaggaaaaatgatgggaataagaagtggaagtggtctttgtatcacaagttgaatttctcacttggagtagtagtgaagtcactactgtaagagctggtcagtgaatgtggttgcagcatggcctttgggcaagaagtaacccatttaactaaaaccagctggttggccccactcagatttatcaaagggttactgggtccctgggggtggatattgcttatattagacttagaatagcatactgttttaatattatatgaactaaaatgtttctttaaaaaaagagtggtctgttaatggatttatgtagtggtcaagaatttagacttcagagtcaaataaacctatatcagtcctagtcctacagtttactaattgtgagatgtcaagcaagtttttgaactcctctaagcctctgttttcttatctataaattaataaatgaatgaatcgggttgagtgaatatttagtaaattcttagtacatactagttatttgtaactgtgagactggttttttggtatggttttcacatttgggagtagaaataccacttcctaaagtctgttttatctcaaattctctatccaggcatagtgtaaagtgaaatacctagatttcttgattaatatacagataatggccagacgccatggctaaaacctgtgacgctagcacttcggaaggctgaggcgggcggatcacttgaggtcaggagttggagaccagcctggcaaacatggcgaaaccctgtctctactaaaaatacaaaaattagctggatgtggtggcaggtgtctgtaatcccagctacttaggaggctgagacaggagaactcctt

SEQ ID NO: 6444 - DNA, 1098 bp, Homo sapiens
ctttgttttgaagatgatgggacaacacccgaaaggatagcacaaataacaggacctccagaccgatgtcaacatgctgcagaaattattacagaccttcttcgaagtgttcaggtttgatagaaagttaacattttcattttttgtttttatggaaaagtattttccttcatgaaatctgaagttacctctatatcagagtctgcttgatgatgctttattaatggagaaagtttaaattgctttaaggtaaagatcttggagcaggaagaactactaccttaagtgctaccttatttactcttgtattttaaaaaatgttattacttattagggccagttcatctctacatttctgattcaggtatatgagagctgggaaaaataaacttaataattttatcatgaaacaaaagtatttctgtgctgactcttcgttcttgtctttccctctctataggctggtaatcctggtggacctggacctggtggtcgaggaagaggtagaggtcaaggcaactggaacatgggaccacctggtggactacaggaatttaattttattgtgccaactgggaaaactggattaataataggaaaaggcaatgtattttaaactcttaatgttttaacacattattcatttttctggacactttctgttgctgtcgtaaacaagtggcaatgctttttctctgaccgtattttagtagaaaagaattcttatgttaatatgtaacaagtaaaacataaatgagggatctcatgtatatttagagaaagagcaggattttaatcttactagcttctagagaaagcgaactaagagataattattagcataagaaatgtcttttgacccaaaaagtggtttgagtgtttttgtttgtgcattttggtttttcccgactcatattttaaaaatttgaatgtttataagtgtattagtttatatttacactgcttttaaaagcagttaattcaaatattttattataatcacattaagtttatgtttaaacatactaagtaaatgtaaatgtattttaagagaagcatgaaatgcttcctaaaatttgattttcagtgtagaatatt

SEQ ID NO: 6445 - DNA, 1585 bp, Homo sapiens
ccgaggcacgtggtcaacttcgggcctggtcccgccaagctgcctcactcagtgttgttagagataaaaaaggaattattagactacaaaggagttggcattagtgttcttgaaatgagtcacaggccatcagattttgccaagattattaacgatacagagaatcttgtgcgggaattgctagccgttccagacagctgtaaggtgatttttgtgcaaggaagtgggtctggccagttcggtgctgtccccttaaacctgattggcttgaaagcaggaagatgtgcggactatgtggtgacagggacttggtcagctaaggccgcagaagaagccaagaagtttgggactataaatatcattcaccctaaacttgggagttatacaaaaattccagatccaagcacctggaacctcaacccggatgcctcctatgtgtattattgcgcaaatgaggtggtgcatggtgtggagtttgactttataccctatgtcaagggagcagtactggtttgtgacatgtcctcaaacttcctgtccaagccagtggatgtccaagtttggtgtgatttttgctggtgcccagacgaatgttggctttgctggggtcactgtggtgattgtctgtgatgacctgctggggtttgccctctgagagtgccccttggtcctagaatacgaggtacaggctggaaacagctccttgtacaacacgcctccatgtttcagcatctatgtcatgggcttggtcctggagtggattaaaaacaatggaggtgccgcggccatggagaagcttagctccatcaaatctcaaatgatttatgagattattgataattctcaaggattctacgtatgtccggtggagccccaaaatagaagcaagatgaatattccattctgcatttgcaatgccaaaggagatgatgctttagaaaaaagactttttgataaagctcttgaacttaatatgttgcccttgaaagggtataggtctgtgggaggcatccgggcctctctgtataatgctgtcactattgaagatgttcagaagctggccgccttcatgaaaaattttttggagatgcatcagctatgaacacatcctaaccaggatatactctgttcttgaacaacatacaaagtttaaagtaacttgggtatggctacaaaaggttaacaaacacagtattttcctcaaatgaacatgtttattgtagattcttcttttttgaaagaacaacagcaaaacatctacagctctgtaaagctggtgggaactaatgttcaccttaattctgacttgaactggaagcattttaagaaatcttctcattgcttttctaacaaattcccgcttgtttagcctttgctgctactttttctagttagatttccaacttgcctgtggacttcatactgcaagttgcaattaattatttctagagtcatgggaacacacagcatagagggtaggtggggccctctaggtgctgaatctaaacatctgtggggtctcctgtgttcagaggctgttgattcaaggtcaacattgaccactggaggagtggtttaagagtac

SEQ ID NO: 6446 - DNA, 1184 bp, Homo sapiens
tcaaagtacttgttttctttattcttgtgccaaagtagtcttgtcattatacagaggttacccgcagaactatgcaatccagcaaaagaggtttctgtattgacctacctaagaggacatgaagcatataaaactcaaatgactgaattacagagcggttaaatgtaattaagcaaggaaaatactaaattttttgtcctgttttcttagcataaaaaattggagttactaaatatatgagaataaaactataaatatattgctattatttaataactaacatttatataataacaggatatagagtatgtctacatgttatatcacattttaaagactctactagccagtctagtggacagagatacttttctgattactatttcagtaattttaattgaacttgattttgcaagttcaatttattttctccacggataagttttagtggaactttaattcttttcggttgtcttcactgttcatttaattagagagagagaagcaagtgtgttatattaatcccttggtcttgtgattattcaatgcaggtacgaaaagaatatggcaagtgcttcagacactcatactgctgtggaggcctcccaactgagagtccccacagttcagtgaaggcatcaaccaccagaaccagtgctcgctattcctctggcacacaggtaacaaagagtttgacagcatctttaattaaccttatttatagaaaacctactgagacatgttctgttcagatgcactaattgtcttctcattataatgatctagatagcaaatacttgcttttttagtattttggtttcaatgtcttcttaaacatttcttcagtgtttctttatatgtgaacgtccttttttgtggagagttatttaagaagtgtgtcataatcgtcttatagcctaaggccatatagcacaatgctcatagcaggcactcaataaacatatattgaataatcagtgatctccactctttaaagaaagacaataaagtaacatgtttttaagagtggaggattaaatgccccttagttgcttagtaaataaacaatagatattgttagttttagaccagaaaaaacacacattctttaaaaggccaccagataatcctacataggttgtttagggtaaatccttgtatgtctttaataaggtaagtttggg

SEQ ID NO: 6447 - DNA, 1208 bp, Homo sapiens
aatttttttttcctttttcttatttttctctccctctcaattataggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctatatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcata

SEQ ID NO: 6448 - DNA, 1249 bp, Homo sapiens
tagcagctttactgaagtataatccttgcataataaattgcatgtgtgtaaagtaagttttgatatttttatcccctcttgaaactactgccacaattaagatgacaaatatttccatcacttccaaaatttccttacgaccttttgtaatctctccctcctgtccttttctgcccccatatcccctggcaaccactgttatgctgtcattataaattagtttgcttcttctagaattttatataaatgaatgtgtatacatcccccgcccccacacacacacatatagtttctgtcactcagcataattaatttgggatttatccatgttattgtgtatatcaatatatcattactttttaattactgagtaatatttcactgtttggatctacaacaatttgtttactaccatccaaatgatgatagacatttgaattgtttctgtttcttaggtattataaataaagctgctttgatcatttgcgtgcaggtctctgtgtggacatatgctttcatttctctttcataattacttaggaatggaattggttgggctctatggtgggtgtctgtttaactttttaagaaactgccaaactgttttctaaactggttgtcccattttcattttcactagcagtgtgtggcatgttccagttgttccacatgctcatgagcttagtgtgatcaatcactttcatattagacattatatcaggtgttttatgttttcagttttatttccctaatgactaatgatgttgagcatcttttcctgtgcttatttgccattcatgtatcttcctagatgaagtattgttcaaatcttttgcccatatttgtatcgggttttttcatatttattgtatagagagtttttatatattatgaatatgtcctttatcatatatattatttgaaaatattttctttaagtgtgtgacctatcatttcattctctccatagcatctttcaaagtatcaaagtttttaaattttaatgaagtctagtttatcaatttttttcttttatggatagtgcttttggtgtcatatttaagaaatcttggcctaatgcaaggttacaattattgtctcctctgttttcttttagaagtttcacaattttaggtttcagggtttaggactatggtttttgagttaatttttgtttgtagtgtgagataagggtttgaagggttgaagtgctttgtgtggtggtggtagtggtgctatggatatccaa

SEQ ID NO: 6449 - DNA, 1534 bp, Homo sapiens
agttgtttgtttggacttccctgtcttcccccaaagagttgaaatcttaaatctatttaaaaggatataaaagctttggatatgtatttttagtaacagaagcatctggttctgtgaataaaggaatgtatagatgtttggatggaaacaaaagcactagactgagtttcctcttataggtattaaaaatagcacttttaggaaactgattattgtaaatgtttaattttgtctcaaatatagttggcattggaagtttagcctttacttgaatgtatactgtagatttttaacaaagcgagttctatatttattatgtttagtgtggtttgaaattacctctttcatatgttttaaataaagtgaaatttatgtatgttttgtacatagatacacatgattatgttaagaggctttaagatttaaaagtttcacacaaccataagtatagtatttcatgccagtaaaatttttttagtggtattctgtttacagatgtattaggaccattgatgcattacatttaagaattctctttaatacatctgggcaataaatattgaaaggtattccatgaagctgagttctttagataatcaacactactaacattacatttttgagatttttatgacattagatttttattttgtatatgtagaatattataatttttaaaaggactattgatgatagaagaataggggcaagacgacaaaagtacctttgaataaaacaatttaagaaattggtttaagatattggatgatagaagatatttaagatatctagatggtgatattttccttacaagatgggtaccagtatagtaatatctgtatactaactagggctttgtattgtcaataattttttaataattttttaatgaggtatttaccactgaagaaatatgataatataaaaccatcaaattttataattgagatgatactctggaaaaacatgtcatttcattttcagaaaactcttaagctctcttcagtctctgtaatgtttctgattgcatgtttcttcatgaaaagtatgttgttgttttgatagtaataataataaatgtaggctcagctctttcccaggattttcatcaaaaagctttaagtgcctaaccctgcttgtctctgtacatagaagcctgcacagatccaacccttgctaggtatcatagtttaggcccatttaccttcccctgtactggcagttcagccgcttacatgcactcaccctgtttgtggctattttaaattcatattattaaaaaacaaaaaaaacccacctatttgtgttgtccattcactatacgtaactatgtaactctttggagttgcatagcagcagccattttttcagggctgataggatatcattaagagtgtcttatgagacattagtggatatactcatagtaaccatatttatagttttaaagagctagctcttgagcattagtcactaccttcagcttgatgcatggtcacttctttactatttaaaatactacacattgtacaaa

SEQ ID NO: 6450 - DNA, 1299 bp, Homo sapiens
ttcaaatattgattagaggtatactatgaataaagcattctagataaactttttataaggtatgttttgcttagggtaaggctttgttagcactatagtttttataaaggcaggctcagagtttgtatatcctttttcttagaattctttgacacttgtactagcagtttgatttctaaataatataaatcatatttatatgtaaaattcaaattttttctagttcaattttagtctctgaatgtgattgttgttactttttgtttaaaaaaatttttttaaataactggtctgaagtgacatgtctttctgatataccagccattatattctaccttctattctatctttgcaacagatttatttgaaaatgcctatgggtcttcaatgaagggaagagaacttgaagagctgaaggataatattgaattcagaggtcataagccacttaacagcatcactgtttcaaagaaacgcaattggctatatcagagtactctgaggcctcttaatctggaagaagaaaataagaaatgccaagatagaagtcatttatccatctcacctgtgtctctacctaaacatcagctatcacagtctttcctcaaatcatctaaagagtactgtacatatgtggtatgtaacgctacaaactcttcattatcgaaaaactgtgctttagattttaatgaggaaaatgatgcagatgatgaaggagaaatatggtacaatcccattcctgaggatgatgaccttggtatatcaagtgccttgagttttggtgaggccgactctgctgttctgaagctccctgctgtcaatttgagcatgttgtctggcagtgacctgatgaaagcagagcggcatactgaagactcactgtgctcttccgaacatgcaggtgatattcagaccacacggtcaaatggaatgaatcctatacatcctgcccattccacagaatttgtgcagcagtacaagcaaaagctaggacacaagacacaagaaggtataatggtggaggacagtcccatgttgaaatctccttttgcaggtaaaaatgatcatatatgtgtctttctttcttcttccatttttgaattatttgataatagctaaaactaaatataaaagatgtttgttatattcatgtactttttcttgtgaagtgaatatattttcatgaaaataaaactcaaaaagttttataaacattttaacgtacacgctggtttaattattactatcacagacttgatttttattttatttttttgagaaagggtctcactctgtcac

SEQ ID NO: 6451 - DNA, 1190 bp, Homo sapiens
accgccctcccccacgccttcccgcggcagagttatgccaagtatgtgaggagccggcgagggccagcgccggtcatggggagccgccgccgcctccgcctccgcctccgcgagcgcggttttctccccagcggggctccgacctctccccctggcgggggtgagcctcgcggctaaggcagaggggatggcggaccctctgaggaggacgctgtccaggctccggggaaggcggggtccccgcggcaccggggggctagggctccgggcggcagccgcagctgcggtggcggcctcttcggcagccgcgggagacgcctggggtgccgcagacaccctcccacgtgagcacgccgggggacacgggcggagcctacagcagccctcgccgtcacctgaggcgtggggtcccggggcgcgggtccccggagggcacccggagcagttgggggcgctcgggcctcggccgcgcggcgggcaggaggccgccccccagagccatgggctcgctcacgcccctccgcactccccggagggctccgaggacagcggagaggaggaggaagacgacaaggacgaagacgactacgacgccgactactacgaaaacctgcccggcggctcgcagtctgcgcccgagcctgagggggcggaggcggaacggcgtcccccgcctcccccagcggcgggctcctccctgggggcggagggcggccgcctggagacaggcaggctgcggacccagttgcgagaggcctattatctgctgatccaggccatgcacgacctgccccctgactcgggcgcgcggcggggcggcaggggcttggcggatcacagcttccccgcgggagcccgggctccgggccagccgccttcccgcggcgccgcgtaccgccgagcctgcccccgggacggggagcggggaggcggcggacgccctcggcagcaggtgtccccgccccggtcgcctcagagggagccgcggggaggccagctgcggactcctcggatgcggccgtcctgcagcagaagcctcgagagcctccgggtgggtgccaagccgcctcccttccagcggtggccgagcgacagctggatcaggtgcggcgcgcaccgggactgggacgagcccccgccacgtggaggcaggatggacggctggagtggggaccgcgcccgggcggctg

SEQ ID NO: 6452 - DNA, 2814 bp, Homo sapiens
atattctgaagaatgtcttcttgatcagtcagataagcttgctttttttttttttttttttcatgaatcatgtttggttcctgtgaaagtccctggtccagggatcctcctcctttctcttttacttctgaattctgaaattcagttagttacttttgcctttcgctcttctatcacagccaccttgaccttgggtaaaacccaaggtctttccttctggctaccttcctgcaggtccaccctgtctgccattggtctcctctgcctctgactacatctgccaccaacaaccctcccctcacccctgccaggggcagacaggcttctcagcagaactgtgactgaaatcagagctgctgtctggggcagtgttaactacacagaggcacatcctgacagggtttgccccagagatctaaattccagaaggagggcaccacacctaggaaggtaaatccagtatcagaaggttgctaaaagattaaagatcaagaagcttggaaacatcccatgggtacaatgtcttagaaagtctttaagtcacataccatgaatttttgcttcattactgaccatatatgaccttggaggaactcttttttttttttccttctactcatttctgtttccacctaccctgactcaccgtatttccagtcttctacccctgcagttatcctagtccagcaaagtcatttctttcaaaagagacatcatgtctgaaaataattactggtagtctaatatgagccagagtaaacagctcctcatggtcaatgaacatgttcaggaagcgatcaccttgatgcttgaacccaaccccagacagtggacaattctactttgaaatatccgtgaatatttactgtgggatccaatttaaacttctttcttctctagcctttaaattacacaactttgaactgacacggatctcttacaaagaacaatgcggcactgaaggaagagatgattcctttactcaaacctgcaggaatcagcctattaacaggcaggggaaacggtactttccaatgaatggtaactgatccaggcacattatcacacttcctagtcatctccacctttcctgtattgcctgtggcttgttgtttaagattaagaatcaaagagattaagaagtatcacttcaaatcttgctctgctcacttctatgtttgcagtcaaattattccttatgttggtgacctaaagagaattactttcattcatttcatttcccccgtagcagatggaaggagaaacctctgagaaaatgaaaacatccttaaccactatctttcccttttatttgattattttatgtcagaaatttgcaaaagtttttttctcctccttctcttccttgttgcttaactttttaattcatgccatatgcagatatccaattatgtgcatcctgtgaataaaccacgtcttggtcactgtcatattttgaaccatctcatcagagatgaataatatctttttaccagagagagaacgaatgttagccacatgcccaagttaacaaagaaaaaatgttctcaaggttgtccttttgggttaaatctggcccttccttggcaaaagcaaaaattctccctgtgagagctcaacatctcaaatacaaccacaggaaaaatggcccaatctgccagtttaggcttaccagcatataatttttaatatctttacttctatcatcccaaatcaaagaactcttctctattatgtttaatcaattgcaagcaaatagatttttctttgtaacaatttgttctgcagaaggctgtttttcacttttcctttcttttgcttctttctgtctttccttctcttttgtctggagaaatcacttagactctgtgtgcctcttctacattgcattctgctctgctatgttacctgctaggctggcttctttggactccctatatgattgatgatgtgaaaacctaaattacttgcagcatagtattacttctttgatgttctcattagcataatgttatttttgaaaaggaaagatactatcacataagttttcctcatctgttgtgatatacaccaatggataaactaacggaaactgctttttgacattaaaagacaggagaaattatatttaactaagtaaaagttaagtcagaattacttgggtgatgtgattcaatttagttaaaggatgatatagagaaaatacattatttagcattatttcttcagctataatgaattgctatagaaatcaggcagatctttctaatgtgtattgattggtcttttcagctactctgaacagattactaaggccatctcctcatctctaagggagaaaaatagtctgtagatgaataatgtaaggtaaagagttgcatgtcagtctttgtaattatttacactttaactttctccagaactcagacatgatttcaacatggtgttagatttgtgcattttattttcctgaccacctcattccagccaatgtatggttatccactctgtgtgccaaaaccaatcatgcctttcacggccctttagttcagagaagttctgcactgatttttagtctcttgatgtctcaatcttacatgtataccaatcacaatggaataaagtgttgagttgtactgtgatcaacagtgtatgtctcttttctttgcaacagaaactgccatggggaatgaagtcatcatttctttgctgtcagtcatgggatattttctctcttgtcccttaggctatgaacttagaaaaataccatacctgtaaatcaattgccatcaaagcttgggttaaaataatatt

SEQ ID NO: 6453 - DNA, 1146 bp, Homo sapiens
tccctgagataaaaactataattcttttgatggcagttacattcccaactcttagcacaagatctaggacatagtatgaactcaataaatttttgttgaatgaaagaaaaatgcaaatttataagccttttcagagacctactgaatcaaactctgagagtggagcccagcaatctgttgtaaaagctgtttgagtaatactgttgcactctaagcttgagaaccactgcaatagaactaagagaacattcatttcaccttcaggcctattctctgacatcacttgaaaaatcctctctgccttctgtaacccttaaccaacaacagtgccctgtccatgtaggggaaacttctgggctgtattacaagtgggtaggaaggtataaggatatcatagtgggaagtattgcttagaatgccagtacttgtttgctgtggaaggtttctaggaatggattgcttagtctaaagtaagcactaccaccatccacgttttcactcaacacagtgccttttaattggtgactaacatcaaaacaccttgacaaaccgttaaaacagtatcagaaaccatgtgtacatccctgtgcctcttagattgctaagttctgctctcattcttacttcaaaggacactttttaaagaattgttaatgcttttttataatacaagtcatagccctgttggcaaaaagaaaaaagattcagtgagaaagaaaaatcactgataattccatcatccagggagaaccactgttatttaagtatatggccttccagacttttctgtgcatttatagatatttttaatgggatcaaagtgtacatactgttttgtaactttttttcactcaacaataccatgactgtcttgctgtgtcaagtatatttctacatctcttaatggctgcatgatattccatcatatgtgccacattttattaaactactgttcaatttttaggtttccaactttcattaataaagtgctttaaagaacattgtgttgctaaatctcgtatgtgttcatattttctcacgataaatgctttgaagtggaattgctagtgaagagggtatgccagtttttaaaagcttttgttactgccatgttgccccctagaaaactctaagcaatttatactt

SEQ ID NO: 6454 - DNA, 1680 bp, Homo sapiens
ggaggtggaggttgcagtgagctgagattgtgccactacactgcagcctgggtgacagagcaagaccctttctcatgaatgaatgaatgaatgaatgagtgatttttttaattctcctttttttccgaaatcctgtaaaactcttctccttaaagatttcctttaagacttgtttattgtcatgtctaaaagcctttttttaattactaaatttaaactggattgaattgctttgtcttagatgaggctgagaaggttgtttctgaacagaaagtaatgatgacgtccctcttttttgtagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaatctatctgaatttggaattcttctggtttgttctttcatgtttaaaaatgatgtttttcaatgcatttttttcatgtaagccctttttttagccaaaatgtaaaaatggctgtaatatttaaaacttataacatcttattgttggtaatagtgctttatatttgtctgattttatttttcaaagttttttcatttatgaacacattttcattggtatattatttaaggaatatctcttgatatagaatttttatattaaaaatgatttttctttgcttaaccttctgtgtggttcaaagtgacttcttcataagatcaaattggtctaatattctattatgtcggctttacctcaggataaattcttcataatctagaaacttcgctgttgattttgaattaaattattttaatgaaggatagttggaaatctataaaggcagctctatcagagaatgtttataaagtatgtacgtatgtatgtatgtatttatttat

SEQ ID NO: 6455 - DNA, 1219 bp, Homo sapiens
aacacctctgtgcatataaactagaaaatctagaagaaatggatgaattcctggacacatacaacctcccaagactgagccaggaagaaatagaacccctgaactgaccaaaaacaagctccaaaattgaatagcctaccaaccaaaaaagcccagaaccagaggggttcatagccaaattctaccagatgtgcaaaaatagtgttggagaaaccacggacaatcatctaactgagtttcagacttaatataatcacttttatattttaagtggaatctaccctgggaagtagtcttgcaactcagatacgtgttttttttttttttgcatgaattggttgaattcatggattatctataagtataaggagatttcatttaggctcatctcaaagtttgaaaaatgctgtttatttgaaaaatattaacttccaattttaagcagcaattcattctaataagtaattttaacaatattttatttacagattgcccaaggactccagatactccaaataatgaccctcgttgttctactagcaacaatagattgaaggccttacaaaaacaattggatatagaacttaaagtaaaacaaggtgcagagaatatgatacagatgtattcaaatggatcttcaaaggtaagtgtagttaataaatgtaactatatagtcagtcattatttgcagattccatagttataaatttacctattcaataaaatttattagtaactccaacatcagtactggtggcatggcactttggcagtcatttgtgtacatgcatggagcaggggaaatttgaattatatgacatgcttgtttccagctgagttcgaacaaggtgattttgccttcttaagctatggtacactaaaaagtatcctttttcagatatatttagtgctgttttttttcacatttttgtgcttttaattggtaatttcactgtttaaacactatattgtgacatctgaaatcattttgacctcagaatttgaaagaatggataaaagaatttggaaacatgtttttctttgttgttgttttttttgtttttttaggtaacattttaaaaattgtttattcctaccaagacccagttaataaaaaattttaccttatgggtaaaggatacacaggagctttccatatctgcaacttttccgtaaatctaaaattatttaaaaagaaattatctaaaagaatttagtc

SEQ ID NO: 6456 - DNA, 1176 bp, Homo sapiens
cggtctccccatgttacaatatttggatatctttcagctctaaaatctttttttcagatttgtaatttagatgtgtaatgacaaaaatgaaaggctctgaatttcaatatcatatcaaatatttttatttcagtgtttattgatgtaaggactaagttattgtaatgttataggaattcatttcttttcatgattttaatcactgcaaattggaaagtcagataaatggtgcaattaaaatttttttttcctttctagcaaaacctgtgataagtcctcttgaacttcggatggaagaattaaggcatcattttaggatagagtttgcagtagcagaaggtgcaaagaatgtaatgaaattacttggctcaggaaaagtaacagacagaaaagcactttcagaagtaattttaaataaaaatttttatttggtttaataaatacattattcaaagtatgtgattatttaaatgacaacaattgtcttttccctgtgcaaggctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaatcaatatagtacactatccaaaccagcagcactaacaggtatgtagtgtatagccattgttttttgtgtgtatttttgtctataactggttctgatttaataattgaaagaaaaacctgtgcatagatttttaaaattatgataagatacacatagaataaaatttgttgtattaaccattttaattttattcaatttggaagcatttgctatattcacaatattgtgtgaccatcaccactacctagtttcaaagcattttcatcaccccaaaaggaaacgcatacctgttaagcagtcactccccattcccccttcctcccagctgctagcaactactaattgtctgtctctacagatttgtctattctagatttgtcatatgatagaaattatataatttgtgaccttttttgcctggcttcttttacttagcatattgttgtcaaggttcattcatgttgtagtatgtatgagtacttcactcacttttaatg

SEQ ID NO: 6457 - DNA, 1159 bp, Homo sapiens
tcactgcaacctccgcctcctgggttcaagtgattccactgcctcagcctccctagtagctgggattacaggcatgcaccaccacgcccactagttttgtatttttagtagagatagggtttctccatgttggtcaggctgctcttgaactcctgatctcaggtgagccgcccgcctcggcctaccaaagtgctgggattacaggcatgagccaccgtgctcagcccagtttttcatattttttagataagtttaatataaaagcgatggctccagctactcgggaggctgaggtaggaggattgcttgtggctgggaattcaagacctctctaggcaacatagtgagacccacctctaaaaaaagaaaaaaaaatttttttaaagaatgagtatctgaattttacttttcactccaacatttatattgacttttgaaatgtttttccttaattttatcattatcaaataagttgttttctgggtatttctatggattcacgtgtatttaatattttacaggattcagagactgtttttgatattcagaatgacagaaatagtatacttccaaaatctcaatctgaatacaagcctgatactcctcagtcaggcctagaatatagtggtattcaagaacttgaggacagaaggtaaagaatatataccaaattttgcgactacatgtttggtaccatactttattgtcttattattaattgaaatttctcttttcagatctcagcaaaggtttcagtttaatctacaagatttcaggtgttgtgctgtcttgggaagaggacattttggaaaggtaatctttttggaattttttggaatatctacaacattaataactcaagtggaaaataattattttaattttatttcaggtgcttttagctgaatataaaaacacaaatgagatgtttgctataaaagccttaaagaaaggagatattgtggctcgagatgaagtagacaggttagtttttaaaaatgaaattgtttatttttctgaatttgtaagttaagagaaatgatatatgtattacaacagcaaaactttatgattttacagtaatatgtgaagaaattaaatataatgtatctatatttgacataaggtagacattagtttttcttttttgccccttttt

SEQ ID NO: 6458 - DNA, 2514 bp, Homo sapiens
tacttttggatcaatagtctatttttaaaaagaaagaaaaaaaccacttttttatagtccctagctttgccatatgcccgccttaagtggaaggaaagttaatcacttaactatgttttataaaaagaaaaaagggcttggaatgctattactgttcacacaaagtatgattctgtttgaataaggcaaatgctcctttttttaaaaaaaaagacattactgtaatatcaaaaaccgtggcagtttgtatacaactcggggcttgattttttttaaaaaaacagaatgaattgatgtcttattttataaatgttctatatttattaggagaaaactttatattgccttttttatcaatcatgtaacaggcttatagctttccaacagagctgcttgccaaacaattttttttgtttattaaacagtgctgaaacaaacaggatcagcatttacttaagatgttaagaatgaggacttttaatcagccgaaccaagatattgttacctgtatgcattcccaaagtctagatgctcagtatgttcagtcatatctttcagaatcagtgaaccgattaccctttttttggtattcactctacatctgccaacctagttcaccttggttttgtgtctgctgtagaagggaaccataacttggttaaaccgtagggattatcattgtatacatgctgtgaacatgtatatgtgcaagttttaatgtattctatgttgtaggcttattatttaattttaccacttcatcacttttgtacagtggccaagcagacacctcaaactccagcatttacattaagtgcatttgtacattttaggccactggatccagattttatattggcagttattgagggcaaaagcaatatattgtaacagaatgtataaatatttttgataaaacagtctatattttattaaaaaatgaattataacactaaagctgtacctcaaaagtctcaaaaataatttgatgaaatattttatacaactcttcaaaggatccgtctgtggctttttatactcttttagggttgtctttttacaaaccatgactttccacttgcctgtagttttttgtttgttttggtttggtttgattttatatttttttctcctaatctatgactttattgttttttcttagtttagtaatagcatctttgatcctgtgcttagcatgttagggtcattatacctcaggaatagcaagctgttaagtaaccatactgaattaactatttaattacagtgagctcatctcttaaaaattgttcaggtgtaaatcttatgagaaacatgaaaaagcacactgatttatggagagttgagctaaaaacatttataaatatttgctgggatgttttagcatcttttcattgtactctgagaacaattaaaattgtccagagatcatttatattaccttccaaattgtttattacccaagatcctttgggagaaaatcttatagaatgggggaacaatatgtggtttaaagttattttaaaatgccagttaatttcctcggcaaaggacaatagaggaacttagcttaattgtctggctttaatttaaactgtgttaatacaacattaaaataaaacactaaatacttttgaggtacagtctgctcacttttttggttctcaaatagcaaagaaagtaatgtctaaaataggctcttagcattaaaaactgacagcatttcgtaactacacagtgtacagaatttttttttaattgaagtcaatcactaaaaaaattagaaggcagggtctatttacacaattaagctgaagaaagcactaattttttgtagtttaaaatatatatatattttagtcagatttaaaattttaagctttatagagtgtaaatatattttgctattactgtatgtgtatgtgactgctcaagcactttgtaaagaaattaggatattttagaatggtacactatgcattcaaatgaaatgtgcctttcactatgtcattctaagaaaacaagtgttttttgcagtcataaattatcacaaatgcacaaattaaagtctatatagattgaaatttgtaactttggttttaagtattctttccttttagaaacttcctaatgattaaaatatactttaacttttctgtgttcaaaatctcaaagactaattaactttaataaacattcttgcaagtactttttgtcctagtgaaggcttaaaaccatgaacattcagagcaaactgtccacttcattgggaataatgggaaaagtttgtattctgctcctgtaaggtcagtagcatcttttatttgaagcatatttatggactgcttactgtgtatagatactgagaataggaagtttttttttttaaagcaacaaaatgttgatgaatgaagaacagcctgttttaattaagatgcaagcaccagtattgtatgtacttttctcttgtttgaggttagcttattttaatttaggacctggcttctcaaaaag

SEQ ID NO: 6459 - DNA, 1107 bp, Homo sapiens
tcgcctgagggaagcgagaagaggccgcgaccgggaagaaaacgctgagtcgccactggagagaagtggactccatagcagcagaccccgccagagaggcccgcccacccgttcgcccctccccctgccccgttcacaatgcagcctgcttctgcaaagtggtacgatcaaaggcactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatacaaacgattccaagcataaaagaacggacagatcaattttatgttgtttacgaaaaggagaatctggacagtcatggccaaggttaacaaaagaaagggcaaagcttaattggcttagtgttgacttcaataattggaaagactgggaagatgattcagatgaagacatgtctaattttgatcgtttctctgagatgatgaataacatgggtggtgatgaggatgtagatttaccagaagtagatggagcagatgatgattcacaagacagtgatgatgaaaaaatgccagatctgcagtaaggaatattgtcatcacctgggttttgagaaagaaaaataacttctctgcaagatttcatgattgagagaattcctgagttgatctaaaagcagatgctgtagctgcctactttaacccatttttcaacctgtttgttttttaaagggcttcactaagggttgatatgtaccattgtagggggcaattttaagtcagctaaggcaataaccttatgcatgaacatttcccagactttcatgaagctgttgaggtcctaggcaattaatgcggcagttgtgataaataaaaacatctcacctaagtctccttttcttcataatatagatactgacatgatgataggaagctctcagcttagggaaagagagctaaattttagattatagaacatggattcaaaagtggctgaacaaattggctgacaccttactggtaacctgctattcctctggtgttatccttcaggattgttccactaaaattta

SEQ ID NO: 6460 - DNA, 1204 bp, Homo sapiens
ctctccaagtccaagattttgctttcgtcctcagggtgttcagctgacatagattccggcaaacagtcattgccctacccacagccaggtttggagtcagctggcatagaaagcccaacttccagtgtcctggacaagaaggagggtgaacaggccaaagccatctttgaaaaagtgaaaagattccgcatgcatgtggagcagaaggacatcatttatagagtatatctgaaacagataatagtcaaagtcattttgtttgtgctcatcataacttatgttccatattttttaacccacatcactcttgaaatcgactgttcagttgatgtgcaggcttttacaggatataagcgctaccagtgtgtctattccttggcagaaatctttaaggtcctggcttcattttatgtcattttggttatactttatggtctgacctcttcctacagcctgtggtggatgctgaggagttccctgaagcaatattcctttgaggcgttaagagaaaaaagcaactacagtgacatccctgatgtcaagaatgactttgccttcatccttcatctggctgatcagtatgatcctctttattccaaacgcttctccatattcctatcagaggtcagtgagaacaaactgaaacagatcaacctcaataatgaatggacagttgagaaactgaaaagtaagcttgtgaaaaatgcccaggacaagatagaactgcatctttttatgctcaacggtcttccagacaatgtctttgagttaactgaaatggaagtgctaagcctggagcttatcccagaggtgaagctgccctctgcagtctcacagctggtcaacctcaaggagcttcgtgtgtaccattcatctctggtcgtagaccatcctgcactggcctttctagaggagaatttaaaaatcctccgcctgaaatttactgaaatgggaaaaatcccacgctgggtatttcacctcaagaatctcaaggaactttatctttcgggctgtgttctccctgaacagttgagtactatgcagttggagggctttcaggacttaaaaaatctaaggaccctgtacttgaagagcagcctctcccggatcccacaagttgttacagacctcctgccttcattgcagaaactgtcccttgataatgagggaagcaaactggttgtgttgaacaacttgaaaaaga

SEQ ID NO: 6461 - DNA, 1158 bp, Homo sapiens
caaaaaaaaaaaaaaaatgctccagggctttaaatgagaagtaaaattttctaagttaataaagatgaagaatgggtgactattatgatgaaccataactaaatgtcttattaaagcaactgagtgtctagccctaaattaaccaggtaaaaactgttaacactaacctgaagttttgtgaataactgttctttaacttattgagatgttgcaagaaatgcacatccagggtggactgggagctatgaaatgactaaattcctccttgcagtgtttaccttcaagattgtataggtattctctcctcttcttcccccagtccccattacttatttgcacacttgttttaactgacttcctgttttgatatttatcaccaagaccataaactcatcaatatgaattttcttgatgtatactcacgactgtctttgatttatgttcctaaatttttttagatagggtatgttgtgcttggcagaattcttttttggcttaatttttacttcctttcccagcttgcttgagtcttccttaacctggttttctcttaacaccaatgatgaaccctgagaaaatgcctgcatttggcctttgcctagaacaggagctgagtatttaagatgtattatcctcggggcatcctgaaaattaatgtattccctaaaatttcttcttgtctatcatcaaggcctttttttatttgttaagaatttttatattaaatgtaaaacatataaatattttctattgtataatcttggattcaacatctgtgaggatcatttttgtaagatacatagaatttgtgcatttctttatgaacttactgttagtgttcttggtttcggctgtttatgactcatgtttatgtacattctgctccaaaatgtttttgtactctgcaactaattacttttggataacaaaagccttgtgtttaatgccctaaagtatttgggggtttccttgtgagagggtggccgaatcatctacctctctcttccatagttgctgtgcaatcgtacgggtaaaattcttaattacttacaaaaactgtgatagaggggagaggtacagatttggtttttaaattgattttaaaatactttatagaaatttagtaagagttaaagcaaaagactttttttccctcca

SEQ ID NO: 6462 - DNA, 1152 bp, Homo sapiens
ttatatccatgtttttcgttgttattttcattttttaaagtgtgagttgatgtttattttagtgtttcacaatagaattatcatgtatactgattccagtgtggcatgtgattaagttttggacatgaatatgccaaaagtgcttaaatgtttttggccacataactagctagaatttcaaaacaaaattcagatttgctaccattcacctgacgaacttctccatggctcgtcactggtttggttcaactgcagaagtcattggctaaattttccttatcacctacgtaaatttctagaagaatttactagcaggattaataatgaatattataaactgctttccacacactagggtataattattggtgcaatctatgttgttcttgatgccatggttttacatcttttaatttaaaccttatacaccagtgtttaggtcgcttttgagacaaggtagccctgatgcaaggaaaaatgaggctactacttcacataaaaaatagggtgttaataccacctttactgtactgttggagcagatctttattttacaagtgttcatattcacataagagaattttaaatgaagaaaattaagtttgttaaattataattatgagactttcgttggcatttgatttcaagaatacatatgcattttccaaaaaataaatgtggaggttattcagaacaaaattcatagcttacggtagtaatggcatggattaattttatttgcatgcacacacagacacacatacttcatatatgcaaattatagcattagtttttgatatatctagtggtttttttttcaaaattgcaggaggttgtagattaaattaagtatgatagcacgttttttaattcattaatcatgaagtgctctgttccctaagttatgacatttagaagaaatcacatgctcaaccttaatctgagaacctaagtgtttttgagcattccagtaaaggagtagtgttcttttcctaacttacatcagggtacatctgtgtggcacacagatactatcttttcattcttcactcccagtcttaatttctttcccctgtatgtcactgtattttatgtcacttcacattgtgttaaacagggtaaatagagatcctcagtatctcagtgctgtgg

SEQ ID NO: 6463 - DNA, 1108 bp, Homo sapiens
aaaaattttttttcggttcaagtgttttgtgattaaaattttatgtttaattaaaatattgcataatattgatgggttcaaaaaccattaaaataatcaaacaattattctgtgcccttaacattattttcttgtgttttcaataaaattttcttttcatctttccatcttcacattctcttagcatcatcctatgcacataaggtatgttgttttccttctccactcacctaccgcactaaatttgatcagcaattgtacagtaacagaatatatttgtgccagaagatttgcaatgatatttgagcatgtatttatttaggaggaagccagtgcctgtaattatgtctcattgagtagttttactttgcccatcctgcagtatttagagctgatctgtacccaaagcaggacaatgtaactgtagatctgctttgttttcagtaactgtacattgcatcagaatctgtttatttctatctggaaacagacagaatggtgggggagggaaggagttattttgcatcctagtttgtattatgaagtcatcatatatatatttgaaatagtataagctaattactgttgcagaatgccctcgatataattatttcttttcagctggatgtgaaaagctgaagcagtgaaaacctgcagtcttatttcactggtttccttctgtttcttgtccatcacttctgtatccacagggagctatctactacatacctttggtaacaggctacattctcttcagattttttatatgaataatttcatcagcactaaagcattaacatagaataatgagccaaagtactgagtcgagatggctttcagttgagtttaatttcatatttaacttttgcatttaacttgtataatacactactgctgagaaaaacaattatgaatgccttctgcatgttgtacattatctctaacagagatggtgcaattttaagaatacaaaggggtatagagttagaatggatgtgttcgtgcatatatatgttgtatttaaatattaatgtttacaagaagattttttttaaattcttcaaatacttcacttagtgaaataatgggccaatctggaatagagaca

SEQ ID NO: 6464 - DNA, 1109 bp, Homo sapiens
cacattgaccattttctgagctctagactgatcgtagtaagttttgtgacttaacaatgaaagaaagtagaaagatgctttgggttttcaaaatgttgttttttaaaattgttctttgggtgaatttactcagtgctgctttgagttgtatacagaaacaaatgttgggaattgctcctcagaaatgtgttcctaagttgtgttttcaactttacatcatgaggtgaagcattagggaaagagattctttcgatttgtttaataatctaattatacagaccaaagtgctttacgtttctgctctatgttaatgttttagaatggtgattttgctgattaatttagacctggaattgaaataatgtgctcagaataataacatggttatagttcttgtatgataaagtattcaatttcagaatagtgttggaatcctgagtttgaataatgtgttgtatttagaaacatagccctatctgttttaaacaaataatttgttggccgattgtccatggttgagcatgacaaaaatacctcgtcgaaaggcaagcttaggtaactgctggcaaaacactgggtgcactatttttctggataaaatttatagttattttctatattacccttcaaaagggatctcttcaggttaaaaatcacgcttatgctgaagtctttatctggtgttaactaaaaatctcatatgggttcataaccgaggtcactaataattcatttttatcacttgtaaaaatttgctcaaaattccaaaaaaatattgatttgttttttagtgattttgcaggctgacccccaacctaagttttgataacatctggtaagtcagtatagttctgtgacttcatgttttaactaagaaggaaaattcatagatattcctattagattttataaaccttcaaaagtctgaaacttaattttgagtctaaattttctgacactggccccttttaatattgtaagtttttgttcactttcttaagtaaaaaaaacatttaattactagttagcccttaactgggaaactcaggtaatgaactgctgacttttctaaagttctttaactgatcaattctgtatagagggatatt

SEQ ID NO: 6465 - DNA, 3103 bp, Homo sapiens
agcatgcgaagactcagaggaaaacaagcagagaataacaggtgcccagactctaccaaagcatgtttctaccagcagtgatgaagggagccccagtgccagtacaccaatgatcaataaaactggctttaaattttcagctgagaagcctgtgattgaagttcccagcatgacaatcctggataaaaaggatggagagcaggccaaagccctgtttgagaaagtgaggaagttccgtgcccatgtggaagatagtgacttgatctataaactctatgtggtccaaacagttatcaaaacagccaagttcatttttattctctgctatacagcgaactttgtcaacgcaatcagctttgaacacgtctgcaagcccaaagttgagcatctgattggttatgaggtatttgagtgcacccacaatatggcttacatgttgaaaaagcttctcatcagttacatatccattatttgtgtttatggctttatctgcctctacactctcttctggttattcaggatacctttgaaggaatattctttcgaaaaagtcagagaagagagcagttttagtgacattccagatgtcaaaaacgattttgcgttccttcttcacatggtagaccagtatgaccagctatattccaagcgttttggtgtgttcttgtcagaagttagtgaaaataaacttagggaaattagtttgaaccatgagtggacatttgaaaaactcaggcagcacatttcacgcaacgcccaggacaagcaggagttgcatctgttcatgctgtcgggggtgcccgatgctgtctttgacctcacagacctggatgtgctaaagcttgaactaattccagaagctaaaattcctgctaagatttctcaaatgactaacctccaagagctccacctctgccactgccctgcaaaagttgaacagactgcttttagctttcttcgcgatcacttgagatgccttcacgtgaagttcactgatgtggctgaaattcctgcctgggtgtatttgctcaaaaaccttcgagagttgtacttaataggcaatttgaactctgaaaacaataagatgataggacttgaatctctccgagagttgcggcaccttaagattctccacgtgaagagcaatttgaccaaagttccctccaacattacagatgtggctccacatcttacaaagttagtcattcataatgacggcactaaactcttggtactgaacagccttaagaaaatgatgaatgtcgctgagctggaactccagaactgtgagctagagagaatcccacatgctattttcagcctctctaatttacaggaactggatttaaagtccaataacattcgcacaattgaggaaatcatcagtttccagcatttaaaacgactgacttgtttaaaattatggcataacaaaattgttactattcctccctctattacccatgtcaaaaacttggagtcactttatttctctaacaacaagctcgaatccttaccagtggcagtatttagtttacagaaactcagatgcttagatgtgagctacaacaacatttcaatgattccaatagaaataggattgcttcagaacctgcagcatttgcatatcactgggaacaaagtggacattctgccaaaacaattgtttaaatgcataaagttgaggactttgaatctgggacagaactgcatcacctcactcccagagaaagttggtcagctctcccagctcactcagctggagctgaaggggaactgcttggaccgcctgccagcccagctgggccagtgtcggatgctcaagaaaagcgggcttgttgtggaagatcacctttttgataccctgccactcgaagtcaaagaggcattgaatcaagacataaatattccctttgcaaatgggatttaaactaagataatatatgcacagtgatgtgcaggaacaacttcctagattgcaagtgctcacgtacaagttattacaagataatgcattttaggagtagatacatcttttaaaataaaacagagaggatgcatagaaggctgatagaagacataactgaatgttcaatgtttgtagggttttaagtcattcatttccaaatcatttttttttttcttttggggaaagggaaggaaaaattataatcactaatcttggttctttttaaattgtttgtaacttggatgctgccgctactgaatgtttacaaattgcttgcctgctaaagtaaatgattaaattgacattttcttactatatcaccttttttgaggggtcttaatttactttgcttaattggtgcaatattgctttaactccgttcactaaagacaaacacatcaagtccaaacttgtaaatttagatttgctgaaatactgatttatttcctgttttaatttaaagtgcctcaagtaagcacctctcacaacagttgactggtactgctgctcctgagcacctcgtgtcatagattttatactcttacagacttggaatgcagtagaggtatgtggatttttaggggttttgtttttttaagaataagtaacaagaaataacacatttcttaataatagcttttttgacatagtttggagttctgattatatggtacatttttctaccagtaatatagggttgccaataaatagaaaatgttttctaaaaataaattttattacaacaaaataaaaattttaatgacttattaacacaacctccagtatcaccaccatttggaagataacacagaatcacaagtatcatttaatttcttgcccttttcagtgttgttctggtgttggtgggaaaataataggaaatgtagttcattgggtagggaaactcttacctttccctatcttaatgacaagctgtattttctgtgtttttgtgcagctaggcgtcatagccagacaaatcctaggagaatacactttttagataatgatttccttcattatctaactgaccagtatctaatcaatctcagaaaaatccaaaaaattccctgccacctgtttagatattagttggcagatgtttcataggccttctacaggactcttcaagag

SEQ ID NO: 6466 - DNA, 1201 bp, Homo sapiens
ctgttcactcaaatagggcagagtactattctatctagatgtgtaagtgttttttttaaaatcacatggaacggttttttttatactaaaaagtggagggagatttgtttaaacaagtatttctaaaagaaatatgtacatagttctggaaattatttgtggtaaggaaatattctttactccagttgcatttctcagacaataaagtggtgcatccatgctacctcctactttgtcaacaaagatgctatttaccctttacatttttgtatcataatagattttaaaaatctaatgttctttattgcaagacattcttttgttaacaggtttgtttctttttaatgttttacctaaaatttgacatgcttacaggacaggtttgcctcttactttatttaacattgtagaaatgtaattaataaacaatgctcactacacagtttagaatagacgttctcatttatattatcttccaaatttgatcagttagcaaaacttaatacaccaattaaaatatttctacatatgagaatgtttacaatttaaattttagaacttgttttggatgtgattatatgtacgaaaatcgtgtaacactatgctcatgctaagaaccgacataacagaattactgaaataaatgtgctgtgaggaatggaaaatatggtgcaggtgtcttggtcatgataaattgtgattctttttaaaaattttttccaaaaacaattaggtattttaatctgaaatcagattcctttacaaacaacaagtttttgtatgcaagcaccattttatttcatgtagtatggctaatactatagttgaaccaaggatatgcattgattctttgcttcgtatgtaaataaagttaaaaacagttaaaataaggagtattttggtagagtatatacatacctcactgccagtgaaattgctttcctatggtatatctccttaccagaaaaatctctaaataaaaaaaggtttaaagaaaattaaaatgtgaaacatttcttatttttatcattggtggtaatagttcacttcaggttgtgtttcattggatttaaattgtttatccttgccaggttacttggatcacagagcatagtttttctagaatcacctcattggtcaatataatgtatgtgagaaaaatcattttccccctttcatgattaatcaaacctctaaattc

SEQ ID NO: 6467 - DNA, 1318 bp, Homo sapiens
agcgaaaaatggatgtaagcaagataactcgttataccgaggattgctttagtgattctaattgtgtacccaataaatcaaaaatgcaagaagtagactttctagaacaaaatgaagagctacaagcagtagactcacagaaatatgcattatcaaaagtgaagcctgaatcaactgatgaagacttagaatctgtggatgccttccaacatctaatttataacccagataagtgtggagaagagagttcacctgttcatactagcacttttctttcaaataccttaaaaaagaaatgtgaagagagtgattctgagtcacctgctactttcagtaccgaagagccatcattctacccctgtacaaagtgcaatgtgaattttagggagaagaagcacctccacaggcatatgatgtatcatttagatgggaatagtcactttcgccatcttaatgtcccaaggccatatgcttgtagagaatgtggacggacatttcgagatcgcaattcacttctaaaacatatgattattcaccaggagagaagacagaagttgatggaggaaattcgtgaattgaaagaacttcaggatgaaggaagaagtgcacgattacagtgtcctcagtgtgtgtttggtaccaattgccctaaaacatttgtgcaacatgctaaaacccatgaaaaagataaaaggtactactgctgtgaagagtgtaacttcatggcagtgacagaaaatgaattggaatgccatcgaggcattgcacatggggcagtggtaaaatgccctatggtcacttctgatattgcccagagaaaaacacaaaaaaagactttcatgaaagactctgtagtaggatcatccaaaaaatcagctacctacatatgtaagatgtgtccttttactacttcagccaaaagtgttttaaaaaagcacacggagtacttgcattcatcatcatgtgttgattcatttggtagtcctcttggacttgataaaagaaaaaatgacatccttgaagaacctgtagatagtgatagcactaaaacattaactaaacaacagtcaaccacatttccaaagaactctgctttaaaacaagatgtgaagcgaacatttggatcaacctcacaatcaagtagtttttcaaaaattcataagcggccacacagaatacagaaagctcggaaaagcattgcccaatcaggtgtaaacatgtgcaatcaaaacagctctcctcataagaatgttacaattaaaagcagcgttgaccaaaaacctaagtatttccatcaagcagcaaaagaaaagtctaa

SEQ ID NO: 6468 - DNA, 1231 bp, Homo sapiens
ggaaaggtgttcacaaaacaaatcccacataatcacaggaaacaagattccactgagtggcccagtacctaaggagctggatcagcagtccaccacaaaagcttctgttaaaagaccctacacaaatgcacaaattcagattaaacaaggaaaagacggaaaggttctatctcttttatttcttaagtaccgacactgttttagaaatatactccttcaaccaacagagggagatagaatactaggatagtacttataatttaaaaaacttttttttgcatttgttatatgtattcatttgattaaattttcactaagatttgtactgaatcattttggttactattttaaaactaaaatttactttgtcagtttataacatctgtcattaactattatgaaatcatattttatgacaaaaatggaaaatattaaattttccctgcatgttaaaaagttcagattaattatcctttttaaaagaaagcattagttataggggaggaattctgaagtgtctatctccattttagctgcacagcaaaatgtaacatccatgcaggtggtttttgaatttttttttagttatatatatttgtggactatgataacattgtatgggtgttgagttctgtctagactattttctcctttcacagaagtggtttggtgcctgagaatgacttggatgcagctgtttttgtttcatctcacttaactctttcaaaactatggcagagtacagctggcagaaagtgttacagatataatccttattttccttgtttttgttggtattgtaggagggatctgtaggcctttctgtccagcgctctgtttttggagaaagaaatttcaatatacacagctccatttcacatgagagccctgcagtgaaagtaagtaatgtagcttaatagcataatggtcagtcagtcatacactgaagagaatttaggtaataactagattaacatttattatcagaaatttttttaaactagagtttggctttggcagaaggtattactgctttaagcatttagtcaaaacttgttttctccagtttttttctgaacttttctggtggaattttttctcatttttggttagctattactgtctttctctagaggaacatttagaacattaagggctttctgtcattgctagagtgtgagctccatacagttagctaactattctgacacatagttgatagtgtaaagat

SEQ ID NO: 6469 - DNA, 1289 bp, Homo sapiens
gagatgctacattgccaatgattttataaataatttaaaattaatttacaaatttatagatgcaaaccaaaagatctttttaaaagagagagagaggaaaaaaatcaccttttatttgtttgggtctcattgtcagaattattattcagatcaagaaatctgtgtcgataaaacctaatctcatattggagagtgaatgtcgttaagtatttctgaaatgtttctaaaaaatgaacatgaaaaaaataaggtattttctccctagcttctcattacagtatttctaattgcttcacactttacagttttaatacaaagtacaagctctacttttataacgtgtactacaagtttctttaaaagtattgttgtatttcagctgaactcttgtatctgcagtcttttgttatttctgcaggctacacccttaatttgcagaggccattttgttgtttgtttgatgctgaagctgttgttaaaatgccccaaactccaaggcagattgtctgtataatacgctatagcttttcaccatgtggtgtttaccagctgttactctgtattttaaaaagccagagatttcttctgtctaaactgtttctatagcattttctaaacaaaaaaaatggtttttttctttgccttgtaataagattgtaaatccatttcctgcttgtgttcttagtgggcatgattgtgagtgtgtgtggggtgctcacacgcgtgccagtctttttgtactgtaactacctcatggtttgaatgatgattgtactgctggttgtgttaacagagcacattttgttgggtgagtcctatgtgatttttttcatgtttgttttatctgggggttgttcatgaaactgacagatgtttttctaaaaaggactattatcagtttccaaatacaatacttctctcttctggtttttcctgaatgagcctgattttgttgctggttttcatcatctatgagggtaaaacgagtacccttaaaatccctgtggccagtttgaacacccctgttgtattcttttctctgttcagtgtgtcagctattttgtgaagatgcttagatgtatagttttgataaccacagttttaaatcttttatctgtgcataataaaaagatatatatcagttattaatatgtgtcttgttatcattaaattctaccctaaggctcatgtaacttttttcactgtgactttctcctgaatggatcgtctgctccgtgttgatgaggaagtgggaggagaaaggctaagaggtccagagcagagggaag

SEQ ID NO: 6470 - DNA, 1137 bp, Homo sapiens
cccctcttccctttagggccattttgagtgccagatctagttattttgctgcaatgctgagtggctgttgggctgaaagctcccaagagtacgttactcttcaagggtaagcatatttttacagggccatttgactgcaaatgattgtaaattgtatttcatacaaagcactttttatgaatctgatttccctggatgttcaaggaaatatttctcatgtagaattcaacaaagtacattttctgaaacgggaagtaatagagagcatttattaatagaggtattgtgttaatctgcttatgcttctgtaacagaatatccaaactgggtgatttaaacaacaggtatttattttctcacggttctggaaactggaagttcaagataaacatgccagcagttttggtgtctgatgagggctctgcccctgggttgcattctgccgccttcttgctgtacactcatgtggcctttccttggtgcgtgcacttggagagagagttttatggtatttcttcttataaggaaacgaatcctatcagatcaaggacccatgtgacctcatttaaccttaattactttctcagaggccccatctctaaatatgaccacactgggggttagggctttaccatatgaatttggagggaacacagacatttcagttcataacaggtagtttttaaatttttcttttatttttatttttttgagatgggatcttgctgtgttgcccaggctggagtgcagtgacacaatcatggctcaggagtttgaggctgcagtgggccatgattataccactacattccagcctgggtaacagagccaaaccctgtctcaaaaaaaatatatatatatatatatttacacacacacacacacacacacacacacatatacgcacacacacatatatatacacacagtatatattttatataacttaaagtatctccagttatctcaaaaggatcttaattgtttaaactgttaatatgcaaagcaaatatttacattcaatttcttttttttgtttgttttttgagatggagtctcattcggtcacccaggctggagtcaagtggtgggatctcagctcactgcaacctccagctgcctcccaggttcaagtga

SEQ ID NO: 6471 - DNA, 1096 bp, Homo sapiens
ctccattctaccaggaaacagaccaaattcaacaaatattagaccacagctgcaccaaaaaagcataatgaaaaagaaagctggtcacaaagctaactccaaacacaaagacaaagaacagacagtagtagatgtcactgagcagttaggcgattgcaaattagatagtcaggagaaagatgctacatgtgaacttcctttacagaaagtaaatactcagagttcttcaaatagcactttgcctgaaagattaaaagcgtcagaaaattctgaaagtgaatacagtaggtcagaaataactctagtaggcataagtaagaaaagtgcagagcattttaagagaaaatttgccaaatcaaaccaagtgtctaggtcagtgtctagttcagtgcaggtgtgtcctgaagttggaaagagaaacttacttaaagttttgaaggagactttgattgagtggaagacagaagaaacattgaggtttttgtatggccagaattatgcttctgtgtgtctgaaacccgaagcctctctggttaaagaagaacttgatgaagatgacataatctcagatccagatagtcatttccctgcctggagggaatctcagaacagcttggatgagtctttaccttttaggggctcaggtacagccattaaaccactgccaagttacgagaatttgaaaaaagaaactgaaaagttaaatctgaggatcagggagttttacagaggacggtatgttttgggtgaagaaaccaccaaatcacaagactcagaagaggtatgtcttacagacattgagtttttccagatcgttaacatttggaaaactcaccacagcaaatcttggagcaggaaggatattgaagagttaattgttaaattttcaaatagtttctttagtcattctgccttttggtttacagtgccatctccactgttggcattactattttacaaataagttgacgtttacccctagcaaattttcatcagtgtgcaatatttttttctaatgtaaaaatagcctaaaatggtgggacaaagttttccctaattcttcatacaataaatgaagcctctgaagaggcttgct

SEQ ID NO: 6472 - DNA, 1209 bp, Homo sapiens
ttttcttcttcaatttagctcagtggtaggtcaaattgtttgcttttgctattaagcttatgatttggaaacgtaaaatttcatggtggatattataatcagaactattcaaaagggaaaacatgccagccattttatatgatgaagtctcttattccatagaaaactgtagaaagatatctgtatctttggagaaggagaaagaaaggaaagaactccagaatcccatcactgttctttaaagcatgcatcacagacctttaagagtatgctttattgagtaaaggttatagtttgactttaagataagaaattttctagaatcatgtttgaattctaaacgttgatattcttaagtaccatttctgattaggaattaggtgttaaaagaatcatggtaaggaaaccttaatccgttgaaactcttgtaatttggacaacaaaaaactagaaataacactcttttctttgaagatctgattcaaatacaccttagaagagtttaaaatctcccaggcctttaggatgcaataggatattatgccttggtttgactccttttcattcaaattaatgtaagtatgttgttcaagactttgaagcattgaacaatgttctcgatgaattttatttaattactgacattttgtgatatttgaatgttattaagttaaacacttagagttgagtatattcaggggagaaaagtgaatgaaatgactcataataagaaagcttgctcccttgggacagttaccttcctggtgtcattgccatcctgggttgacaagctgagagtagaggatacaagtgatgtgaataaaatggaaattgcattgagttaatgaaacagacacttttagatcaagaaaacacttcaacagcctttttagaaattggcacactcctatagtcccacctactcaagaggctgaggcaggaggatcactagagtacaggagtttggggctgtagtgtgtaatgatcacacctgtgaaagaataaccactgcactccaacctgggcaacatggcaagaccctgtctctttaaaaaaaaaaaaaatcctgggaaaagaagtcaaagatgtaattttacacaatttctgcccccaccgtcttttttgtttgtttgtttgtttgtttgttttttggctagatactaggtattcagtgtttgctgagatgacaggtttctactaatcagccag

SEQ ID NO: 6473 - DNA, 2051 bp, Homo sapiens
cttccatgtgttggttactagagtagtaggttaactacagacatactgttttgtttgtacatatttataaatctgtaccacctaacattgaacatcattttatatgaagaacatacatgttgcaaaatgactgctttcagcatctaacaggacttctgtaaataataggttaaaagttaaaaataaaacactaatgttttaagagctttagtattttgcttagcattcaatactagcagattcataactgatgcctgttcaaaaacactgttggtggaatcttttatttcatgtgtatgtaactactaaatttttcatgactgaagaggttatagcacatattagttagtgctaatattctactgaatataatttaagcaatgggctaaggtccaagaaacatagcaattatatctacaaataatctattaacatgatcttcagaatctctagtttttgttctatagataaagccataagaatcctttcctaccagtttttcctatatcatttagatattatttcctagaaaacaggatgcctgtcactgataagttagagaaaacacccaaattatacttgcactatggaaagacgacatgaatatgttgactgggtactttctactctcatttttgttagcctatgaaaaaaaaaacattttgttaacctatggaaaaagccttggaagagaaaagtagaattcagtatgtatggaggcacagttttgcacagtatgttgcatgcggcaaaaaaaaaaatatgaaatagagtagaagagataaaagtagttttctgtcaaaaactaggagttaagccttcaggtacgttgtggactaggctttccagcaaggtttttgtagctatttgcttgcctgagaaatgaaattgaaaacatacccctgcgtgtctgtccttaacaccaggctaaattctggtggttaaataacttatctgtggttacaagctagtaagtagcagagccaagattttttttaatatagagacaggtgtctcactgtgttgtccaggctggtcttgaactcctggcctcaagtggtcctcctgcctcagcctcccaaagtgtggggattacaggtgcgagctactgctcccagcaagagccaagattttaacctagatctccctaacaccaaagcttttgaaagggttcagctgaagaatttctcaattctctgttttgttttgtttttatttttgttttttgagatgaagtctcactgcactcaggctggagtgcagtggtacgatcttggctcactgcaacctccacctcccgggttcaagcgattctcctgcctcagctcccaagtagctgggactacaggtgcacgccaccacaactggctaatttttgtatttttagtagagatggggtttcgctatgttggccaggctgatctcaaacttctgacctcaggtgatccacccactttgacctcccaaagtgctgggattactagacgtaagccaccacacctggcaattccctgcttttttgacaacataatttaaatgaatttgatttaaatgtttcctgaatatatatacagatagatagatgagtatcaacacttacaagctctacacagtctgtgagtgtagatactacttactcgtaggattgtcttgtgctttggggatttttgttcggagttctatactatcagcccagaaagctatcaatgtccaagtgaagtgagatgatgcatggccacattattgctttgaccctcacatcaagaaatctgaatgatctggaccaggggtcagcaaagtgcagcctacaagctattgcagtcagctgccagtttttacttttttaaatagttgggaaaaaaattccaaagactgatattttgtgtcacatgaaaattatatgaaattcaaattgcagtgtccataagtaaagttttattggggcacacccatgctcacccttttaaatattgtgtatggccgctttgtgctacagtagcagagttgagtcattgcaagggagaccatatggcccaggtagcctaaaatat

SEQ ID NO: 6474 - DNA, 1173 bp, Homo sapiens
caataatgtgaatgatgcttcctaaagttgtttaatatggtgaccctaggcagtgaattctaaaattgcctgtctttcttctcaggtctctcttttctccaataaattctttttttttttttttttttttttttttttttgaagtagagactagagacagggtttcaacatgttggccaggctgatctcaaactcctgacctcaggtgatctgcccgccttggcctcccaaagtgctgggattacaggtgtgagagccactgcgcctggccaataaattctatcttaaatatacttaagatctgcaaaggtctttttatgaaacccttttattcagatgataatagtgcctgattaataggattttctagggattaaataaaataatgtgtggaaagtgttttatatatcacaggcctgaaataagcgctcagtaatattagctcttattttgatactgagagtatttgttgcaatataattttttatgctttagcgccacttagctcgtactactgggagatggaaagacccacccaagaaaaatgctatgaatgagttacaagatgaactgatgaccattcgacttagagaagctgaaacacaagcagaaataagagaaataaaacaaaggatgatggaaatggaaacacaggtatgatgggaaagcccagtatctttaaaaagtatcattagctgatcaagggtttgtgcacagattgtatcatccctagaacagagataaaaggtaaagatatgaagctgtatagaccgcagttttctagcccaaatgaagatggcaaaaaattattatattggatttcagagatttaatccttctttgacccattcaacaaagttcaaggaagtcaaattttatttgacttttttgggtaaaactcatagcattgccctgttgcatgacttgagaaggaacaccatgcagagcaaaatttctcaacctcaacacttttaacatttttggctagaagatactttgttttacggagctggtccatgcgttgtagatgtttagcagcatccctggcctctacccactagatgccagtaacggctctcctacctcaggttgcgatgaccaaaaatgtttctgcacacattgccaaatgtcccctgggggacaaaattgccccaattgggaaccacagatgta

SEQ ID NO: 6475 - DNA, 1172 bp, Homo sapiens
agcaaaatgaaaaaagagaagtgatttggttaattttgggggctctgccttacttttaagccttagacacattgtaaacgttttaggattggttatttcatagatttgttgtacctcttccaagtataagttcttttttcctgaagcctacccaaatacttttctcatcagatttcccctaatttgaatttttaatggagacgaagggaaattataatggggctagtagctcaaaaatttttaacgtaatttgctttttcaaattttcaaactgctataataggtgaaaaaaatatagcagtaattttattgatgtgaccaaaatttatttaaattatgtatattattaaaactatattttaaaacaatggttaaattgcagtaataaagctctaagtatcatcaatgcctcttctaatatcactgtccgattagatcttgaacagtttttaattatattttagattgttagaaacggatagtaagtctttaagatctgtaaatgggtcaagaagaaacagtggctcttctcttgtgtcgagttcatcagcctctagcaacctcagtcaccttgaagaagattcttggattctttggggaagaattgttaatgaatgggaagatgtacgcaaaaagaaggaaaagcaagttaaggtattcatgttctttgttgaagttcttattcttattccatagtgcgtcagacataacttaatagaggattgggaaaaaaaccccaaatacaacttccaagctatatattaaagaggtctgctttatttgttttcacttacttgtacccctaaaagttttaatttgtagacatcagttgttacagaggtcctgatcatatagaaatatataactgaaaattattttatttacttattattattttataaagactcactttgttgctcaggctggagtgcagtgatgcagtcatagctcactataacctcgaatttctgggcttaagctgttctcctgcctcaggctcctgagtagctatgattacaggtgtgtgtcaccacacctcgctaattttttattttcctttttgtagagatagggtcttgctttgttgcccaggctggtctcaaactcctggcctcaagcagtcttcctacctccgcctctccaagtgttgtgagctactacacccggcccga

SEQ ID NO: 6476 - DNA, 1162 bp, Homo sapiens
ttggcctcacttagagtaggcaatgaatggatattgagaattgttatcattttgttttaaactgctttgtttggagagtatttatgatttgaggtactttttatatttttgtcttaaggtttttaacaaatttaaaactttgattaacatataaaatatcccactggtataaaataagctctacaagtaagtcttatgtatggtcttttattctctaaacagagactctacaggggcaggtaattcactggtccacaagcggtctcctttacgtcgaaaccaaaagaccccaacatccttgaccaagctgtctttacaggatggacataaagccaaaaagccagcatgtaaatttgaagagggtcaggatgtcctagctagatggtcagatggcttgttttatcttggcactatcaaaaaggcaagttactttaatgtatcttttgctgtttttgcagtaagcatttaataatcttaaatttaacttcatgtttttaattttaagagatcaccgttaagtatttctctgtattgcagataaacatattgaaacagagctgcttcatcatatttgaagacagttctaaatcctgggttctctggaaggacattcaaacaggcaggtgctactatttctcttgaacatgatttaaattaaaatttgattttcttcaacttgtcatattatgatgttgtctgttgaatacagtgtatttagataactcagtattacttcctaggagaggttaaaaaatcagcatagtcgttattatagaccataagaagaacaagaatactctagaggacagatgcatcactaatttatacctgtaagctatgttaagacccttctaagaactttgaagaaaaatctttagtaactaatctcagtaacggtttgggattcaattcaactgttgcttgcttatatttgtagaaagcaagtgtttattgggagcatactgtttgtcagatgatttgggaaattaggacatataaaactgatttagaataatagaaatattcgttaataagaatggtttaaaattaccatttagttatgggttttttatgtttaaatgggaaaatgaggctatatttgtgtgccaataaaaatgaatgaaagtatgccttggtttggttataggtatgcttcttgtga

SEQ ID NO: 6477 - DNA, 1104 bp, Homo sapiens
ttatgaaagtaggcatgttaagttaaaggtagaaagaacacagagagcagagagataccattcgtgtactttgtcttgtgaagcattatgatgtacttagcaaacattgcgcatatgtgctgctcactgagtcataaaagtggttttgttttatggaattttttatgactctcttttttaatgtgttttaaatattttaggagccactggaagtggggaaatggtctgtacaatatgtcaagaagagtattcagaagctcccaatgaaatggttatatgtgacaagtgtggccaaggtaaccattgatttcttttaatcttgttacatactgaatgactatgttgaagattaatgactaaaaatactttacattgataatttgaaattatcctttttattaattatattaatgtaggaaataatgctaaaatgcattcttgaaattgtgttgaaagtattaatgaaaccgaatttgctttatgctttttttgatattaaggatatcatcagttgtgtcacacacctcatattgattgcagtgtgattgattcagatgaaaaatggctctgtcggcagtgtgtttttgcaacaacaacaaaggtatattttaagtgttttgggctaaagctctgatggaatttgtaagacattatcaacataatgattgtgtacactgaaagtttgttggaatgaaatgagcaatgaatgctgggtagaaagaggtgctatttatttgactaatgatgcttaagtgactttttaatgatgctttcacttatttgatgatagtaatacgggaattggtgcagtaatttgaaagaagaaaagaaaaatagagattattattaatcagacagtttgtgatatggtaaaagtttggaaaggaaatttctccagaagtgtcagagtcgtttttaaagtatagaattgtgtttaaaattttagccttcactctttcacatttttttccctctaatgtagaggggtggtgcacttaagaaaggaccaaatgccaaagcattgcaagtcatgaagcagacattaccctatagtgtggcagaccttgaatgggatgcaggtcataaaaccaatgtccagcagtg

SEQ ID NO: 6478 - DNA, 3081 bp, Homo sapiens
ctccaagaacgtgacaaaatctaaagtaatgagcccaagtgatagtccatttatatagcatttattgtttgggtttggctcatttttatatcatcaaggatatatggtatagtagagtaatccagaaaagagaacatattgtatgggcataggatgctaaaaaagctcagtagacaattctggccttctctgttacatagattatctgactccagaaaaagaacgcgtacaggaagatcttggcctgctgcaataccacatttgcggagaagaagaggtcgtcttccaagaagagcactccagactcagaactcagaaattgtaaaagatgatgaaggcaaagaagattatcagtttgatgaactcaacacagagattctgaataacttagcagatcaggagttacaactcaatcatctaaagaactccattaccagttattttggtgctgcaggtagaatagcatgtggcgaaaaataccgagttttggcacgtcgggtgacacttgatggaaaggtgcagtatcttgtggaatgggaaggagcaactgcatcctgactgtaggactgaacattatgttcactgcactctgattttctgtaggtacagttcaaagccctaaaggagtctggcttttactatctttcttaaaaaaaaaaaaaagtcaaaaaaattcaaaaaaggggatgatactagccttaacatgtacctgtcaatgttatggatattgtcataaaaaggtatcttttaaaaatcagaacagagacttaattttttaaatcttaagatttgtagaatgtttctaggataggatattaaaaatgattgaaacccatgcatggtgttagacaatttttctaattattccattgagtcagttttttgtgattagtgattatcagagcaaacatcatgtagatagcacaagtatttggagaaacgttgtttgttttgttaccaaaatgttggaaaaatttatttcaataccttttagatttcataaagtgcagtgtatataatgcctactgaaagactgtaaaatattgaaattttctttcaagcaaagtgtaaaaaaatatattgagcctgtaaattgctctgtgactagacttcattgtcgtcttaatatattcttgcatgtgcatatatatacacacgtgtatatatatgtgtgtgattatgtgacctatgcaatacaaattatgggaatgggcagctttggagtatatatcccataattcttttttcaggaatagttgcagtatttacacagcagcatttcttctcaggcttttattgggtgctgttgcttgctatgtatgaagagaaatgtgtcagacaagtttagtgtgttctgaagaagggtgtgaacaacagtgttcatgggcttttagaatgcttttcacttttagtccttgtaactcagctgttcagtacctaaaacaaattcaaataatatgaacattatctcctactagaagtaacgttttcaagttttcatggcacattatgattgtaaatgtctctcatttttaacagtaagtctataggagtcccgtgaagattcctgaaatgtctgtagtaactgttagtcatgtttgaataagtgtagtatgaacaaagtattttattgcacagggttaacaaacagtatgttgccagctgaggctactgctgttttattacaacattacctcttgtttttataaagtgtaccaagatttaaattgataactttattttacttgtaaaaaaaaagtttcttttatcaccagtgttacagttgtcttctgtttctttttgttttgttttatttgttttcctttttagccaaagagtgaacagaagattttcttattttggtggctattcattttacttttaaaagtgattggtggattttagactaattatgggggaatttgccaccaaaataaaaaatatgtaaagtgtagtgattacagagtggttaaaatgtgggttagtacttatttattccattaattgattatttgactgtttataaagaaagttgctttatttctttaaacatcttcaaaagatgatcctttcttgtcacattatagccaaaagaagcagagaacttcattgtctgcatttggttcctggttggccaggtataaatgagctttacaaaagtgcaaattaaaaactgttacttctgtttacctccaccaaaacttgattttcccctagctattaatttaaggttgcctttcctgcagctgcaatattttgaataacacacagagtttgtgttgatttttgaatgtttgtttatatctaggggtaatgaaaaatgtaaatcccgtgtatccttattcactccacctgtatcatattatttcattttccccaaagtcctttaattctaactgaacaccagcagtatttttagaaatttttctttaacatacttggaagatgatttatccagctgaactgtctttagacgtaattattgtgaatgtctgttttattttctcatggtggttcacatggctctgatgttcagtttgtatttttggaattgctttacttagaaattaaaacagaccaacattaaatgtgtgtattttttaaagagctaatgagttttgcttctgtatttgcttgaaaatacacactagtgcagtagttgactgcttttatttagctagggtggtaaggattttctaattccactgctagtatgttcacttgaattaatctttataaaactttgctttcattttcttcatccctcttataatattaataactatcacatgttcatcttaagtggtcttaaagtacgtttagtgagcatgtacactttatatttgaaagacaatatatctctattgtgtccccaaactttaaaaaattcagacttaattttccaactatgtttgcttcttacatagaattgttagggttcatataaaaggatttcctgggccaggtgcggtggctcacacctgtaatcccagcacttagggaggccgaggcgggtggaacatgagatcaggagattgagaccatcctggctaacacagtgaaaccccgtctctactaaaa

SEQ ID NO: 6479 - DNA, 1162 bp, Homo sapiens
aaaatattttgagatataaaagtaggaaacaggtataattttaatgtgaaaattaagtcttcactttctgtgcaagtaatcctgctgatccagttgtacttaagtgtgtaacaggaatattttgcagaatataggtttaactgaatgaagccatattaataactgcattttcctaactttgaaaaattttgcaaatgtcttaggtgatttaaataaatgagtattgggcctaattgcaacaccagtctgtttttaacaggttctattacccagaacttttttgtaaatgcggcagttacaaattaactgtggaagttttcagttttaagttataaatcacctgagaattacctaatgatggattgaataaatctttagactacaaaagcccaacttttctctatttacatatgcatctctcctataatgtaaatagaataatagctttgaaatacaattaggtttttgagatttttataaccaaatacatttcagtgtaacatattagcagaaagcattagtctttgtactttgcttacattcccaaaagctgacattttcacgattcttaaaaacacaaagttacacttactaaaattaggacatgttttctctttgaaatgaagaatatagtttaaaagcttcctcctccatagggacacattttctctaacccttaactaaagtgtaggattttaaaattaaatgtgaggtaaaataagtttatttttaatagtatctgtcaagttaatatctgtcaacagttaataatcatgttatgttaattttaacatgattgctgacttggataattcattattaccagcagttatgaaggaaatattgctaaaatgatctgggcctaccataaataaatatctccttttctgagctctaagaattatcagaaacaggaaagaatttagaaaaacttgagaaaacctaatccaaaataaaattcacttaagtagaactataaataaatatctagaatctgactggctcatcatgacatcctactcataacataaatcaaaggagatgattaatttccagttagctggaagaaactttggctgtaggtttttattttctacaagaattctggtttgaattatttttgtaagcaggtacattttataaaatgtaagccctactgtaa

SEQ ID NO: 6480 - DNA, 1691 bp, Homo sapiens
gaaataaaacagggccatttataagagatccaagtttgagaaatttcttagacctgtgtagttagaaaaaagcaatctctaattatatttacctatagagtttatgttctccagatgtgtgacaattacatagtacttggacagtatccaagtatgataataaactgtctgaaattggcctaatctacatttaaccaaagtgtatatattgtgggtttgtaaaaaattgttatttttttttatgttttgggtgtttaggctagacagcaacaagcagaattggcccaacaggaatggcttcaaatgcagcaagctgcccaacaagcccagcttgctgctgcctcagccagtgcatctaatcaggcgggatcttctcaggatgaagaagatgatgatgatatctgaaattcaccagctgagtttctatttcttctataaatgtttttccctgcacaacaaaaacagtgaaagaaatgcttatctgtaattttgtatgcatcttggtggacttgtcattggtattctagggatgtctgctattaagtttcatctattgtgtgctatacatgtaaaaactgtctctttgaactattgaaaatttaaggttcagtataatatcaattttgaatttttaatggtgtttatgaaattttagatagcagcgagtccttcgtttgatcaataaacagtgttacagataacttcaagtttataaaaatacagtgaaatttctacaaagctctaaatctgcatttgcatttcctctgcccttttaactaaactaaaacttgtgaattttaaattattaaggggggggtgctgtgtgaatcagtagacattggattgggttggtgaaagagttcagttctgtagtatctgaatttgtcttttaaaatgagtacatatataggcaataaatatatatgctcagatcaatatacttgtttagaaaaacttcaagacattcaaaaactaggaaggagtatgtttaatagtatttgtataaatttggtggttatgtttttttattttgtttctgttttgtgtagaggtaaaaactatagttttattacagcataattcattttgagctccactatgacatttcaaagactgcccagtttggaagtctgtcatgatttttactctttcactccaattcagtaattgttgatagtattacttacctagtccatccatactcatattattcaaatatataggtggtacttttgaaacaattacattggttctcttggtttaactgaggtttatgaatattcaaacctttgctgggggaaagaaatgaaagttaatgagcatgcttgctatgagagagggatttttaatttaacttgtagttatagtttacttattgtttttagaattacttttacattttcccaactagatggcctagagtccaacattaccttttgagatgacattattgtctccataattgagtgatagctttaaaaaaaagattagttttgcttaagaagttatgttacaactgatcagccctatatgaattaactgatcagccctatatgaaacataagttgtgttataacttatcagccgtatatggaacataaatagtttctacctgcttgttagagaagctttaatttggttctaataaatacagtatggtagtgtttataggaatccaggatgttgaagaa

SEQ ID NO: 6481 - DNA, 3135 bp, Homo sapiens
aatctcatacttttgtatgtttcatcttgaaaatatcttttgggaaataccactttagtgattatttagcatttagcagttacacataggaaaatacacagttacatagaaaaatacacatttgaagatagaggaaaccttgaatggaggggaagtgttgacaaattttaatttttaaaggagaaactttttgactatctgggttagaggaagatatgtgtaccgcctttagggcattttgttatttccgctgaatcattagttattaggatagataaatttttccaattagtttcagcaagcgttgttggaaacactgtgcagtcaaggattgtgcagtgctggttgtgtgaccacaccctgagtcagtggtgtggggaagtaaagtgtgaagaagcagtaagattggtttttaattttgcccatgttttaaattttcctggtgttttcggtagctgactataaaatgatagagacatttgggacaggcactttaaactgaacaccccttttggttttaccaaaggtcttcagtaattgttcttttctttttcctcctggactgcaggttcctgaagagggtttctgaggaaatgggcaagatgttgaaggaggttacatgcagctgcttttgggggagggtattagagttgtcaggctcaaagagagtgagagaagcaagttgcatgagtgcatgcagacatgattttttttttactaacttcattagcatttccatacattgtttttaaaaatcataataccaacccttaagttcctagttcacagttattcccacaaaagaaaaagccaacaatagtgtaccatttttctatttattttattgctgtctaatcaataaagaatgcagagctgtcaaaaaatgtgtcttacattagctgtcccaacaggattgtcttccctcccagctctgttttaattggcttttagacccactatctgtcagatccttgccatctgtcagtgtctgcctgcgccacctccgtgcttgcttaacatcctgttgcatgtctagcgtgattgagctagatttttcaggcatgtctttagattcccttgttcttgtcaaagccttgttttgttttacatttgtagtgcaaatcactttgtcaaacatctccagcactaatgtttccatcttagtatttgtgcacactgctataacttccccactgcaaacattccagttttggcattacgaagaagtagctgtgaacctgaagtatttatgataagaaaaagaaaacatctctgctgtagcctacagcccagttgaaagaactctttgaaacgtgatacatcttcagcacctcagtctgggaagaatctagtcagcactgaaatcctggcataataaacacagaagatattcaccacctcaagacaaaggactattgtcaaaagtcagctgcttccattcaaatgctgccttaaacttgagtgcctaaatctgttgattgccaacactaccactacagtatcccacaaagggctttatgtgtcagctcagtgcgacctgctttaactctgcagcaccgctgcagctgccgatgtagcctcggtaggtggctattagagctctaccatatacagtggtgcatcttcaaatttatgcatcaaactaaagacatgtccaagtccattttaatttcctcagtggttttatgagaagttttatgggcctcccccaattgtctttttattttgggttatgacgatcatgtttgataattacaatgatagtctctttccacgtgatgcttttgtttgaacctgataaaatttagtgaaactttgtaatgatctatgtgcacttttacttgtaaaatggaatttctgtatgtttatacttgtaaatatgattgttgttagtgctcctgttgctcatggtgtcctgcctcgcatttgtgattctgttaatgacatgtatcttaactaatttcttagtggtgttgtaatagggagatggggcaggtggggggttatttgtaccactgaatcttcattaatttggttctttactgttttgaggggagaaagaacgtgaaatggtttgtgtattattgaattttaagcaatattttagaagctgtgtgactgctttaataactttttcccagtgttatttgaatcatactacccgttatactaaagctgaatgacaattgtgtgaaagttactgccttcataagatcaagtcaccactgttacacagctgacatatagtgtattacctttgcagctagtaaactataaagtttagatattgaatctcgttacagggttatttatataatgtgacattattcagtactgacagactacatgaagtagttttaaaatctagtgctatttttattttaaaggttagcaatgaggaggaaatgtgatctggctgtgtttgtcttctgtacaaagcctgaagtgcttatggttttttggctaacagccacagagggcaaagtttaagactttcttgtaaggactaactgttcttttcaagctactgtttgtttttctaaaagcaggatttgcttccgtaggaggcaagttccttgatgtggaatagtgcaacctgtatatgggttattataataggaaagacatttgtacttgcacagtttaaatcattcttaaattttgaacatgtgaattgtcccaaaaaatctttaattttttggtaatttttactctttttgtgcacatgttgatttcttaatggtaaatccttcatttaaagatagtgttctctgttgagaatatttacatggaataaaacaatcttttcatggcctgttaaggtgtttagtgtgtgatctttcattgctatgtgaatcagagatgtgatgattttgttcttgaatgtgccaagtctcagataatacagagtagatgacaaattccataagtgggacaagttttttttgttttttgcaaagcagttttggaaattgtattctaattttggtttctctaagctttcctaaaggaaaaaaaaagtttgctgtctctttagagtgaatttaaattgcatgcaataatttggatttatctttcttctccagtagctgtgttgcatagactttccttttacaccatctgtccactgcaacc

SEQ ID NO: 6482 - DNA, 1100 bp, Homo sapiens
ggggctcagtggaggtggccctgggattccccgaggagagattctcaggcgttttgggggacctgctgtctccatggacctctcatggtacagggtactaggagccacatgcacttctgagcacctttgccccaggagctccctctttgtgcccccaggtccagggttgaatgtggccctgtccggggacatcttgctttctgactgaaagtgcaccctctgtggcctactttggccctccacagtcagcctgctaaggggcgttctctctgttgagattggccgtctaaactgtgctgccggcacattttagagcaaaaggagcaaatggcacaaaaacagccctgctcttggctgatttggtttagttttctcctagtcccattggccctgaacctgaccgctgatctcctggctttcagacacaacacaatggccatcggcattgcagtggacattctgggatgcacgggcactttggaggaccgagcggccactctgagtaagatcatccaggtggcggtggaactgaaggattccatgggggacctctattccttctcagctctcatgaaagccctggaaatgccacaggtaaatttccaattactttatgtgtacttaatgttctgtaaagagatctgcatgccatgtttggcaaatcagactattttagtcaatctcaaaagtaaattgaatcttagtgaaagctgcttcatttaggggacagtgtcctaagtatttggggtctacttttttttttcttttttgagacagaatctcactctgccacctaggctagcagtggcacaatctcagctcactgcaacctccacctcccaggcttaagtgattctcatgcctcagcctcaagtagctgggactataggcaggcaccaccacacccagctaatttttgtatttttagtagggacagggtttcaccaggttggcctggaactcctgacttcacatgatctgcccgcctcagcctcccgaagtgctggaattacaggcatgagccactgtacctggactggggtctatttttttttttttttaaacgaagtctcgctctgttgtccaggctgcagtacaat

SEQ ID NO: 6483 - DNA, 1116 bp, Homo sapiens
caggcaagcccacttcctgatccagtgtatttcaactttggctcttgacaggttgctaggatacttggagtctctgaagagatgaggaggaacatgggggtgagctcaggcctggaactcattaccttgcctcacggacaccagctgcgcctggacataattgaaaggtgagcagtgccgtcctctgcacttccgaccctcccagctccttccaggcatcagagcagcaggttttagaacaaagagaggcgcagcaccagcctagccctggggtaacagtacttcagggcgcatggcctacagcgactcttcccagaagcctgagcctgagaattcctggagttgcacacaaagacagcacaactcaggaacaaagaatgtgttcccgtccctgctcctggaggagtggatggagagaatagatggcctgaagccagtgactcaattggcctgtgtgagcaggagtcacagatcctgcagcctggggcagagctggggccccagcacctggagtctcctgggtctcctgcccagcaagctgcccctttgtctctttgggggttaagattgcttgaggaattaggaggagtttgtgggaaaggctgggaagagcagagtctagacagtgttttctttgaggggtggacaaatagggtcagaggttaggggatgacggcactggtccggggcctccgaggcatccctcccctcttctcatgaaaagccagggccctgggcatccattgaaatggaatgtttaggaattagaaagacaccaacaatgaggtatgtttttaagaaaagaagctctagactagatatccatattaccacaaagccagcctttttgacacattttttaaaagttgatttgggcaagactatcttgttaagttttctgtctgtccagcccatgtcctagttgccattactgactgcccatggctttccatgaagttccaggtcacagtgctgtccaggaaagctttctgtggtaacagacgcattctgcactggctattacagtagccaccagccacatgtcactctcgggcacctgaaatgtgactgatgtgattgaaggatgactttttataattagaatttgctgttttc

SEQ ID NO: 6484 - DNA, 1874 bp, Homo sapiens
tgtctaggctccactcaccaaaagttaagaattaaataggctggggtacaggtgtagatactttttaaataactgcctgggaatttctaatattctggttcagattcatagcacacacatgaagaataagcatattatatattaaatgttgaggtgtttcttttgttatgttaaatgcttacctacatactaaagtgcttttttgttttccaatttaacacgctggagttttgtttgttgttgtttcttttagaactgctttctgaagcaagtttccaagaagctcttcaggaaagcattcctgacattcaagcgcacgagtgggtgccgctgtggctactgcggtattcggtcattgtgaaaagtagaggaattatcaaatcaaaaggctacattttacaagctaaaagaaggggttcttaactgacttaggagcataacttacctgtaatttccttcaatatgagagaaaattgagatgtgtaaaaatctagttactgcctgtaaatggtgtcattgaggcagatattctttcgtcatatttgacagtatgttgtctgtcaagttttaaatacttatcttgcctccatatcaatccattctcatgaacctctgtattgctttccttaaactattgttttctaattgaaattgtctataaagaaaatacttgcaatatatttttcctttatttttatgactaatataaatcaagaaaatttgttgttagatatattttggcctaggtatcagggtaatgtatatacatattttttatttccaaaaaaaattcattaattgcttcttaactcttattataaccaagcaatttaattacaattgttaaaactgaaatactggaagaagatatttttcctgtcattgatgagatatatcagagtaactggagtagctgggatttactagtagtgtaaataaaattcactcttcaatacatgaatggaaacttaaatttttttttatgtgtccttgcttatagtttagctgtaataatttaaccttgtattcttgtgccatattctgtctttttattacttataaagacaaaccaaagtaaatctgaaaggagactagaagctttgaaattattgtttgggggttttataaaagcaactactgtcacctccatccagattcttttaaattattgatccatccatagtatatattgctactcattcaagaatcctcaataagtattgagtatttaccatatgttgggatactgtgggctctggagagaggagggggcaatagagctaggaattaagaatcagttgagtaaaatgtgtaatatttattccccattaataactgactaggaaggactaaaagccagaaaggggatgaaaaaaaaatccttaattcagggccgacattatctacttaaacaactttgagatatggtcttaattattttaaagcagaataatataattgaaagtttatagctaaaagagactatataggtcatttagtataattcttcattagtttacgaaccacaaaattgcaaataaataagctatgaactttgatgtacactataaatctccttaattctataaatttgtgtctgtaacctgaatagtttgaaaacttctttaaaaatctcttgtatttcatccgggcgcagtggctcacacctgtaatcccagcactttgggaggccgaggtgggcagatcacgaggtcaggagtttgagaccagcctgaccaacatggtaaaaccccatctctactaaaatacaaaaattggctgggcgtggtggcactcgcctgtaatctcagctacttgggaggctgaggcaggagaatcgcttgaacccgggaggcggaggttacagtgagccg

SEQ ID NO: 6485 - DNA, 1224 bp, Homo sapiens
cgtggcggggactcgcggacaccctgacattgaagtcccacggcagtcgcggtcggccctctctccgcccgaccccgtcgggcaaagagacctgtcggccgggtggggagagagagcgcgcggggagcgcccgctccagcccgggaaagctgcacggctacgggccttcttacccgtgcaggccgagggcgcggcgccgcttgtggagcaggcagagcagcaggaacgcggcaccagccagcgaggagtttcgcgccgtcaagtacttgctgaaggccgccatggcactgccggtaccagcgagccggcgaggggacgcggcggcggcggcggcggcggctaccttactgcacgcagcgcgggggagactgggaggagagcagagggcggggccggccgcgcaggaccgccccctggctcgcgccgccgcgccgcccgcgctctggagcccactttgtactttggcccggcgggagcgcgctcggcagcctccgtgggcggaacagttcccgggacgcgctctgcgcacgcgcggactccttcagggtctccggaaacgcggcgcggaggagctgttgctactcagccctgcgaggcgtcagtgctgcccctgcctcacccctaccctcccactcttcgcgcgcacaccccggctttcacaataactggatgagcgggcctggcctgcagcgacgacctagtgggccctgcctctccactcccgcggtgatgtaccgttaccaccctcttaaaggagcccaggaaggaggcggacggccccgtcacagagcgtgtagggaaaacacagcacagtgattatcaggacgaaaccaaacaatcggaactccgcagaggtgtagggagatgtgaggagaatgacacagatcaaagagctttttccaagccagtattttccaaaccgcgggttataatctctagcgcattgtgaaattggtttggtagatcgggatcatcaccctccgtttttaataaaattgagaatagaacaaaatagaaaagtttcacagtacatcacgtagtaaaggagttgtttagagaaatttcgatttcagtgttttgcacgtatgtatcgccagcggcgatgtaaaatgtatgcagatctggtcagaaaaaagtttgagaaacactgttctttgcaaagggacattcagaagtaacaatcgtgcgttgtattaatgctggcctcactcccagaatcagaag

SEQ ID NO: 6486 - DNA, 1546 bp, Homo sapiens
gatattgctaattgtgtatatgttggtttaattaataatatgtactaagaatgtccttattcttgtggttaaaaacctgcctaaattaaattgggcttcaatcactgtaacctgattcatcctgggatgtaaaccattcgaagtcagctaattggacttttatggctctatcttttccttcagtgaagaaccctatttaaaactgggtcatcatttgtcctgttctagcaagatagtcttcagtttcattttcctgtgccctgtggtagttggaaacaaatcataatgtattatttaaatgtttaacatcattgcataacagcgtttattatacagtggcagatttctttagctgccacagtaatactcattccttgtgtgtgtcttggagtgcatttgactccaggaaaagccattttggttttccttaactaaatgataaatgtacccctctcagtctgcagtattgagttgtttaaagtatatgtgcagtcttgcttacaaggaggggttaccatgtatcacacctaatcttcccaatgtttgggatattaaaacacaaagtccttaacatgccaggctcaaggtcttataagagttctagatttttaagagaattagacaaatttgtgtgtgttagaagcccattcattagaagtgtggtggttatttggtattaaactccaaatgagccataggaaggcactacatgaaataatgcactgagtatgcaatgctatcactgtctttgactgtgattttatgtttaaaaagtatgttctaaaattattatatatacatgggtgaattatgtttccgaggcactgttttatctctgtgaatcttgaataacttttttatatttgggttatgatgtcaaacgatcctaagcgaagatgatttcagttcatcaaatcatcattaatgactttatgtattatttgcacagggagaattgaaactgagtataatcaataagctagatacgaaatcagtttctcaaactgagcttcagaaaggggcattttgtactcttgtttttgcataactggttttgtttttttgcagaattaactataacaatcactggctaccgaagtaaactgatgtactgaattccataatacataacattcaatttttaccacttctgtttagcgaacttgtatacttattttctgttcagattaaaaaaaaaaaaaaaaaactcagatatcctatacaacctttgcttgttctttttattctggtatctaaatactgagaagttcatttataattcagccttgacttgaaaacatagatagtttaatcttgacttgaaaaacacaaaaataaattcagaaaatgcttttagcacagtgtctcttttttaaagttttgccaagtgtggtttttaattgaatgaatttctcttttagaaaagttcagtaaaatctgtgtacctgacaaatgctaccaaacagccaggagaccttaaaagatactattcgtcttggaaaagattttaaggcatgggaaagtttcagattttcagatttctggg

SEQ ID NO: 6487 - DNA, 1115 bp, Homo sapiens
aaataaactgttctctcctgtttattgccactgacaggagaggtttctctttacctctggtcctgcacccctctgagccatcctacccacagccttcagtcattgtcctaaagcctagctctaattccactgcctctccttttgtgcacacacacttctctgcttccctggccgttctctatcttggagaggcatttcaaacgccacttccaccagaaggccttgctactgcaccaactagttactatctcttcttcacccaaatcctggtagcactttggatctcccactttgcacttagggttcaccttccgttataatcattgccatcaatctcagcatcgtttttaggcacttctttccagccattgttcttacctccaactacatatcttttctggactgtgcattattcagtttattaaatgcccattaaatgtgtttagccattgtcaattactctgaaacgttcaggttttgacaaattctttcctaatgtaagtgtggtggaaagagtgaaagaaagtcaaattgcacaaaaataggatggtgtaatttggggttatgccgtcaattttgtccactgataaatgggatttgagctctccaagttgactagatgccctttatttttcagaaatattctacatcattggagctgtggtatttgtggtcatcatccttgtcatcatcctggctatatctctacacaagtgtagaaaggcaggagtggggcagagctggaaggagaactccccactgaatgtttcataaaggaagcactgttggagctactgcaaatgctatattgcactgtgaccgagaacttttaagaggatagaatacatggaaacgcaaatgagtatttcggagcatgaagaccctggagttcaaaaaactcttgatatgacctgttattaccattagcattctggttttgacatcagcattagtcactttgaaatgtaacgaatggtactacaaccaattccaagttttaatttttaacaccatggcaccttttgcacataacatgctttagattatatattccgcactcaaggagtaaccaggtcgtccaagcaaaaacaaatgggaaaatgtcttaaaaaatc

SEQ ID NO: 6488 - DNA, 1736 bp, Homo sapiens
aaccaaatgaaagttcatgtattactgttcatattcaatgtgaattctataatttataaattattcacaagaatagattctagctgctgttttaacttttatactatgttctaataccaggcagggatgttagcaccaggtaccagaagagacatctatgatcagaagctaacattacagccggtggacaactcgacaatttccctacagatgggtaccaacaaagttgcttcccagaaaggaatgagtgtgtatgggcttgggcggcaagtatatgatcccaaatactgtgctgctcctacagaacctgtcattcacaacggaagccaaggaacaggaacaaatggttcggaaatcagtgatagtgattatcaggcagaataccctgatgagtatcatggcgagtaccaggatgactaccccagagattaccaatatagcgaccaaggcattgattattagatccacacagaaggagctcagtatttagtcctttgtttttattcagtgagaaccaagctagccttgagtaatttttatcttgtcttcctaaaacactattaagcttattgtacttttaagaaaaattgccttacgtacattcctttttcctttttctgcctcttccctcaatagttgccttttagtgctgtaatagttaaatcctacagcataatcaataactcgcatatgaagtaaaaaggaatactgtgaaaggggagtactcttgtacagccagttcttttatgcaaaaatctatgcatttttacaatcttatattaaactggtattttcaaacaataggaaactttttttttttttttttttttttacagtttagtgtatctggtttctacatggaagactaaactcatgcttattgctaaatgtggtctttgccaactaaatttaagatgcagcattttagaaatttacatatcaatgtttctacagtattgtttgctaatttttaaataaagtcatgatcagtgtgcatttgtgattatatgtgtactcattctcttacctagcgaacaagatcttttcagagtggtgtttctaaaagagcatgtacaaaagtggcctgtggacatttaggcctgggtgatgcatttgctcttcctgtttgtgccaatgtatcaatgtagagttgctctgttttcttcaactgtatttattgctgcatttctcagcataaacttatcccattgtattttttataaataaatattttttttgaactttcatatgaaccacaggctgattattttctggctagcttctagataggtagggtcagatttttttttaagtacctttttcctaggtactgttacaaggtacattaacattttatttacttcacacaacactgcactctatgcttaaggagattgaggcttaggaaaccattacacatagtaaatgacagaattctaatcattttctgacccttgcttatttcactgacttggctggcccagattcatcttaaattcaacttggaataatcttaaaatctttaggaatattgacaggaggggtggggaattttcctatcttagggtaagtaaacatgaataagaaacatgctaggtcagccataggatgtgctgcttggtaataagccagggtttatagtgaaacataaaccttcagtcctgacagagggaaggacaaacaatagctaggtgtcatagtgacaaaaatgcagtcactaaaagaaaattagtaac

SEQ ID NO: 6489 - DNA, 1125 bp, Homo sapiens
ctatgtcagatagaaattttcccttctaccatatctctcctcactctcacttgcttgaagaggaaaatcacatggaagcttcatcagcttttcttgcaaaatctgctaatactcacacttgtctttctcttttaataaaaggcatagatgtttagttatctaagaccaataaacaccaaagcctatcgtcttctgcctgtcaagagactgcactatctgtcatcccctttctcatttatttctctctatattggccacttttcaccagtttcaagcattctcagcttctttcattttaaatgaatttaccttcaactttcaatccatccatctataactctacgtactttctatcaccctgcctcccctctcccttttcactcataaccagacttcttaaatagtctatctttgttgtttattatctcatttctctacttactattatttggttttagcactgttgacccaaattgctcttcctcagcgtcaccagcgattagtagagtagctaaatgctagtgatatgatttagtccttgtcttacttaatacctagataatatttggcactgtgcaccattgtcttaaaattctctttcttcctggtctctgatacttctcacctggatttatcctacctctctatttcttccttgtcttgtaactccccttctacctgggaggcctcacctgctgtcacagctccattaaacctcttatgattcagacagagttcacatcacattttctagctcagacctctcctaagagacccacactaagaacctggcggactaatgaatatcttcaaacagtgtgttcaatctagctcctgtttttggtgtccgctgtgttaggaaagtgcaagataccaacttcagtctcattaacaagccagtaaacatggtatttttccctttccttccaacctgtcatcagatattattgattatacctcctaaatttttgttgaatctggccttttttctccaactcttgctaccattgcagtctaagccagtgttattcaagatgctggtctctcaaggtagtagtgtgtgtcaaactgaaatcagcatacttctagcaacagtatgcttaatgtcaatattggcataaattt

SEQ ID NO: 6490 - DNA, 1108 bp, Homo sapiens
catcctctcgctgtccagctgcttgtgtcttctgcgatgtgttcctctccacgtccagctgcttgtgtgtctgcctgctagaatcttggaggtttttataggcacaggatgggggcgtggtgagccagggtggtcttaggaaatgcaacatttgggcgctgaaggcaggggtgcctgtcctcacttagacccgtgggcacgggtttgggggtggagccctcgccagggaccacgccctcctctacccagcacttcctttccctcctttcctgttatttaaagggaccacgcccttcccagcacttccctcccgttatcacttacaaaagctagtttatcaagttctagctccttccctgacttgctgtccaacattggtatctttttgttttgaccatccttataaatgggatgggaggcagctgatcctgtaaattaaaaaggactggaaattagaagacctgaatgtgcatgtttgcttgttggtttacaagctgcatgtccttgggtaagtcacttatcttccctgggctctattctttcatctgtaaagcccatctcacagagcagctgtgaggatccaatgaagtgatgccagcaaaaggtgcttgcttcgtacatgtttttgatgatgtctttgccatttgattgcagtgttaaacttaataaattttgcatgtaaaatgtatactttttataaaaaatatttgatattcatcttgaaaacattatgctgaataaaataaagcagacgcaggacgactattgtattaatatgatttcacttatatgaggtacctaaactagtcagatttacagagacagaaagtacaatggcgagtaccaggagctggtgggagaaaggaaatgggaagttagcgtttttttttttttttttttttccttttttgagatggagtctcgctctgtcgcccaggctggagtgcagtggcatgactggattctaggctaagtggagctgcagacaactttgacccgtttgacaaacttactgtgggctcagctcactgcaacttctgcctcccgggttcgagtgatcctcctgcctcttcctcctgagtagctgggattacaggcatgtgccacc

SEQ ID NO: 6491 - DNA, 1132 bp, Homo sapiens
aagggatctccctttgttgcccaggctgatctcgaactcctgggctcaagcaatccccttgcctcagactcccaaagtgttgggattataggcatgagccattgcacctggccccaaatagaccaaatcttttgattagaaccaaattattcttcttctgcttatgggtggttggtatccacaaattgcaaatgcctagtcttcactcctctcagtttttctttttgtttctgtaataaacactctgggaagtttttcaaaagttatttcttttgatagtaattattgttaaattaaatgcttttatatctttagcaatgttgccaaaaacaatgagcaaaatcatgttttcttctaaagaagtgatgcaatatgaaataaagatgtgtgtgcttttcagaaagaaatgaaagaaattctagaaaattgtggttgggctggcattaatagctgaggcaataaaaaaattctctggtctgcagaaatcaatcttaagggcaaaggtagtctatagtatgggttatcaagtaaatgaatcaaattcactttagtactttatttttgtcaaggattttgtctctaatgtgtgttaagcaatacctcatcccttccacatcctgcaccagtccaggctgcagtgggaaaagacaaatgcagcagatgccaactaggaagctctcagggcacatgtagtgtttggctgaaattctatttatctgtatattctcatgaggcagggaaaaaaagaacaaaggtccttgtttaagataatccattataggttggaatgaaaggaaagattcttctaagagtcctttttaaatcagattaggatattcacagttcctatccacatcctgcttctttcttccttgtgcagcccctaccaagctcatctctgcacccaggtcacagatggttaccagcctggaatgcccttctcagtgaaacgggaaatgttcccttgtcccccttgcagggtgtggaatggggatgtggctggcttcttcagtgccccactgctcaaatctaggggagcatacagatgggcaggctgtggggctccgaccccacagcaatgtctaggggtgaatgtttgcagctgaagccccagtgggcatgtgttaccacg

SEQ ID NO: 6492 - DNA, 1153 bp, Homo sapiens
gtgcagtggtgcaatctcggctcactgcaagctctgcctcctgggttcacaccattctcctgcctcagcctcctgagtagctgggactacaggtgcccgccaccatgccgggctaattttttttatatttttagtagagacagggtttcaccattcacaggatggtctcgatctcctgaccttgtgatctgcctgcctcagcttcccaaagtgctgggattacaggcgtgagccaccacgcccagcctatggtaaatatattttgaactacaaaggtgctgtggtactttaaagaaaaactatttttactagtttatctgaatggtctgtggactttatttagaaactgtttttcagtttagttttttggacatatcctttgctcagtgtattttgttacttctctagtaaaggtagaagtgaagcagatgccattgtaggttttaccagcatttaaatatattatgaattgcttagcaatgaaatgcaagtatgcatcttttacttaaagatactatttatgtattcagctacagagatgaaatagcattttatgtgttaattgttttggctataaaatttaagtccttacagcatttggggattatacacttggatttcaaaattgataaaacccttgtgaacatatctaatagatattctgtttacttgtagaaataatataatgtgtctggttctgttttgttagacattttttatgttctactgaatcagaatagtcagtgttatattccttatttcaagaattcatctattttatggctacatctcatatgtgctatgaggacttctagccagtgggtggcgctgtaataccgaagtactgcactgctttgttcctgtttccttgtgctgattcctttctagtatttaggtaacattaccggatggcatttcccttaaattccaccaactcttaatctttattttaaaaatggctactttttttgggtggttggggtaagggttaaaaccttaaattagtaaccgctgtttattttccagtttatttgttttctgtgattatttataataattgatatttgtttttacaagtcccctgaccctgtaataatgaatgcagctatcttaggcaaagcaaataaataaactgggcatttttaaaataaaa

SEQ ID NO: 6493 - DNA, 1109 bp, Homo sapiens
cctgtattctcagctactggggaagctgaggcaagagaatcacttgaacccgggaggcggaggttgcagtgagccgagattgtgccactgcactccagctcgggcaacagagcgagatctatgtctcgagaaaaaaaaaacagcattgaaaagagatctttgtttccttatttttcaggtaaggaagtggaggattaaatgatttgcccaaagtctcacagtaatttgtagagctgagattgaaattcgggtgaaacttcacatatcacattctttttatcaggtatgttgagaatatggtttgctgaacacagaaagcaagtagttatctagaattatggtccagttgtgtaaaagcttttatattttaattatatatgacaataatgggcttttacccttctttttgagatggcagtttctggatttactcttggtacctgcatacttctgttgcacattagttatgtggctaattatcccaatggaaaagtaacacagtcatgccatggaatgattcctgaacatggtcatagtccacagtctgttcctgttcatgacatttacgtgagtcagatgacattcaggccaggagatcagattgaaggtaccgtgctgggattaactgtttacattttggatttcactcttttactgtttattgaatctttattattacttgatttagaagatttcacttaaatctgttttcttttgtaagatactatcatacttcttatttttggttccagatgactgtattacttaagtagtctgtgtattccccatccagaacaggctttaaaataagtttttatcgttatttactatttttattaattgtgctatcacttcaagagaagagaaaaatgaagtttattttatcttgtttaaaatataataaacccttgtccttcttgatatcatataattttaagaacaattctctaatttctctggtaaaatgtaggctgattattaaagataaatctataacagcattttgcaaactattttttgcaactctagaaatgcaaaatgttaacaggtactctgttacatagagagtatatagaaaaataagtttggaatattctgtgtgatatata

SEQ ID NO: 6494 - DNA, 1237 bp, Homo sapiens
atttaatcaggtttagtctgtttctattttaataattttaaaaaattatacaagcaaattagatattagacatgttagttacaatggtaacacatttttaggtgtcgaaacacaattttcaaaattcctaatgaaagttataaaaatgtaaacaagaattgtaaaaatggacaaagtagtcaaatatattttcaaagcacaattttattagacaggcataatttacattttgcttttctagtgggtttgaaaatgtttattggagattgggctatgtagtttataatttttaattcataaaaaagtaatcatacatgagaaggtagacctgtgccctaggatcatgtcacatatacagataatgccatttccttgtgtgtgtgatgtgtgttttgatgacctccacaggccttactgtatcaagcttttataatgatgactccttcattatttaaattcctatactttttatttgttatcacgcaactactttgttcaatgtgaaaatgtgctaactcatgggagaagagtgccaattgatagttcttttagcaattaagaatatggtatttgggaagaaaagtttgaaatgcaacaaatggatatttcaacacagtagtattatattatcagttctttagtaagtgattttagagatgttgtaggctacttttacggtggaatatatagtatagagatgcaaaacttaaatgtttacatcaatttatattgaatgtcacataatttcatggaaggaaaggtagcttgatatttagattctaagatataatctgaaaggaaactaattatgttctctacacttactgtaatactgattattcttacatatcaaattattgaactttaaaaatttcattgtatagtcattaaactgagttgggttttttcttaaagggtttagcatcactcatttgatttacacattcacattataatatttaattatcatgggtgtatgctttacataaaaaaggtttataaaagttatttatgctatattgaaagtcatcttaagaatctccaggttatttaaagtagttataggagcagagaacaagcacctttatcaaaatctggtcctatgtgccttgctttaccaaatacctgatttttctggagggtgttcctgtaattcacaactgtagacacatgggcaaaattaggatttttaagaataaatacatttctatttttttggttgtttcaacattagctc

SEQ ID NO: 6495 - DNA, 1788 bp, Homo sapiens
taataaagagaagagcaattagcttgtaattcataagttaatactaaaaggtatgtagtttctccttatgagtaaaagtatttgtgtaaaaatcctaattactttattcttcctcagaattccatcatccctggccctcccttcctatttggagcctgttcagtactgctggctctgcttgttgccttgtttattccggaacataccaatttaagcttaaggtccagcagttggagaaagcactgtggcagtcacagccatcctcataatacacaagcgccaggagaggccaaagaacctttactccaggacacaaatgtgtgacgactgaaatcaggaagatttttctatcagcacccaggtcttagttttcacctctagttctggatgtacattccatttccatccacagtgtactttaagattgtcttaagaaatgtatctgcatgaactccgtgggaactaaaggaagtgggaacttagaaccagacagttttccaaagatgttacaatttcttttgaaaaaccttttgtttattagcaccaatttcttgccactaagctatttgttttattatacatcctttaattaaaaactatatatgtaacttcttagatattagcaaatgtctctgctaccatttccttaaggtgttgagctttaactctatgctgactcagtgagacacagtaggtagtatggttgtggacctatttgttttaacattgtaaaattttgagtcagattttaatattgtaaaatcttgggtcaaataattcaaagccttaatgcagatgcactaaaacaaagaaatggtaaatgaattgtttgcatttaaaaaaaaaaactcttaagaaaactgtactaaatctgaatcatgttttgagcttgtttgcagtacttttaaacattattcactactgtttttgaagtgagaaagtatcagccatttagcatttaagttggggtatttagagcctgtaatctaaatgctggctcaaatttattccccagctacttcttataccactattcttttaatgtttgcataatcataagcacctcaacacttgaatacataatctaaaaattatatagtaaagctggtagccttgaaaatgtcagtgtgatatctattatgtagataaatatatatagtggcctttcaggactgtcacagtaacactttatttacagagctaatgtttgtcctaaattttcaggaccctagaggagagctttatacaattaccgatgtgaatttctctaaagtgtatatttttgtgtccagttatattatttaaaaaagtgttactttgtaaaaattgtatataaagaactgtatagtttacactgttttcatcttgtgtgtggttattgcttaatgctttttaaacttggaacactcactatggttaaataaggtcttaaaagaaatgtaaatattctgttaataaagttaaatattttaatgattttttttttaaaaaagtcttgatctgtgagttcctacagggtctgttttggctttgttaccatatttttacagtaacaaatcaaagcattattcattctttctttgcatccatttcttttccctcactaaaaaatgctcttcaaggaagacaagaggaaagaaacaaaaatgcagtatgcgttttgaagtacttgattttcaaagtgtagatgctgcataatagtttattaacaaagctcaaagtttacagaaataacattaaatgcaacactttttgattattaacacatgtacaattttacactgcaaa

SEQ ID NO: 6496 - DNA, 1106 bp, Homo sapiens
acatagtgggtatacagtaaataattattaaatatttgaaatctgagatgaaagttaatgaatgtaggtatgggaattgtacaagggataggaagtaccttggagaacttctgtaagctccaggcatatactcaaagatgggaagagtaggaatcagcattttcaaaagtcattggggatgcccatttttttctgtactgtacaggaagaagggtttgcctgatcttacaccattgttagagcttgagctctgaacaagtgaaggtttactctttgttcttttttttttttttttttttttttttttcatttctaggccattccccgatttaaccagaaaggagaagtatataaggcacagataatgaatgtgagctggtcagctgatcacagagttattgatggtgctacaatgtcacgcttctccaatttgtggaaatcctatttagaaaacccagcttttatgctactagatctgaaatgaagactgataagacattcttgaactttttgagcttccaaagagtatgtaaaccctagctgtgccagcacatgttcatctttacaatttatattgtaaatgatttgtatcgtatgattaaggatctaaggcacaatatttgtcactgttctattagactttttactgaaaatgaataatggtgtaatggttctcctggggctgtcacattttataggtcagagtgtgacttcttaatatggtgctgatgtttttgtgtcaatggcttgaaactggcaagattaacaaaattaggccgggcatggtggctcacgcctgtaatcccagcactttgggaggcccaggtgggcggatcacctgaggttagaagtttgagaccagcctggccaacatggtgaaacctggcctctactaaaaatacaaaaattagccgggtgtggtggtgggtacctataatcccagctacttgggaggctgaggcaggagaatcgcttgaacctgggaggtggaggttgcagtgagctgagatcgtgctattgcactccagcctgggcgacagagcaagacgccatctcaaaaacaaaaaaacaaaattcatgttactaaaagacaggtagccatatac

SEQ ID NO: 6497 - DNA, 1150 bp, Homo sapiens
gccaccgcactgagccaaattctttaattctgatggaattacctgcagactaattgtaacacgcatgcttttctaggatttgggaggggaatttgtttgtttggtagatggcgtctagctatgttgcccaggccagccttgaattcctggcctcaagcaattcttacaccttagcttctcaaagtcctgggattacaggcatgagccaccatgcctggctgcaagttttaatttttgaaattgaggcatagcattatagggtcataacttaacttataaactggctttataaattagtacattttaaataggactaatgaagcctatattttcctccactagtatatttaaaggtataagacttgtgtatcccaaacactcagaatattaaataactaaagatcttattctaaaaggtgcattgagtgggtttttgaggcctaaaaattgtataccagtgctaattgggatataccaaactttttgtctcttagtaattagttttgttttgttttgttttgttttgttttaatgttgtgcttatcttaaggtgtaaatgcagacaaagttggaattgaagctgccgaaatgctattagcaaatcttagacatggtggtactgtggatgagtatctgcaagaccaggtaatgacacatttaggttaaaaaccctctaacctgttagatttgaatatgtggtagattgaatatcaatttaaataattgactttcagacactaattagcaagtcctacttcaataatttaaaaaaatattctgggatttgcattcctcaaatttcagccctcattttactttacgtgtctacagtgttttgcgcaattgaccactccttcctttttgaagtattttctttccttggtttctgaaatactgttatcttcctatctcactggccatacattctagtctcctttgctagtttattatggttttcatcttctcaacaacaatttttttttttttggtggagacagagtcttgctatgttgcccaggctggtctcgaactcctggtttcaagtgatcctcctgcttcagcttcctgagtagctaggcctacaggcacatgctgtcatgcctacctaatttaaaacttttttttgttttaatttttatagagacgaggt

SEQ ID NO: 6498 - DNA, 1139 bp, Homo sapiens
aagcttgttaatatctatgatagcatgcccttaagatactccaacattatgatttcccagtttggttttccatatgccaactacaaaagaaaaatataaaagtaaaacaaacaaaaacaaacctgaaaactgcttggcatttgagtagcttctccatgctatgtatttttttaagcaacatcatgaattttatctactccagaagtctctacaatagaaaaaaaagtgcagtgcttctaggatataaaattcacattacttttgaaagccaagaagttggtcttatccagttaggtcttcttatgaagagttttcatccagggatataactccttggtcagtgattttattgtttacatcctgagactgttctacagtttctttgactcctggcatttgccttaaggacctatagcaagctgtttctaggatcagaaactcaagagaggcatttctctgctttttcactaaaggtcagttgttttaatttgaaacctgaaatgcctctttagcaaaagcctgtggtatggggtaaagccatgtaagaagagaatagtctcagtcacatatgaagaggaaaatttgcagctgccagtgctttccttgtggccctgccaaccagctcttccaggacgaactcagtccagcatggttttgatgtaaccatccatgcttttatttttgttaagtcttttgtgactgggacagttaattttagtagctgaagaacgtctagttgtttgcttgatatttgtgaacatttactgcatggatcacaaaacaatataccctgtatttcttacacgccacttatatgcagcaaggagtaaatgtgttactagattcgggtagtgcattttgtcactgaatctgaccttgagaatgtacattaattcttatattttacataatgtatgtgttgtttaagaaatgtataaaaaacctgaaaaaaatgagtaagaactggcagaagttaaaaccctttgtatcaaaagatctttattggtagagcactggttatcttctggatactaaaaagttgtattacaaagccaaacacttgcattcacaactttaaaaaaagatccaaggaactattcataatgatgaaatttcaactacatacaaggaggagaaaa

SEQ ID NO: 6499 - DNA, 1228 bp, Homo sapiens
caatagaacacgtggctgcctagactcttaatcactgatatctaccacaccaggatttaatgccagttgggaggaaatggcgaaagggcaggcgctggagcccatgcatccgggaacactggtggtaggcggtcgggtgggcgtgagcgggctctccatctcccagcccagtctgcaggtcgccacctcaggattttcttcctgagtccgggtggcaggattccatcccaggtcagcccctcacaccccctggtagttgccacctcctggcgtccctccaacagctccagcacctttctcatcccgcccccgccgcaagccacgccctccgccgcgcaggccccgcccgcgaccggcctccctcctttcctgtcccaggacgcgttgcgcggcccgggccggaagtaagcgaattcccgggtgtgtgtctgtgtctgtctgtgtctcgcagcggcgcgcggccccggacaagcgctggggattcccgtttgaggcgtcactactgtcactgccatcaccccacggagccacttctagaggggagtagacccggcccttcgccgggcagagaagatgttgcccctgtccatcaaagacgatgaatacaaaccacccaagttcaatttgttcggcaagatctcgggctggtttaggtgcggggtgctgtgtttgcggggagggggtgtccggcagaaagggagaaggcccagacctcaggatggcccgaggtccagtgagggagagtcaaaaactccccgtcaacccctagctgtgaagaaaggagcatgtgaactgggagggtcttgaagagggtacccagcctcggggtcccggcacctccttaactctcccggctcttttccacgtgtatcattcccaggtctatactgtccgacaagacttcccggaacctgtttttcttcctgtgcctgaacctctctttcgcttttgtggaactactctacggcatctggagcaactggtaaccaaaggggaaaatggtttgggcggaagctgggtgtgagggagacgaagcactgtttgcttaatgccacgtagctcctcactaggaggttcaggtcctacctttgttacctacctctgctgctgagttgctttctcatacccacaccaatctggtagggctacagttcttgagtaagatctgggcctatcctgtgcaacctctcttgtcacgctcccctccagttccatcagacaagactga

SEQ ID NO: 6500 - DNA, 1168 bp, Homo sapiens
aagatagcctcaaatacagtgaaagattatgtatccaaaaaaaaaaaaaaaaaaaaaagaaaaggagcagggaaggacagttctagttaaagccaaatggatgtgagtctgacaagggtgtctttgatttatatttcctaactgcaaattacacagaaagtgagaatggggaataacttttattaagtatttatgtgccaggcggttagtgtggccttcatgttattacatttaatcctcaaatttctacaaaggaataattttgcatgattttatgattgacggagcattttcaaatctcctctaattctcataacatctctgtgaggaaggaatttttatccttattttacagatgaggaagctgtttggagataatttaagtgacttgcctggggaatctagccagtagtagagtactgattaatcaggtgctgacatctgctctgctttgtgtatgtaattcagcagtgcttcaaagatccaagaagctgtagcagatctcaatacactctcctataaaattagtgaataatcaccatgacaaaattggtatggcggaacagtcattatacattatttagactcattccttcttccagtgcccttatgattatttcctacctttaccattgatcttaaactgtgcaggctaaaaagaggaaccagaactcccttaagcacttttaagactatttaaaaaataaagttttgttggcattgaagagtaagctgcttaagggactgaatgaaaagatagtaccctttgtggctgtatgaagagagaaactgaatttctatccaagagaccttaatttagtttattagggaattatcttccccaaaagtacaagtaattttgcactgcaggagaaggataagtagatttgatttacatcacattttatacacacctttcaaaaggaagaaatctgtttcataaatagtagtaatctatgcttaaacttaacatttaatgttgacttcttacaacagccttgaaaattatttgtaattttgatcatgatgttggaaagcttgtaataaagaatatctttctcttctgcatccttttatcctcaaacttagcatggattcacatgctgagtaaatgtttggttaactagtgaacattttagatagttgtgtcaaaaataagggttaggga

SEQ ID NO: 6501 - DNA, 1193 bp, Homo sapiens
cactcttgagcagctgcttgagcccattcctattctgtggagtgtagtttcatttcaaaaaatttttgcttttctcttattgctttgtttgtgcagtttgttcaattttttgttcaaaatatcaagatcctggacaccctccaccggtaacactattacttgaatccaattagagtataaagcctgtattacagggagatgatagggaaaataaacatattttgttctccaggagaaaaattcagaaattcattttttaatattttattatagtcagagatttgtagtactacttagtgcatttaaatttaatagcatttaatgctattaaaaaccagcattctgcctcctaaaggtgtactgcaggcaacttaaggaactagtaactattaatatcttgtgtaaagtggaatattctagaattcatatacatactcatttttcattgtaccctttatagtagatgttggaaagaaatctattatctaaaattatttacaaattctccttttcaaagaaactgtatttgtcatccttttagaatttcattgaatagtacatgttgttgctttttattttcttgtgttcaacagaatcttggaattttaggaagtgttttcctttaactttttgttttcaggtaattttagacttacagaaaagttgttagaaaagaaaaaagaattatatataactttcaactattttctccccaaaatagttaccatatttgcttttgttttatatttctcttttttctccctcaatctatgtacatatatatgtacacacatgcacacacacacactacacacattcatacacattattttctgaatctacccatgttatagaaatggtgccccggcaacgaaagccaaaacagacaaatgggatctaattaaactaaagagcatctgcacagcaaaagaaactaccatcagagtgaacaggcaacctacagaatggcagaaaatttttaaaatctacccatctgacaaagggcaaatatccagaatctacaaagaactcaaacaaatttacaagaaaaaaacaaacaaccccatcaaaaagtggacaaaggatatgaacagacacttctcaaaagaagacatttatgcagccaaaagacacatgaaaaaatgctcatcatcaatggccatcagagaaatgcaaatcaaaaccacaataag

SEQ ID NO: 6502 - DNA, 1123 bp, Homo sapiens
tggtgctgaaaaataagaaaaaaattaaactgcattctgctgttcttctttagaagcattcctgcgtaaatactgctgtaatactgtcatgcaaagtgtatcctttcttgtcgtatcctttttggggcagtgtttttttgtttttttcctagaaatgtttgtccttcccccacctgttgatccaggttaaggaatacttttttacactttattcaaatgaaatatttctaaaattatttgtatagactgaacagatcttttatgtgtttttagatttgttgttgaattttctgtgctgtcctttatataattttttgagggaaagttagtgaatcaggtcaacttacttagagaatgtgttcatttactttaacccagaatacagtcttgtttcttctatttgtatgtttcctaaacctaattcaataacatatgctttctgttgtgtaatatatctggtttaggtatttataatgtgtttaaaatttgggcaaaggaaatgtttttcttttaaaaagtacttacattgaaaattaagatgtctggattactatgtaaattctagagagtagcagacctctcatctgaagtcttagtgaatctcttttgacatagatagcaatagaagtatctttcttctttcccctttctttttctaaacaagagaagaaaagcgtaatagaggggagaacacataatgcccactaagggtagtgcattaaggaaaaacagtcttggcaggtatataggaatagtggtttccagactggttgatgaccgtaatcaccaagaacagtggttctcagtcttggctgcacattgcagtgatctggaacttaaatactaattttaaaagggtgcagtggctcatacctgtaatcccagcactttgcaagtccgagatgggagaatcacttgagcccaggagtttgagaccagcctgggcaatgtagggagaccctgtccctacaaaaaatacaaaaattagccaagtgtggtggcttgcacctctggtctcagctacttgggatgctaaggcaggaggattacttgagccccagaggttgaggttgcagtgaaccatgatcacaccactgcattctagcctgggtgacagagtgag

SEQ ID NO: 6503 - DNA, 1442 bp, Homo sapiens
atattttgtttcgcgggggagtgagggggaagaacacggatgaaaatgtcagtttttgaagggtccatgcacatccctgacacctcacaccttatctaagtctgaagctggggagaaaggggttcatttagacttcatacatttccagtacgactttagtatctctccagagccatattttctcagtccgaattaattccccctccctaggtgcctgtaggctatggtacttcttcctcattgttttctaggtaaacttcactactggtaattaaggggaaggatatgaggaagcagtttaaatagccctgttctcattactctgaccacatacatcatagggtgctaaagttgatgaacacattaatccgttaagtaaaatggactttgtaattgtacagcatacctaagaaactcagaaggtgcatttaagagagagacctgaaagaaatagtatggatttttaaaaattcttgtctctactattataaccaaaaaatatttcttgtatgtcccataaaaatatttgtgtaattcttatgaaacaggctggtagaggaggtttctgagcctagcccaagggcttattcatcaccatgggtaaattatttaaactcacttaattaaggaaaatattttcccagctagaaaagtatactcattctcatttaaactctctcatttggagggatcatgtgagttggcctacttacaagtagtgaaagttcccttttcagttttgttttgttttgttttgtttttctctttcactcagccaaatgtgaaagttgtgaatttaggaaaatcacttgtaatgaagtgtgaatcttgttatcaaatttatttctctgatgtttccttccttatccttgtagccaataaaacattgacattctcacgttttatagatgaggtaaaaagtcttgtgtgctgtgagttataatgcttttgcctttttaatattattagttcttaagtgttacagccccttcagaatataacttcaggacaattcaaactatgcttaatgtatgattttcgagcttctgtatgctaagaaaataggtgtgaaaaactggtgttctgaaatagcctaacatttattgtaattctgaattttctgcccttttattcattgcatattaaagtattagagtataaaaactaatttgctaaactttggttgtatataacacagatcttccatcatggagagatatacatgtacaaaattatcaatttacaagataattgagtagcaagcagtacagttgtaaccgtcaccattttgatgctaagatagtgatcatctcatgtaaatgctacagtcacagcaagctagacttaagctagagggaaaatagagctccttataaggtgttctatgttttaaatcaaatatttatttagagtttgagtgtgtgattttgagtaggtttctg

SEQ ID NO: 6504 - DNA, 1797 bp, Homo sapiens
aggggagaggtagaagagaagaaacataaagaagacaaagatgataggcggcacagagatgacaaaagagattccaagaaagagaaaaaacacagtagaagcagaagcagagaaaggaaacacagaagtaggagtcgaagtagaaatgcagggaaacgaagtagaagtagaagcaaagagaaatcaagtaaacataaaaatgaaagtaaagaaaaatcaaataaacgaagtcgaagtggcagtcaaggaagaactgacagtgttgaaaaatcaaaaaaacgggaacatagtcccagcaaagaaaaatctagaaagcgtagtagaagcaaagaacgttcccacaaacgagatcacagtgatagtaaggaccagtcagacaaacatgatcgtcgaaggagccaaagtatagaacaagagagccaagaaaaacagcataaaaacaaagatgagactgtgtgaaaatattttgtaaaagtggatcacattgaatcctataaatgattaaatctgcttttttcccccacgttgagattgtgcagtagttcgcactcctcaagctctccctgtaggctgcattttcatttcctctttcgtgtagggaagtgcctttgtaattccatttattgcattggtgttttcacccaattgttaagtttgatacatgatgcacagattgttcttgcatttttattgtttgtttttgaaatgtacagtctgtacatatgtcctgaaaatgttttaattcctttggcatggttgccatgttggttaaatttgtataaggcaataaactgccactaatctatttttgttttgtaggtgtgggattatggtttgtgtactgaagttagcatggctgtgcttttcgtaatagaatgctaaagactttgagaatggatcttggatgtctattataggagaagtatgtgctgccaatgtacaagaaggcagcattgtaggattaacattcttgtctactgtatattatcttggaaggctcttgttaatatgttacacttaatattctccacagttacctttagagagaatttatgagaagttagtttctgatgcagaggtttttaggctgtgatttcatcaaaagtccttttagcattctacctcaaagggacacttagtatgcctaaaatttattcacttagttttccttttttatttgaaaaaatacatgacatgtaatctttttttcttgaattctttctcagattttaaagtactatattaaagaaaaaaattaatgtctaaagcctagcattcttgcagaaccctatactaacatgtaatggggagagggtggggcagatgagtagagaaacagattcaagcctcaagcttccaaagcatttttataaatggaaaatccttaaattatgaaacagcttgatatagtgtcctttttttaaaattcagaactttttttattgataatggagattgctgtttgagtttttaaacttaatctagaacagaggagtattaaaagtaatgctgtgctgcattatttaagactatcagcaaattatttgatagattgttcttacaacttgtattctgattacagaaccatcatgagtgtggaataaatactggattaaatcctttatcctgggtcttggcttttcccccatttgttaaatttttttagcatatttatattgtggaaattgatgaaacgtcagtagagtcacactttgtgtacagggatgtcttagtgcccagatgacaagtgaattttggagaaatgcatagactgggattgggcatgtggtaatcaat

SEQ ID NO: 6505 - DNA, 1162 bp, Homo sapiens
gctacaaaaatgtaatttaaatccttagatataagaggaaataacagattaataaggaaacaagagcaagatctattttttaaaaaggaaaagaaattagataataagaaagacctcttagaaaattaaaatatgatggtagaaaaaagtaaatccgaagcagcctgaggtaatctgtgaaaatggttcgctattcacttgacccggagaaccccacggaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcagtggggctggacacaaggtcggtggcccaaaaagagtgctgaatttttgctgcacatgcttaaaaacacagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaggatatcccagaagaaactgaagaaacaaaaacttatggcacgggagtaaattcagcattaaaataaatgtaattaaaaggaaaaaaaaaagtaaatccatagaaaatagaggtgaggaaattgctaaataatatttttttaatttcctagaacttaagtttccaacttaaaagggcccatgaaatacccagaagaataaggaaaaatagaatcactctaaggtctatcttctatatcatcatgaagtttcagactatcagggaagagaagaacctgaaaaattccagagtagaaggagcaataggcctcacccaaagaatgaggaatcaaccagcctcgccaacatggtaaacatggtgaaactccatctctactaaaaatacaaaaattagttgggtgtggtggtatgtacctgtagtcccagctagtagggtagcttaggcacaagaatcacttgaacccaggaggccgggg

SEQ ID NO: 6506 - DNA, 1406 bp, Homo sapiens
tcattagggaaggaactaggctgtgttcagacttcttttgaagagagagaattttcaagacttcttttcactctttgatttggatctggcaaattggggaggggatgctgggtgggaaacagttatgaaatgccaagaaattctttggctttagaaatttatctttcatgtacccatccgggaacataaaagagaggcatagtgctcattgcaaaaagagaacagatgaagtagctgtgttatgtgctggtatcttgagagttttgccaagaaaatctgggcctacataaaatttgagaattatctgtgtgatgagaccagaaagcagtggcttagacaagaaaaaatctttctgttcaccagtatcctcaaatggagacttcacttgatcagatggtatatgaaaaatgaatcaactattgctatttcgtaaaacctttttatattttctaaatttacttagtgctaaatactgttactcagttttaaatgccacgactaggggaaaaagaaactattgaagaaataattgtttagtatatttgcagttggggtagaagaaagaaatctagtatattgattcatatactagtaaattcatctagtataagaacttgtgatgttagattgaagttttgtcatcttataaaagacaacaaacttattttctgtttaagtctgagtgttatggcaatttttagttgattacttatttttcttagccaaattttaattttcttcatattgcattgctctttagttgtctctggaaattctatttactttaaggacatgagaaattcaaatgagagaagttgctgatattcatcagtgtgtttggacagttcatagggtccacaaatcaaatgaggttgtttcctgaagtagaagaaaacagaactttgcaattgatactgaagtactttgccatggagttagtaactcctgagcagaccattttagatggctcagcatttggcaggaagacttctccattccctgcttatatctatggaaggatcagctgttggatgtctagaacttctctatttaaaaaaaaagagtaggtctaaaattaaattattataagcaagcatagacatgggtcttccagttgaattgtccattaccgtaaaacttaatggtggacaagttagctgtggttgattcctgtgtggcagtaaattgtcttctgtctgcttactccaaataataaaagctgctaggaagtttagattttgaaataggcagtttaatgctttgagggtttctagaaatacagaaagtcatcaagtaaacactgcatgtctaatcatctcagagttgtggctgttatctcttcaggaattggtccacagggtaaatttcaacaattcatacgttttccattgtcatttctgaggacc

SEQ ID NO: 6507 - DNA, 1198 bp, Homo sapiens
agccgtgttcgcgctactgcactccagcctgggcgacacagcaagaacgggtctccaaaaaaaaaaaaccacgattctgtaaggtggaaattagtactgccttttcctgggacctatgttcccctccgagccacgcgagggcagcaacgcgcgcactctgaggaacacccccttcctcaggactcgtccgcctgtgctcggtggtttctcccagaatcctccaaggcgcgggagggggcggagagcttaaaagtcgcggggggagcggacttccgctgttttagggagggagagcggcctgggtcctgggtgttgtgtgcggagctgtggcgtcgcgtgtgaggcgcgtgcagggtgagtgtgagtggacgcgtgagtgtgtgagtgtgcgcgcttggagcgtgttaggcgagtgcgtgcgcccacccctgcgcccctcctcccgcttacactttgatcttatttgatcggatcgtgaccccagccccgccgggccgacccgaaatgaaaagctctcctcctgcgaagccccctcggggcgctgtgcagcgaggccccttaggcggcggccacgctgtggtccccgaggtcccggagctggccctgcggggcccggcgctcagaagtgatgaattgatcagatagacgaggccgggcttgtccccggccactgattatcgaggcgattctgatctgggcacggccaccgggctgcgggctgccggtggcgtaggggcgagcacgtgaacggcggcggcgggcggggatgctgagcgcggtggccaagggtaaatgagccgctgcccctccccctggagctggaaggtcgcggaggcctttttggccgctgatatactttcctcccactttcccatttctccttgtttttcttttttcttttgttcctttttttttttttttgagacagggtcttgctctgtcgcccagactggagtgcagaaccgcaatatcggctcactgcaacttcgacctccttggctcaagcgatcctcacatctctgtctcccgaataggtggaactacaggcgcgcgtcaccacgctcggctaatttttgtatcttttggtagagacggggtttcaccatgttttgccaggctggtctcgaactccagcctcaagtgatccgcccgcctcggcttcccaaagtgctgggattacaggcatgagccaccgcgc

SEQ ID NO: 6508 - DNA, 1558 bp, Homo sapiens
gcacaaagctgctctgagcccagcctttgttccccgacaccccagccgtagcagggcccatctgtgcctctttcattcattccctggtgaacattaaactcactgcaggctggggtgtgcaggaggctgcagagcacagaccacgagacgactctggaggtcagggccctgagtccgccctcatgtggccctgggaccaatgagagcctggaaaaaaaaaatctacattctcctctgcaccccaggcaatgtcgattgtctgggaagggttgtccttgtgcaggatttgaggggtaatttaaaagggtaaaaaaaagaaataaacaaaaaaaacccccgagagaatgctatagacctcttggaaaatcatcattcccagtttcatggctagaattacttctcaaactttgtaagttactacttctccattgagtagcaagttgccttctctagttatgagacacagtagtgtttgagttaagcgatgacttcacaaagttaagttgttcgtggaataaagtttggaaagatggaggttgtagaattaagaaatcatatatcaagcttggcgcggtggctcacgtctataatcccagcactttgggaagcctaggcaggcggatcactcgagcccaggagttcgagaccagcctaggtaaaatggcaaaaccctgtctctacaaaaaatacaaaaattagccgagcatagtgttgcacacctgtctgtagtcccagctgaggctgaggtgggaggatcactggagcctggaaggttgaggctgcagtgagccaagattgtgccattgcactccagcctggatgacggcgtaagaccctgtctccaaaaaaaaaaaataatttaaaaataataaaatcatatgtcttgtatgtctctttcttgctctgtttccttaggatgtggacaacaaagtagagaggatttggggtgattgtacagtcaggaagaagtactctcatgtggacctggtggtgatggtagatggctttgaaggcgaaaagggggccgtggtggctgggagtcgagggtacttcttgaaggtaagagctgggaaccagtgaggataggattatgaaaaagaaacaaaatatatatatatatatttttttttttttttgtagagaaacataatctgtttaaagaggcccacagatctaccagttgtacttgcctttctgcaaatgtattggcaattagatgcaattctctttctaaagcaagagagggcttatcaggattccgtagaacaaaagccactaagtggtcctccataatgaatgtctgttttgctgactgaatcagaacagtctctgcctttaagtagctcagtataattggacagtcagacaagtaacaaagaatcaaaatccactgtcataagctctgtggtttgtgtaggcccaaagtgctttgagaacatcaggataattctcttaacggtgtgcctggatgatttgctgggcttcagtgttcagaacgaatctcaaggttcagaatgtcagttgctgggatctgtggtcttttcttggcctcctgctt

SEQ ID NO: 6509 - DNA, 1099 bp, Homo sapiens
tgaggcaggtggatcacctgaggtcaggagttcgagatcagcttggccaacatggtgaaaccttgtctctactaacaatacaaaaattagctgagcgtggtggcgcgtgcctgtaatcccagctactcaggaggctgaggtgggagagtcgcttgaacctgggaggtggaggttgcagtgagccgagattgtgccactgcactccagtctgggcagcagagtgaggctctgtctcaaaagcaaaaaaaagataagtggaaaatattctttcctcttaatttacatttctttgatctctgtcagggaccccattttggactgacccattcctttatctttttagtattctctccccactcccaggcagggattaaaggaaatttttcctgcactattattgatctctttcttgtggtttcttattctagccaaggtcctccccacttcctcttaactggtatagctccttccttccacaggtgattggcaaaggcagtgaaaagtctgatgacaactcctatgatgagaagtacctgattgccacctcagagcagcccattgctgccctgcaccgggatgagtggctccggccggaggacctgcccatcaagtatgctggcctgtctacctgcttccgtcaggaggtgggctcccatggccgtgacacccgtggcatcttccgagtccatcagtttgagaaggtgagtagatgggtcagggtaaggagtggaactttctctgtctccagaatggttagatgagagataggatctgtgttgctgaggcccatcctggctccagcttttcctctcattgcttacctctgtgtttctggggaagtgcatggtggagtggcgtggattatggaccctgaaaccaggctgcggctttaccactcaccagctgtgtaacattgggcataatgcataagcccccagtgctccatttctgcctttgtatgaggaggataacagtaacagtgcctgcctcaccaggcctattgtggcctattgtgaggattatcccagtcactatatgtaaagcactcagaacaggggctggcatgcatacgggaagctcgcaccataagcatttgctc

SEQ ID NO: 6510 - DNA, 1192 bp, Homo sapiens
gcaagggccaggatcctcctttacaaatatattcctgcttgaaatcattgaggtaggactagcttagagaccagaactgttttaaaagcctcttagcacttctgttccctacaaaggactctgtggaaagcgagaggctgtatttaatccagaagagcccctagcttctatgcctagcatgggttggggacttattaacagcagtttctctcgttacagccatccccacatggggagaccaactgcataccaacttgctgctgcacctccaaaggattgggatagccagcagggcagaggagaggagaaaatgttgtagcccctttgtggagctcccactgttgccctaatagccagttcctttctcaggggaggctgatgttcaggctgtttatttacctgctgcctttcatctgcaatctacaaaccctttactttaataacagcttctgttagtttagtgcctctctcctaggaggttaaaatactccctatagatgatctcttttatctttgtgatggtcccagaaggtagggtggggacatgattatatgattatgcttattccatcctttggaagacagaaatacaaggacggtaagggagatgagacaacgtggcctgatggaggtcggaagtcctgactcctcggcagtgctttatgtttctttgggaggttgagagctggaatgtgaactgggctgtcacttaggagcctttatctcacctcagcttccttagtccctgagcagcgacttgggcctgctggagcatagtaccaaggaaaggggccatgtgctccattttccactgggggcttgagattgatcctattaatcttgctgctggaaaccctgtcaaaactgaggtaggtgcgtgaaggggtgacagtggctctcttgtcttgcctggctatgccagctgggggcccacaggcagacccgcctgggccgtagcccattgccccagctctgggataacaaagccgggacaaggggacaaagagcaagctgctcccatttgtaattcagaaggaccagaaactcacatttcctgtggcctcaactatttggtttgaagaaaggcagcgtacacagtgtgcaggaggctagttttgccccaccccctataccattccagaagcccactgggaactctcacagggccctgaacgcccctgctctgccttag

SEQ ID NO: 6511 - DNA, 1493 bp, Homo sapiens
cagagtctgagtcttagttttcaaatacctcatggtcagggggagagtactaatcccacactcgctcccttcatccagtatttcttttcgaggtcagttaaacttgctgctaactcatttcttttgttaacccccatgaagttcctgtttcccagcgactaaatcttcctgtcatgggtgccactcgcagcaatctgcagccccccaggaaagtggcagtcccaggacctaccaggtcagtctggtcctcccttgcccatcctgtctccctaccccgccatcatctgggattccaagctgttatgcacatcagccctgaattttgtatggaaagatggagagaggaggggagcctggggcaggggaagggggatcccatttcttcccaccctgaggagcttgaattctgctgggtgacaaatgggcttgaggaagaagggcattttaaagcagttattccttctatttctttaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtatttttatattctctgtatatctggaagtcgatcctgctcctatttctttctctttttttagacagaatcttgctctgtcacccaggctggagtttaatggcgcgatctgggctcactgcaacttccaccttctgggttcaagcaattctcctttctcagcctcccgagtagctgagattacaggcgcctgccacccacgtccggctaattttttgtatttctagtagagacggggtttcaccatgttggccaggctggtctcaaactcctaacctcaggtgatccacccgcctcagcctcccaaagtgctgggattacaggtgtgagccaccgcacccagcccctgctccaatttctctttttttttttttttttttttttgagacggagttttgttcttggtgcccaggctggagcacaatggtgcgatctcag

SEQ ID NO: 6512 - DNA, 1217 bp, Homo sapiens
ttttcctctaacagtacctctttgtctcgaatcccttactgctgaattattggcttgggttggtaacttagcaaggtttggcgcacttggggctgctgggcggctggctgactcgggcctctatgacactattggtagcggggagagaagggagaagctggagttagatttcagggtgttaagaagaaggataagtggatttgctgcatctccatcctggcatcatttctgatgtccgtaaatgctaaaggcctattaggccccatagaaccaggtatctcatcgcccagaggccacatctcacagccagcatgggcatcggggcctagggtcatgtccctggctctgttgtggggcttttatgcagtctcccttgcataatctcctgttcccttttgcatgggcatgatgcctggtttgtttcctgtctcagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggtgagttgagagagttgagttggaggtgtgccccagacatggtgtgtgccatgatgcagggagtggtttccttattggtaaaacagggatagcatttctacatctagaattgttggaattaaatgagaaccatgaaaaaagagaaccaaaactcttaccacagtgtctgagtatatgtctatgataaactcaataaatggtattggcaatagtgatggtgatggtgatgtggtgatgttagcagctaacttctacccttccttactgggatgtagacaactctccacctctatttcttaattccttaagccacagaacagatattttttccactctagtctt

SEQ ID NO: 6513 - DNA, 1108 bp, Homo sapiens
cgtttgcagaaactgcccctcccctcattgagggtcactgctcaagagtgcaggagtggactctccactgatgggtctccctccccatcctggtttccaccccgggctggctagctctgttggtttgaagactgacagccagcctggctcattctcattattggctagttagctttctttatcaacctgctcactcacaaatgtgtgccctcagccagagagtaagaaagcccaaatctgttacagcttctaaaaaaatagatttctaatttgtcctactcatgttaggagcattatctttgaaggtaaaacatagtgtatcattgtgtaaactcccaggcttgatgtagcagaagagatcatttctggaggcttcagcaatggaatttagcattataagagagattggacaaaccagtccaaagtggtccgagttcttaaatccaggtagggaactcactcttctttcttctctggacctaattgggcattgggctttagtgagaccacagaccaggcccgtctctcctgtaggcttttaattcaatggcaactctatttcaaagaataaaagcctttggagagttgcggcagttctgggggcgggctcaggagagtccatagatcagccgtaactggaacgtagaatctacgtctgcctctgaatggacttcccacctcctctctcttgctctgatgcttgcctctgggcctctccatgcccaaggtggtctttcatccttgacaggctggtaatgtgctggccacctccagctcctgcatcgagtctgtaaaccagagctggttctcatggccttcgtcacgataccaggatacggaggggagcccagggccatccatacccaccccagggtaacggggctggcctggcattagtcattatttagtttccaggccaaccatccagatagagattccctctttcctttgagcagtgctctcaagagctccgtgcctgtccacaatgacctagagtgcatcctgctcattgtcagtgtagcccctcgcccctatattcatccaggatacttggaagtgctaaaataggaagggattcggctttcaactttgctaccatcttccctga

SEQ ID NO: 6514 - DNA, 1094 bp, Homo sapiens
agctgtgctttgtgtgtgtgccagtagacttacgcaaggacagggtacaaacttagctggaagtctgcccaggctgaatgatctcttccctagagttgattgtcgggtacacagtgtgaacccccgaagacggaacctcacagtcttccatgttcccttcttaactgtcgtgtggctcgttgctaaatcatgacaatggctgcctatctgctgcttcttaggttgctgttgtacatggaaccaggactagagattttttcagatttatagacttaaaaaattagaattttattaccaggctttccttctcaccccttttttctgactttgccaagtaatttgttgacacgaaaattttggaggaaccaattgaaaacacacttccagtctagatgatgctttgtgtgatacattaagttcttattttggattaaaagaagttttccatttgatacctctctaaattaaataaattatagaatgtagttgggtggattttggggtggccatatagtaatggaaagctgcaataattagttttaatacagcttgaatatttgctatatagaaatatagtatggaaagtttttggtcttaatgtagctactgtgcgggtcacagtttctcccaatgattatgactgggacattctttggtagataccatttgctactagtttattttgtggctagaaagtcagttttgtgtgtttttttttttttttatttgaagtgccaaattaactttagtcagaatgtgagcagatggctaagttctctcctccccagaatggattaacagctgcgtggaaagtgggggagagagtggatggagacttttagagatgttaaaactgcagtagaatgaaatgagtcagggagcttcagttagaaaataaagttgaggcagtttttgtgaagataatatggttagggctggagtgcactagtctttttgcttattcattttgcatggttttaaaattaaaaataattccgaagatacaccagctcacaaatgaaaacgtcagcctctgccccaccctccctcctgcccaaagtgaatttggtactcagaaaagaactgtttatacc

SEQ ID NO: 6515 - DNA, 1192 bp, Homo sapiens
gccaatgaacacatggtgaaattgaacctgtgctcttggctaattagtatcttgtcctaaacaaagagctccctggtcctgagtggagaatatctggttgcttacctctgacagctcctactgactgagggcgtaggtgtgcaagacacacacagcagcctcttagtttggaaggaacttgagagattttctatccagcttcccacttcaaaacaaatagggtttttcctaatcctcagatggatgttgagatggaaggaatactcttttggcatgaggaaatgcgattgctagtaggctctagactagtgtaactttttgtttgcaattccaaaatgaaggaataggttgagtcagacattcccactttccctctccttgttcttcctatagcctggcagctgcctcccgtgggtgggttctgtgctgtgtactttcctgaacagtgtgtctctcctttaggtgaagagaaggactataccatatggctggcacactccacagaccctgaagattatgaagatggctgcattttgggctacaaagaacagtttctgcggctacgcaagtcatccgtgtgtcagaatggtcgagactatgttgtgaccaagcagccctccatctgcctctgttccctggaggactttctctggtatcagcattcctcagatttctctgtctccctttccctgttggaggaggtgaaagacagttttcttatagggctaacaaatattgaaatccagccgggtgcggtggctcacacctgtaatcccagcactttgggatgccaaggcaggcagatcacttgaggccgggagttcgagaccagcctggtcaacatggtgaaaccctatctctacaaaaaacaaacaaacaaaaaaaaattagcagggcatggtggcgcacgcctataatcccaagctgctcaggtggctgagacacaagaatcacttgaacctgggaggcagaggttgcagtgagctgagatcatgccattgcactccagcctgggggacagagcaagactcttgtcccaaaaaaaactgaaaccctttcccccaagagtggagaactgctgcttcttatcaaggaagctgaggcacagagaaaggaaaccagaattgttaataatgaaacagatagcacgtattagacagttaattattgggcagaaccagcaacaaacccg

SEQ ID NO: 6516 - DNA, 9023 bp, Homo sapiens
catgtggaagaaattaggtacaaaacagggtaaatttgaattttctaaaccattgggctacctcttagatcatttgggcattattgttcattggatattaccaataatattatcttctaaattaaaagaggaattcaaatgtacacaagactagtctatccctttccccttcttcaaagattactttggttggtgactttattgtggctcacaataaggtttgggggttttttttcctgaaaaaatgtattctacttatttgccatttacttgagttctggagatacttgtaatgcaccatactaagtaagatgtttgacatacttgctaaatacttttttcagtgagataaagggaaaatctttgaaggaaggacggattgtgcataattaataggcatcttcttgccttctttgtttcaagtctatgactttgaaagaagccatcaagtcttcactcatcatcctcaaacaagtaatggaggagaagctgaatgcaacaaacattgaggtactttctgttttattgttggatttttttcggttttttttttaagagatgaggtctggctatattgcctagactggtcttgaactcatgagttcaagtagtcctcccaccccagcctctcgagtagctgggactacaggtgcacacaccatgcctggttaatgttttttaatttttttagagatggggtcttgctgtgttgcccagactggtcttaaactcctggcctcaggcaattctcctgcctcagcctactgagtacctgggactataggtgagagccactgcacctggctgttttattgttttttattcagatatcatagctggcattgctgaagactacatagatcatggaaatgacatttttgtatgtttagttcctaagaaattattaacagcctttgaataataagcagcttcagtaaagtggtgctggcagaagccagaattcagtgagttaaagaatgaggcctggcgaggtggctcacgcctgtaatcccagcactttgggaggccaaggcaggcagatcacttgaagccaggagttcgagaccagtctggccagcatggcaaaaccccgactctaccaaaaatacaaatactagccaggtgtggcggcacgcacctgtagttccagctactcgggaggctgaggcatcagaattgattgaacccaggatttggaagttgcagtgagctgagattgtgatactgcgctccaacctgggcgatagagcgagactctgtctcaaaaataaaataaaaagaatgaaagggagatgatgagtggagaaaacaatagtatgctgctttctcaagaagtttgattagtgtcagcagaagatagcattaaagaaaaggattgtgtcttttttaggatgtggaaaagtcttgaaaatataaacggagatgaaactagtgtatagaaaaatgttgaaagagttgggcgcagtggcctgtaatcccagcactttgggaggctgagacaggtggatcgcttgagggcaggagttcaagaccagcctgcccaacatggtgaaaccccatctctactaaaaatacaaaaattagccaggcgtggtggtggacgcctgtaatcccagctacttgggaagctgaggcatgagaatcacttgaacccgggaggtggaggttacagtgagccgagattgcaccactgcactccagcctgggcgacagaacgagactccgtcccgaaaaaaaaaaaagctgaaagaaataaaaggagaggttaggatagtgatggaaaagttatagaagaggtaaggcatggtacacatgaaggagttggttttgaaaagtaaaattcattcagcatcatattgagtacccattatatagcaggtattatgctagatgcccagggttacagacacagaaaatccaattcctattcaagtagtatactgtgtagtgcagggaacatatagataataagaacctggggtgatacttctataatagcagtaaaaacagattcctgtgagtatgtataacttagactaaagcattagggaagcttcttggaagaggtgatgtctggaaaagggagcagaaaggtattccaggaagacgggacaacatgtgcaaagggttcaagatgtaaaaataatattgtgggtaaaggaaactttgaggttttgtctgactgctgaggtgtgggatgtatataagatggtgggggacggtaagggatgagactggagaggtatggaccagcttgggaatgtccttttttagtatgctaagagtagacaggagcaaaggaagtaatgacgagtaaagataggtgggtttggcggtaaacctggagagatgtcccacatttccccagatttttcctagtgattgtaaagtcatctgccgagggtaggtgaatgcaacagtaaaattgagaatgggaaatatttggaaaagttgttatgagaagacagggaagagtaaaaggattgctgggccatattaaaatcgtagttgaggccagtaatcccagcactttgggaggccaaggcaggaagatcacgtgaggccagaagttcgagactagcctggccaacatagtgaaaccccgtctctactaaaaaaatacaaaaaattagctgggtgtggtggtgcgtgcctgtaatctcagctattcgggaggctgaggcatgagaattgcttgaacctgggcagtagaggttgcagtgagctgagattgcactccagctgcactccatcctgggcaacagcacgaaactctgtctcaaaaaataaataaataaaatttaaaggccaaccaaggctgtaattatatatcagtaattaaaccaatcagtacttaccaggatatttgttgaccacactcatgagaaaatggatggttggattaatccatggtaggggattgactagttaagaacagaagattagagaggactggagagtattgttggtgaatgtctcacccatagaaccagctttcataggctgctgtgaaaggtcagtctaagaaggactgacatttgggagccactgcgctagagcccatctgctttaagttcttagtccattagttgttccttggagctccagcctccctacatgaactgcttcccctaagaaaaggaaaatatccggccaggcgtggtggctcatgcctgtaatctcagcactttgggaggccgaggctggcggatcacgaggtcaggagattgagaccatcctggctaacagggtgaaaccccttctctactaaaaatacaaaaaaaattagccgggtatggtggcgggcgcctatagtcccagctactccagaggctgaggcaggagaagtgtgaacccgtgaggcggagcttgcagtgagccgagatcatgccgcgccactgcactccagcctgggcgacagagcgagactgtctcaaaatatatatatatatccaagttacatcttacatctttctttttaagaaaatctttatatgtacctccttctgtcgagtgtccttactttcaatgaacttttttgagatataatttatatacagtaaaatgtacctattttaagtttacaattcagcggatgttgacaaatgtacaacccccagtatctgtcaccccagtcattatattgatcctcccaaaaagttctctcatgtccctttgtagtctcttcccccacattgatctactttttgtcactatagatttgttttgtgttctagaatttcatataaatgtttttgtttgtttttttaagagatgaggtctggctgtattgcctagactggtcttgaactcatgagctcaagtagtcctcccaccccagcctctcgagtagctgggactacaggtgcacacaccatgcctggctaatgttttttaatttttttagagatggggtcttgctgtgttgcccagactggtcttaaactcctggcctcaggcagttctcctgcctcagcctcctgagtaattgggactataggtgattatagggactatacttctttcacttggcatgattttgagattcacctgtgttgcatcaattctgttacatttcattgctgagtgctatctcatccatcctattttttcacctttattgccaagtctcctccaaacagaacctgtattatctccactgcttcacctctcatttactcctcaatcactactatttgtttcagcttttattatttccatgagactgctccttgctaagataactcttatttgtcagatttcatggtcactctttggaactatcatttgacttttttgaaggattcacctcagatttgacagttctaaaattaaaatcattatctttcctaaaaaccatttcatcttcccatatttctaatcttggttgatgacacccccagggtacttgtcattcacacgagaaacctggaagactttgactttccttcccttttactcagtcatttctttgctcccttataaataactcccaaatccatgtcccttctccatccctacttccagtgccgccttttgttcaggttcccatttttcccctaccttgtatattttcagaggcttcctaattaatcttgccctcctccatttcagtccattttttcctcattgtgctactatagtggattttctaagctatatctaatcttaatggttctccacttaaaaaatattttctggctggacatgtggctcacacctgtaatcccagcactttggtaagccaagatgggtggatcacttgaggccaggagttcaagaccagccaggccaatatggtgaaacccctgtctctaataaaaatacaagaaattagctaagcacggtgacatgtgcctgtaatcccaggtacttgggaggctgaggcatgagaattgcttgaacccaggaggcggaggttgcagtgagctggaatcacgccactgcactccagagcgagactctgtctcaaaaaaaaaaaaaaaaaaaaccttttctgacttctattgtctgtgagataaattccaaaattcttttcatggcataattcactacttcttaagtcatttgtttaatctattagagactttgctaagcattttacatgcaattacatctcttaatcttcacaacacttctatgagatagatattcctattccgaaaatcttattttacagaagaggaaactggctttgagacggtagggccaacaggtaaatggtagagtcaggatttgaatccaggtctggtcttaggtcttatacttttaaccactttaacgtactgtctcccatgagctctgaccccctactccctctccttttcacgtcatattccatgtgcaagctgtggtctagccatacagaattactttcagttttgcaaatatgtcgtgttcttttgtggttctgtgcatttgcacattgtttgcccttcctgtctttgactgtctgacccattcttgccatgctttaatacacaactcaaaagttgcttctccctgaagccttcctgggctcctccagatcactcttaaacatattcttagttctattacaacacttacctgacattgaacacatttggcatctagcacttagtaaataaagactttcttcatctttggatccttagtcacaagtacatgtaactaatacacaggtgcttagtaattaattattggtgaaataaattgaaagaaaatatctgttctacctgcctcatagagatgttttttgaaagtgagataataaatagaaaagtatctttcatattatgcaaatacatttattattatgcaaatgtaagggattatttttacttatctagtgatgagcaacttcctgaaggcagtccttggctcagacgctattattaatagtattgatttgcgttccagttcttctgtaggactgttccactcagagttttcccagtttctgctttttagcccctgtaatgttttgagaaggctagcctgagtcatgagtgaaattctttaggccctcactctttagattattgctcttatatttctctgtcctcatgtcattgatcatcaagtaaagatatatcttaagagaagcagtagtaacatttttatttatttatttatttatttatttgagacaggatctcactttgttgcctgggctaagtgcagtggtgcgatctcagctcactgcaacctccacatcccatgttcgagcaattcttgtgcctcagctgggcctacaggcgtgtgccaccatgcccgactaattattgtatttttagtagagacagggttttgccatgttcaccaggctggtctcgaactcctgacctcaagtgatctgcctgccccagcctcccaaagtgccataattgaaggaattacaggctaccacgcctggccaagagaagcagtaataatatttgtatgtttaaatatccttggaatggaactcatggtctacatggtaaactaattgtttacctatattttgcagatatatttgggacttttctgacatttcatgtaattagagatatatcttttaggagaatctagaggagactacaagctttgagaggagaactttttttttaagtctgttcccagatatcagatgtcttaagacttgcagcagtctttctgaattttacttatagatgaggcagaggatactaaacatcatataactggattatgctgattctctctagcaactttcaagttacattaaatattagtactgaaaattactttaaaatgccctactatatttaattttaaaaaattattattaattaatttattgttttagacagagcctctttctgtcacccaggctggagtgcagtgggatgatcacaactcactgcagccacaacctcccagggttaagcaattctcccacctcagcctcctgagtacgtgggacacaggcgtttgctacaccccctgctagtttttggggttttttttttttggtagacacggggtctccctgtgttgtccaggctggtttttgactctcgggctcaagtgatcctcccgcctcagtctcccaaagtgctggggttacaagcatgagctactgtttccagccatgtgtttaattttaaaaattgaagaaaaaagacactatgaggaaatgacatgtaaaacacaaatcttttgaggcaaatgtgaagtggcacctattgctcagtattgcccaaaactgtgggacatgatcaacagagagaatggaaaacctagtcatgatagttaaatttgaaattaaccatcttctgaccctagttttttattgttgttgttgcttttaaatgtaaatataatctggatttccagttattactgatatcttcagcagtcacaactggtttcctatgccagtgttaatgaaatcttttcttggccagttcttttaaaaaaacgtaacaggccaggtgcagtagctcacatctgtaatcctagcactttgggaagctgaggtgggcagatcacctgaggttgggagttcgagaccagcctgaccaacatggagaatcgccgtctctactaaaaatacaaaattagccgggtgtggtggcgcatgtctgtaatcccagctactcgagaggctgaggcaggagaatcgcttgaacccgggaggcggaggttgcggtgagcctagatcacgccattgcactccagcctgaacaacaagagcgaaactccatctcaaaacaaaaccaaaaacaaacaaaaaaaacttttttgttaagttttgccacataaacaattttagagaaaatacctgacaatagttaatgattatttgttgtaggcaataatggtctaagcactttatatatattaacatttaatcctcacaactactctatgaattagctattcttattgtcctcattgtacagatgaagaaatagaggcacagagtggccaagtaacctcaagtcacacacacaagctcaacttttaagtatttaaatatacttcaaatatatttctaaaggagtctttaacagaaaaaagtactgactccatgtactttgctgctgcttttgtgatccctgttgaagtgacttcaagaagtgacaatgatgccaggcatttggttaagtatgatgtggtgagttaaccttaaaatagaaaatttggtcaataagcatttttattttggagccagagagctattttagggacctgctgcctggaaaggatatccttgggacagcagatcccttagttcctaatgaatagctgcatcaccaacacagcttctcctgaccatggtagggccatcagcagggtaactcagcccagcttattaacccttctgttttctttccagctagccacagtgcagcctggccagaatttccacatgttcacaaaggaagaacttgaagaggttatcaaggacatttaaggaatcctgatcctcagaacttctctgggacaatttcagttctaataatgtccttaaattttatttccagctcctgttccttggaaaatctccattgtatgtgcattttttaaatgatgtctgtacataaaggcagttctgaaataaagaaaattttaaaatatttgttaatagactgttctcttctaatagtcttttttttttttttttttttaagagatgaggtctcactatattgcccaggctggtttcaaactcctgggttcaagtgatcttcccgcctctgcctcctgaagtgctaggattataggcgagagccactgtgcccagccattgtaatacagtcttttgtttgaaatgcaaatgttagtgggccaaaaggacagtgttattaatatccctattctatgaagatgtctgttctaaaactgttttagtgatgctctataacagaatcaactatatccattaatcccatggtgttgataaatgaactagtccagctcttcccagtggttaatagatgttaacagcactgtaaatccatttcggccctataatttctggagcaaacgtgtatttttgctgcttttcttat

SEQ ID NO: 6517 - DNA, 1175 bp, Homo sapiens
gttagtgttgtggatgtccttggtcttctgaagattcaggtcctcctctccgggtagcttagaagtaaggaggttggtttgattcaatagtatggggacagaatggggacagcaagggcagaagtgtcctctccacgtaactcattatgcccctcctgggggagattgcatctccaggacaagcatctaaaggaggcccctgctgtgcagaggggtattgttcctgtctctttcattgtcctccctcctctcaaactctccagtgtggtgtgaactcagaagaaacggttactggggctgcatggagaatttcacctgcggtgattttgatccagggactgcatctcctctttcctcatcacagccagtgctgagaggctccttctacctgccgcagggtaggagggccaggcaaagttcaccagcttgctctaagagcaagcaggcaatgccgtaaagcctgagcctgcctgaggtgctgcctcctcccaggtggtgcgggggctggtgggcgggcgggcaggcgtgctgacagccggcagtttgcgtgggctgtgccatctgatgtctattcccagccctgggaggaagggggagtcatttatattctgcaggaggaaggggccccagctgtcgcctttctgaccagcaggcctggagggcaggggcacagagcagagaggagggcactggtggtctcctgcttagcctggtctgactgcagtgtagggaataggtcaccaggaggagcccttcatcctggcaggccggattgtggagggacttccctccccctcttttccatttctccctccatcaccacctgccctcacatcctggggcagcagctggacagccattagacctcagtgccagggcactcttcctccagctgggatctcagtggctcccagctgcatgggctcctgcttgtgtgttccctcctccgccatcctctgttccccgcacctcccttattctgctcatgtctggggtattcacttggctcctcagcaaggaagcaaacgccttggaggagaagcacatggttgcccttttgtccttgctccctggctagggaaagctgctagtggtcagcctgttttgcctttttttaaaaaaaaaaaaaaagccagggcagggtgcttagattttaaaaatttgcgtgtcatttg

SEQ ID NO: 6518 - DNA, 2821 bp, Homo sapiens
ctccataagtaaatggtaatggtctgacttagttgagttcaggcagctgttacaatttgaactgagagtactgggtgtccgttttaggttccaatacatatgaagaggcagctgcctatattcaatgccagtttgaagatctgaacagaagaaaagataccaaggagatctatactcacttcacctgtgccacagacacgaagaatgtgcagtttgtttttgatgctgttacagatgtcatcattaaaaacaacttaaaggaatgtggactttattgagaagcatggatgttagtgaaaggtaaagtttcatacaaggtagttatagtgctacagtgatgtctcttggtttttaaactttttctaattaagaatattcttctcttctagttactacagtgtggagtgttgagaccagacaccttttgctgtctcatggggcagctacaagcatgaacgggaccagggaatggcagcagcatgcagaatcttagcactctttagcacaatattttgtattagggaacttttaattgacatgagatgctaaagtcagacattggaattggaagaactataaagtgtgattcgatcgtcaagacatcacttggatttcttaatcttaaatgcttatggaagatgtgaagttgaggtgctgcattctagaacttcaatatgtagcttactctttttttccccccttcttaaaccaccagtggttcatttttaaggttttttcatcaagagaagaataactttactaaattttatttctttatttgcaaaagaatctttattaaaacaaacaatcttaactatgcacatgatgtgaccagatcatcttgaaaatattcctctttagtaggaactctttgtttttaactcttggtatggtcagaatataatacttccataattacttataattctttccggttactggggctataaatacaactttttaaatgaaatttatgttattatcctgctcaaagtaccattatggtttccatatggtaattacattggaaagttctgcaataagattctagttctctcttttctttaagcttatggttgaaggttaaccttgtttgtgcagattaccaaattactgctgatgtagtatgataaagtcagcttcttggatacagacacacccagggcagctgccaatcagaaatgcaaattgctaaattccaaacagaaccagtgactttgctgctacatatttactaaattgaccactttgattcttgcttgtttgtctcagttatagggagttttgtacatggtgcctcttgttttccatcttcatggccttttctgttgagaaacatctaaagtgtattaacagtgcatgcttttactttgtaaatgtggtgccaaatccctgtttgccatcgtttttactgtaccgatgttaactgtagtaatccttagccagtatgttcttttgctgaaactgttgcattttgggacttttttccactttgtcatgtgtacatttttaatctgttatagttggcggcagtattaaaatggtgagtaaagagcccaggtttgctcctgtttgtaactagtcttttctggaaatactgtcttctgtttccttttgcctttgcagaatgtgctttagcctttgtctgagaatgggtttaggtagaagggtttcctgaaagtctagtcttttggtgtaatagtattgttgaaccttaggttttatgttatatctgcatatgagtgatatgtgatcatgattcattttgcagatttacattttgcttgtgtggaaagttacgttcacttcaacctacagacccttttgtataatgtacagcaaatgtcattaaatattgaatgctctattgggggaagacaaatgaagagaatgcattttgagcatttcaaatcagtagtttgggcagtgccttttggggtccaatctttttggattggattctatttcatcttttgatgtgacttttcactagtttacaaaaaaaaggttggtggtcaacaaaaaaagcaagtcatagcagttcagtgcctttgttggtagtttttaactttttttgtgattctttttggaaaatcatagcttacagatggtataactgtattatataatggaattttctttaggtgtgggaaaacttgatctgaaagaaaattatcagcttcaattggcgattgattcagtgcccacaatgtaaacagggttggtagttgttactcattttgaatataccttttccttattgtattctgtaatataggatcctggaaatgagacctggtggaatattattttcaactgtagtctttctatactgtggactaatgaaatggtgttgttgataatctaaaataaccaataatccaaaaaagttcattttactttgaatttgtattttcatttgaatatctatctgatatgttaaatttttagcccttctgttaaagaaaaatagcaggtccccatttttctgcctctgtaccatttacatttgctctctgtttgttaacatgaagatcactcttatttcaccatcccaaataacttatctaaatgcacattccttgaggacacagggagacaatttaagtcagtagtttttaatatgacttaagtaaaaatcacttggacccatctaagggattgacttttggctggtgggctggcaatcgattttttttttttttttttttttttgagacggagtctcgctctgtcgcccaggctggagtgcagtggcgcgatctcggcttattgcaagctctgcctcccgggttcatgctattctcctgctgggactacc

SEQ ID NO: 6519 - DNA, 1199 bp, Homo sapiens
tcagctcctgcgatatgtgtgagctggcccgcaacagcgtgctcatgagcggcttctcgcacaaggtactacagcgcctgcctggaccttggcatggcatcactcctcccctcctctgcatttggggtcctgacctgtccctgggatggcttggggtggggcatgacccctcagcactggctgcagccctgcccattacccccgctccttgcaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatgagcctggtccatgaagtgcccaccacatcgcagcacttttaccacgttttgtcctcagaccccgcccatgctgtgtggtctctgcatgtctccattcttctctgtctctgtcttgcatgtctcctaccatgtcactgtccctgggccacccagtgaaagcaaagcctgggaatctgctcattgttgtttgggctcaggtattgagcctgatggcccaggtattgagggcctcccctgctggtggccctgtcctgggatcctcagaagcctgactgtcctatgggcttctccagtgtccacaggggcttgggatggttgtggggggctggcccctctagcctttccggtccttcctgggcaaatctaagccttggccagggccgaagtttaggcccctgtcttgttcatgtagccgaggggcaggcgggggacctctacacctctgctgtgggcacggggctgctgagggtctgtggaactccagcagctctgcactgggtagagctgggcctagagctcagtcacaggcctgggcttcctggcctgagtgggtagacgcaggcggcagaggtgctggaccacatctccgccaagtcactgcccagcagccttctccgtcctgtccccagcccacgtgctccttgggtgtcagcttcctgtgcctctgtgggagagggcagctgccttgtgttatgtctggggccacagttgctgcaaagtcctggatctgccactcaaccccgggagtggtgttcccagtgtggctcccagagctt

SEQ ID NO: 6520 - DNA, 1205 bp, Homo sapiens
tgctcatatctggtccagagcctaccaggtgctcaggtgctcctggggctgacccagaggttgttgggaggtcagtggggacagatttagggacagtgtcacattccgctctgccatcccatcacctcagaaagactccagctacccagttggagtctaataaatgctgatgtatccagctgaagcctggacagtgacccagttccagctgtggggaagatgactgcttgcccgcggccagctggggccatgcacaaaactgggaggccgcatctgtgcagggagcttgtgtctgagggtgttgacagctgttttctgcctcaggagaaactgaaaccagaatacctgcaggcactccctgaaatgctgaagctctactcacagtttctggggaagcagccatggtttcttggggacaaggtaatgggggcgtgtgatggggacaccacagatttgtcatacttcctatattatggaggtttcagcccacatatccttggccttatccagatcacctttgtggatttcatcgcttatgatgtccttgagagaaaccaagtatttgagcccagctgcctggatgccttcccaaacctgaaggacttcatctcccgatttgaggtgatgcccccagcctcctttctctttatgtctcttattcctttccctcctttgtgatgctttcccagtcctggagctacacaaagaataactcacatttttggccatgtgcggtggctcacgcctgtaatctcagcgctttggaggctgagggaggcagatcacctgtggttaggagtttgatacctgcctgcccaacatggcaaaaccccatctttactaaaaaaaaatacaaaaattagctgggcgtggtggcgagcacctgtaatcccagctacttgggaggctgaggcaggagaatcacttgaacctgggaggtggaagttgcagtgagccaagatcgtgccactgcattccagcctgtatgacagagtgtgactccatctcaagaaaaaaaaaaaaaaaaaaaaaaggagccgggcatggtggctcacacttgtaatcccagcattttgggaggccgagttgggtggatcacctgaggtcgggagttcgagaccagcctgaccaacatggtgagacccctgtctctactaaaaatacaaaattagctgggcgtggtggcacatgcctataatcccagc

SEQ ID NO: 6521 - DNA, 1392 bp, Homo sapiens
tagaaagttccttctaatggggtgacagaagaaaacaatgaacattgactagtttccagggagatgagaagttcaagttgaaaggaaggagggagaggaataaaggccctctggctgcctctgagctgtctgttatgaaaatgcgcagatcccggtgcatgtcaatgacagcacttggaaaactttgaggagaagatgcaatttgagggtgccattacattccttggtcttgtacttgagtctgtatattctaggagcaggtaggtgatataaatcaactgacagaaatgacccatgacagaggccagaggccagaggagatgaaggagattctgaacacaaattttaccatctaggaattgaatttccaccgtgggatgcctggatcgtgtcctaagattggtgggaattgcctctgcttttgttgacatgacattggagtcgtgagaataactgctgatagtatgggaaagcacttggaggatgagtggtaccaaggacttaagaaaagaccagtgcgtgcaggaatgcaagagtcctggccccaaatccaaactctgccaggtgcagctcactggggagactcacaaactctgggtggtagcagatcatgaccagttgcatccagttgtccgtggtctggttctccaaaatgtccacaagaatcttcagaagaggagaagattcgtgtggacattttggagaaccaggttatagacgtctccagtcagctggccggagtctgctacagacctgactttggaagtccctccctggtctgggccaaaaggcagggaaatgggtgactgggagtggggtgtgggactcacaaaatctgggtcatagcacagtctgaccagctccatgtggttatccataacctggttctccaaaatgtccacacgaatcttctcctcttctgtctccccacctgccacccacaaaacacagactcaatctcagcatcacagcccagccaaggaggaggtcaccttccccccgcacattgcagccacccacactcacacaggttgtgcttgcgggcaatgtagcgcaggatggcattgctctgggtgatcttgtgagccccatcaatcaagtagggcagctggatagatgggaaaccggggaagctcagttgggccaccaggctccccagcatccccttcccatatgcaagggcagagaggagaccagggcctgctcatggcaggcctgagatagaaatactgtcacactaataaatgagctgggacacagaacatcatgcaagggctgtgtagacagccaagagtgagaggaattgggcagaagactcctgatcttaacacctctaaggtggggagaggagatgcagtcagagacacgtcgcactttcccccaaaaccgccc

SEQ ID NO: 6522 - DNA, 1099 bp, Homo sapiens
tctcttacctttccagggtcgtctactcaatttgagctgctccacagttcccacctttgttctgtccatcacagccacaacacaggtatgtggcaaaatgcctgcttacactgcactgcaatttgtggaactgggcgtagatcagttccagtgagggtgtactgtactatgttctcatcatcctattcttttttgatgtaataaattgtggaaacaggtattcttaagtatagaaaagagtcactaagtcagtattcgttgaattggctgttttagttgagaatataatgttccagcttagttttatttgatttgttctttcgttaggaactaaacaaaaacaacaaatcctcttaggatgtgtgctgccctttagtataggcaaagtcctaggtactgtgactgtggtagatcactgtagtacttacccaaatgctgtttaacctggttttatttttatgtgcctgtctaagaaatatttttgtgctttctggccttcttttcccaccttaggctttggcactgatagaactctataatgcacccgaggggcgatacaagcaggatgtgtacttgcttcctaagaaaatgggtgagtgaaaaacagtggaaatctatgcagacagctgcatagtttggtaaaatgactgccatgaaaggcattggatttagagtcagagttccaattcctgttcctgtgcttactggttgtttgacctcaggacaagttctaatctctatgatcctcagtttcttgattggtaaaatgaaaataatactacatacattgtagaattgtgtgagaatcacagctaatgagtaacagtgcttaacacaatggtttagggagatgttcttactctaagtagccttatgaagttcagtaaacttcccagtgcagctgagtacatacagccttggaacaaaatgagagaaacaaacacaggttttattgtccattttctgtgaggatatgcaaaccatccaatctcttgtaagcaacccatgctgtgttcatgtgacataatacatcatctctagtcctttgcctttctgcacggtgtacccatctcccatatctccttggctagcccaaatc

SEQ ID NO: 6523 - DNA, 2729 bp, Homo sapiens
gtcagggttgaaaaaacactgactcattcctgggaacaggcggtaacaccagaaatggcattgtcagagaccctgtggaagaataagggagactggtgccctggggaatgactgcagggatcccacccaggctggggaggggccctggagaaggtgctctgtttccgattgttttttggaattctcatatggaagacataagtgttaaccaatcactctctctctttacagatactaatggaccatactaccaaggaccagtccacctgaaccacacactctaaagaaatattttttaagataacttttattttcttcttactcctttcctcttgatttttttcctataatttcattcttgttttttcatctcattatccaagttctgcagaccacacaggaacttgcttcatggctctttagatgaaatagaagttcagggttcctcactctagtcactaaagaaggattttactctcccagcccagaaaggtgattctttctttaccatttctggggactttagtcttaattaggtaccttattaacaggaaatgctaaggtaccttctctgtggaacaatctgcaatgtctaaatcgccttaaaagagcccatttcttagctgctgaaatcagtgctctttcacttcttcagagaagcagggatggtacctacccggcaggtaggttagatgtgggtggtgcatgttaatttcccttagaagttccaagccctgtttcctgcgtaaaggtggtatgtccagttcagagatgtgtataatgagcatggcttgttaagatcaggaggcccacttggatttatagtatagcccttcctccactcccaccagacttgctcatttttcgagtttttaactagactacactctattgagtttaattttgtcctctaggatttatttctgttgtccaaaaaaaaaaaaaaagaaaagaaaaattaaggagaatttttggtgttaatgctgaggaattgcttgagtggttagttgttaccaatttctcttttgaacctttggagctaaggatgctgagtctagagaaatgctagtctcaagccctgttaagtccctctgtttctagcccgtagttcatagcatcagtgaactggagccacaacagcaaattctatcagctgtgtaccatacagcttgtgctgaaggcgaatttcttgagccattactcagtataaagcactgagttctatctttaggatttatctttaagagcaaatttctggtcagctgtgcttctgcaacctaaaatatttaaagggaggtaggtgtgggcaggaggaggaatgataaattgggccagggcaagaaaaatctagcttcatataatttgtctgggactatacaccctatataatgttagttttacagaagtaatatgacttttgattgctacataccacaaagagtttatgaactgagatcataaagggcaactgatgtgtgaagaaagtagtcagtacatcctggctcatgctctgaaagaatatccagagaggctctctcaaagatcagggagatgtattcccatgccatgcaccctgcttcccagcatttctgcatggtcaagtgagctttatgctcatgagctttaagtatataattatccaggattttaaatcctcaacttgttctagcttgtgatccctcaaagttgggtcatacgttagtgctagatactagaaattttcacttttccactgatcagagagacagacattaaaaacaaaaatagaagaaaggaaagctttcaccctgcagcttcttagcagggaacaattgtcttgccaaaacttttttcccttttctctcccattttcttttacccaatcccttcttactccttgccagtgtgaccatgctttcttctctgtagatgttaacagttaaggcctattttcctcgggcacttaaccaaccaatcagaacaccacatctgttaggggaggtaacctggccaacagtgtatccatcacgttagccctgctggagggaagggacccacattcacctgccctctgacctgccccttgatcccatatctattaccgtgtccataggaataataggtaagggctctgtctctgtcaagccatgtaacaaaggacactgttaaaaaaaaaaaaaagtctggcatcagagggagcatgtggagagcaacttgggaagaacaagttcattttgtattgaatgatttttaatgaatgcaatattaatccttgcagatgagcaataatcattaaaatcgattaaaatgataagaccttattggcagtccgtatgtgtcattctttgttaaacagcaaaacttcattagaacctgttttctagggtgtgacaagttataggtcagtagcatttaatagagatttgttgagggcctaatatatagaggctggatacaggattcttcaaagtaatacctgaagttttgtatgcctgctctgtgccaagcaccgggcctgggtactttcactcctaacttccttcaggaagcagacttgctgcttaagcctcagggttcctcatttgcatagtccttctaagacctaatttctgaagaatgcccccaaagttatgtaagcttcagcctcctcccacacctgtatccatttctgaagtggtctcagtgtcttttttttttttttttctctttatttttttgagacaaggtctcactgtcacccaggttggagt

SEQ ID NO: 6524 - DNA, 1196 bp, Homo sapiens
gtttgatcgctttggagtcatcacagaagtagatatcaagaggccttctcgcggccagactagtacttacggctttctcaaatttgagaacttagatatgtctcaccgggccaaattagcaatgtctggcaaaattataattcggaatcctatcaaaattggttatggtaaagctacacccaccacccgcctctgggtgggaggcctgggaccttgggttcctcttgctgccctggcacgagaatttgatcgatttggcaccatacgcaccatagactaccgaaaaggtgatagttgggcatatatccagtatgaaagcctggatgcagcgcatgctgcctggacccatatgcggggcttcccacttggtggcccagatcgacgccttagagtagactttgccgacaccgaacatcgttaccagcagcagtatctgcagcctctgcccttgactcattatgagctggtgacagatgcttttggacatcgggcaccagaccctttgaggggtgctcgggataggacaccacccttactatacagagatcgtgatagggacctttatcctgactctgattgggtgccacccccacccccagtccgagaacgcagcactcggactgcagctacttctgtgcctgcttacgagccactggatagcctagatcgcaggcgggatggttggtccttggaccgggacagaggtgatcgagatctgcccagcagcagagaccagcctaggaagcgaaggctgcctgaggagagtggaggacgtcatctggataggtctcctgagagtgaccgcccacgaaaacgtcactgcgctccttctcctgaccgcagtccagaattgagcagtagccgggatcgttacaacagcgacaatgatcgatcttcccgtcttctcttggaaaggccctctccaatcagagacagacgaggtagtttggagaagagccagggtgacaagcgagaccgtaaaaactctgcatcagctgaacgagataggaagcaccggacaactgctcccactgagggaaaaagccctctgaaaaaagaagaccgctctgatgggagtgcacctagcaccagcactgcttcctccaagctgaagtccccgtcccagaaacaggatggggggacagcccctgtggcatcagcctctcccaaactctgtttggcctggcagggcatgc

SEQ ID NO: 6525 - DNA, 2624 bp, Homo sapiens
aaatgtatgtattataaaaaactaattatgtttagttggtcattacctacagagtgccatagtccacatgaacctcatatttgtactgcccattcttttgtgcaggttcataatatccataaagtatctagttaaaccttaagaattcaaatgaaagcaaaagtctaaaaccggttctacttctcattagccaggatttaataatcccaacgttgaatgttctttgtaacaaccaatttttttctatctttcttctttaattattttaatgtagttgatttttctggaactcagttaaaatgaatggaaagaaaacttcaggatatcatttaatgactattaagtattattggtaaaaacgtgaagataagacttttagatcacagcttcaaattttatggaaaattaagcaagcaatacctagccaatagttctgcttaactttttggttaagtattttgttgggattcctataaataatttttcacacaaagttttaaatttctggtgtactttgactctcaactgagagtggatagagtttttcttttgaggattacatcttaaaatgtccatcgcctggctggttataagcatttgtcaccttttgaaggtaaaatatactctggcccttcttgactcagttacaggtcattttaggtccagtaataagagtcaggtgtttggttattgctttcagagtcagacattgtttaggtttatttaaaaactattagcaggttttcactgacaatgcttttttaaaaataaaaaatgtaaatccacttttttaaggcagattgttcattatgcatatacagcttgaactatagtttgggtccatataggaaccaatcaccaaaaactctggtaacagaattaggaaatcctcttgagaagagggccttaatgaccttttatgtgaaaaaaattttggagagaatttctggacatttttttttctgtctctctcacagggtttggttttcagataggagttaggtatgagaacaagaagagagaaaacttggcgctgaccctgttatagtggttatagtggtgtccctaaagggaggaaatgatttcaggtaaccacagtgaaatgttaagctgaatgaagagttttatatgtatggtttaaacagagttgaaaagtgagattcctgaagtgttctttggctgtttaacaattatttgtatgagtgttttattaaaataacggctgctgtctttggtaacatagatgagggtggatttttaaatggctttgtatcgacccctttctacaataatggagtagtctatgttgctccatataaattacagaatgaaaatagatggggcaaaagtttgactaaactttacctttttatagtttcactttttaagttatatttagaatatattgatagattataaattgattgtgaaacttttttctgaattttttcaacatgttttactcagttacatgagttaaaggatattttcagtcctgttatcttcaattgcagtctttaaaaaaacccaccctattgttctacttgttatatgtctattcatacagtaaattcatttcaaggtttatgccagtgggtattattggtgctttttgaagttgaggtgaaccatccaggaaggtcttgttaatgttatgttcatctataatggcataggggaaatatatatatttttaatattgtaaacatttgtactgaataacctttttttccccccctccgcaagcaaaactggttgaacagcggatgaagatatggaattcaaagctctaatggacctttttgaagagaagttgtggcttatgtggagtttacatgggcctctgatggaagaaagctaatctgtttagtatttgtgcattttactaaaatggcagcttaaagttgtgtatctgctattgtgatgccaatgccggtgttttaagtggaaaaaaaatgacctctttgatttgtgctgtgtacacaagatttctggaaaagtaaagaaaaaccctttttatggctcacacagcttaagagtagctgtctctcaaacgtgcgctcacagttgagctgcttttgttttattctaaataaattgtttcttttgaggaaaatgtttttctgcctggaagtgaattgacggcaaacctttgacccctttgtttgcagccgagggggtgcttgctgctgctcagatcttgtatgtcttgagcaagaagcagggagaccatcaatttcattttgactatcacggtgtgtcaattctgaaggatcactagtgttactgttgaccccctttgtttgcagtgaaggggatcatttgcttctcggttctcaacgtgatgaggaaatggtgctgtttgctggcacgcaagaagccggggcaggcaccctaagcctcaccacagtgcctgagtcgggggcttttgctggtttgaagagctggagttgctgaaatttaagttttgatttattttgttcacccatcacgtttggccttagtttcatttttaatttgaagaaaagtttgaaattgctttatcttgcacttaacatttgcaccaaattgccaaaagaaggagaaatgctccgtttgctttttaaatgttaatgatgatgtta

SEQ ID NO: 6526 - DNA, 1158 bp, Homo sapiens
aggggaggaggaaagactgtgatttgatgtcatctcaggccctccctccacccacagtcactcagaaggtagaattttttgccgcaggctcaaaagcaagcatgaagtaaactaagtggaaagtccttttggcgactatgctcagggcagggggatggggctccagagctctcatacacttgtcttcaaatttcctcagggaacttctcacaacatgcttattttacaggagaatataaaactcctggatgggtggtgagagaggcatttcctgggccacaaacagaaatcttcagtaagctcaacccattcgtgtggccttttgtatattgactaaagattctggttactaatttggggtttcagaccccattttaattgcatttttgagatctgattacctcaaccacctcctgcaaaagacgtatgctcgtagtaattttaatgagattttttttattatattttggaaatggttaaggctgagacccctagaaaattactgggataattcaactttctcttcccatttcctccctctaccctccacataaaacaaaacaaaacaaacaagtcaaatgggaaattgtctttcgtctcccacaccaatattccagattttaaaccagagtatattttagacgaaaggatgtgtttttagttttatctggaaaatctgcacatatttatgcatgttcctttttaagaagcaagaggcttctcagattcttaaaatcaaactctataatactttttgattaaagtgcttgcagaaggacagcttagtggtttgggagggtgccctgtaagtgtaagcatggaaggattatgcagttacatgatgctggtggcaaggatcaaataaacattcaacagaaggagaaaacccaaagagagaaggcaaataaatgcttttcagagagctgtttgtaattatgaatacactctagacaacttttttttttttgagacagagtctcactctgtcgcccaggctggagtgcagtggtgcaatttcggttcactgcaacctctgcctcccgtgttcaagtgattctcctgcctcagtctcccaagtacctggtactacaggcgcataccaccacgcccagctaattttttgtattttagtagaaacggggtttcaccgtgttgccc

SEQ ID NO: 6527 - DNA, 1205 bp, Homo sapiens
tgtgtgtttagtagagacagggtttcaccctgttagccaggctggtctcgaactcctgacctcaggtgatctgcccgccttggcctcccagagtgctgagattacaggcatgagccaccgtgcccgaccagaaagcatggtttttgaaggaccatattttattgtaaaaaaatgttttggttcagatagatgtgtgctgatgggagtaattcacatctatcagtgaccaccaccaagatatttataaaccttatcaaatacagtaggaagagcaaccagcacaattttggataaatgtatatgttgcagtgaacaaagaagatagtttaaaataaaagatgaccacagaataattagaaatggtactgtcacatatggagtgatttgctacgtccttcacttgaggatagttctagtagagtgagtgcagagctgatgacaagttgaaatgagatcaatctatttgtttaaaaatatacaaatattttgcatttaatttcatcggttaaaatgtctaaacattagagtaaacccatttccctatctacatccttactctgaagtccactaatcaaacctactcttccacagctgttctctggtccaccaagggctatgaggctcaccccttggatggtgctcagaaccacaaggaatactgaagaagccttgcctatgatttcaggtggcatcagacattgggctaattttcaaggtgtctctccttcccaacaggacagtcggagtctggttctttaataaatagctatatggatcttacttactggttcacaatcatattacagcagcaaaaacacccaagctctaactgctctgggcctccagccatgtttcctccagatagcatgttagaaaggacaggagattttaaaaatcagattggacttcagagggctccaaattttcttgccacatctagacctgaaagtaaagagctctgattattaagaggcagattctcgttgcatttggacagcgtgagtaatggtcacactgaacacattagaatcagttgtgaaattgattttgtttcaaaaaaggataagcaagctgtagtctcaattttgagttaattgaaatttctcaagaacttcatcagcagctcacatgatacagttttggaagagtaaacaaggtaagcagacaaccctgggaccccaaacacattttcttttttagttctc

SEQ ID NO: 6528 - DNA, 1988 bp, Homo sapiens
tgctacagggtaaaaggcagcacctggaagacctgaattgtacttccctccttgccgtgatttgctgcctgttactgcccctcatcactgtcttgttctatccagcatttcttcatctatgaaaatagaagactggattggatgactgatgacatccactgtggatagctacactgctatcctggcgatgaggccatacagttggtgaaatgtgtgtaacacacccaaaaaatgtgccccagatgtgttgggttctctttttttctccaggtctgcttttcttgtctctactctgccccgactttttttctttcttctaggtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagattggatttaagacaaaaagcaagtcccccatgagtgtccacttctttgccctgccctctcagcttgtgagacaacacaggagccttctatagtatgttgatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttccctaagcactgcctctctctcaccccccaaaacaagttgacgaaagggttttatgtagctgtctatgaggaattggccgtgtctgggtgggttatgggatgtgggcatccctgggttcttggaagcagctcttatgctactcatagagatgggattgactttatttttttatagtgcttaattcaccattatgagaaatgcttccagtcacaaaaatgcagcccagctcactctgaggaagaagcaggacttggtacggttttacacaactccttaccattaaactgaatcagaaatccattttctggctgaataaaaagtttggcttgcctgtgtaatgcccactcccttccccctggctccctagtgatgggacatatatgagagagaagtgtttttctatcatagacaccataggggaaagtttggggatgaaggagagcttaaaggtgtttcaattaagttagaaaactgacacaggctgttgagaattctttgccacttttcccaccccaaaacagcatggggcctgacatcttctgccctggtcccctttctcttgatgtggaaagtctgaatgcagtatttatagacttctaaggttttaaaatccagtatcaagaagaaaatcagaaatactggttggtgaaataaagagtttaggcattgttggcctgtcttttttgaagcatgtgtgttatgtgtagttagatatatttcacttatgtgagtcatcatggtgttggtcttgtagcccattatttttcctgtgcttccccagcttcccaaagtagctagttagaacttaaggtaaatatttattcttgggttggtggagtggatattgccagttaggagtcatggatcaattactgattatattgaaagtaaatataatcaattatgtacttttgagctttgcaggttcaatttaggtaaaaatcacattatgaaactgggaaagtctgaaggaatatgggcaaaatatttctcagtaaagcttccatgcttcacccttgacatgattacccttgagtaaaacatgggaatttgtagttgtgtgatcctctggcgttgatgtggagtaggaataaagtcttgcatcatttttataatgtgggaggaaatagaatgggtaggtacaatcacttaagttctgcctctcgaagataaaactttaattttgtggacacttagagaaagtaaggggtgggggagcttga

SEQ ID NO: 6529 - DNA, 1148 bp, Homo sapiens
agacaacttttggcggattctctatacttaaccagtcactgtgcaagacgttcaattattcaacatatttttaaagactctgcaagacatttattcaactagttcagcaaatacttactagtgtccaaatattggggaagtgttaacatcactggatagtgtgctgcttaaacagttgtggaaacttcatccttgtccccttgcagctcattttccatattctctcactaaaagcagataatgaattttacagactgttccatctttgtctttttctggaagctttctgcacctacttgtctgggctgtcattaggaaaacagtaacgcagaataaagtcaaagactcagaaattagctgaactctccaatgatgtggactttgcttttacaggaataactaacttactttgttaatttagtgacaatggctctttgaatcctagaagtgaattactgccttggtataatccaagctcatgttttccttaccctacccccaacaggtgctgttgaattgtgggaactagatgagaatgagacacttattgtcagcaagttctgcaagtatgagcatgatgacattgtgtctacagtcagtgtcttgagctctggcacacaagctgtcagtggtagcaaagacatctggtgggtccctgttctcattgctcctgtctctaagcctcctgtgggtgcctttcctatcctgttaacctcattaggtaacattttgggcttattctaagaatccagtgacttattttagcatgtctataaggtttccttagggattttgcagtccatcgtaagtagaccatagcagcagtccaagaggcaaagacttggggaatgttgattacaggaagttcttgtttgaacacgtttttatgttgatagtgtaggtcaagattaaatgtctgtttgcttttgcttcttagcatcaaggtttgggaccttgctcagcaggtggtactgagttcataccgaggtgagtattctttcatttttagccctggtgttagctgttgtgtttttggactttttgaactttgctttgatgttaggagcagcaattccatgttctgatagttttcttgtaaaacaatagtcaggctccggtatctactccttgtccttttctcaatttcc

SEQ ID NO: 6530 - DNA, 1099 bp, Homo sapiens
tgacataaacacaaagacaaatctacaatgtatgcaccattatttgtagtaccaaaaaatgaattatagaataccagtatagtggaatccagtgtaacttaaaattgaggtaggtttgtgtgtcataattaataaaagtgatgtgtatatgcctatattttgatgggtatacctatatttttattaaatatttctgggagggaatacaagaaatacaggaagttaatggcctatgggggaggctgaaggagacttatttcatacagcatcacttttaaatatgtttttgccatatgctgttataatttctaggtacatattacctattaaataaaagaatttcacgtaaaatacaaaagaagtgggcattctcactggcagaatcttcagagtagaagtattccttcaagtatacaaacaatatttatcatttcttaattttgccccagaataacattgctatggctttggaagttacttaccgggaacgactgtatagagtatataaggaagtaaagaatcgcctggactatcatatatctgtgcagaacatgatgcgtcgaaaggaacaagaacacatgataaattgggtggagaagcacgtggtgcaaagcatctccacacagcaggtacacaacatttttgtaggttctgatgttgtactggtatctcttaacaagtatctgctgatgttttgttaaggtaggaatagctggcaaggagtctttagcctagaagtagcagtgtaaccccggtttgtttttctggatagtgataagcaggaagatgctgcatacctgtcaggatggcttttctctttccttaaatttgggtaacattaactgatatatttaatttctctataaaatagactgggctgggcacggtggctcacacctgtaatcccaacactttggaagggcgaggcaggaggatcacttgaggccaggagttcaagaccaacctgggcaacatagcgagatcctgtctctacaaaaaatttaaaaagtagctgggtgcggtgacaaacgcctgtagttcagctactcaggaggctgaggtgacaggatctcttgagcccaggaagcataggctgtag

SEQ ID NO: 6531 - DNA, 1271 bp, Homo sapiens
tcattcttaacatttatatattactaatatttgttgaattggtctttttcaagcaactgttggttgtacaagccaacatcagtggcagatggttacaggaatatctggcctcaaattctatacaggtttcacccataaaggctgtgagccagggaattttaactaaccccctggatttgcttaaaataaattatatctcctctgtgttaattaattttacttctaaacctgtctagtagctgtatagtgttaagccagtaatcatcttgaggttctggtctggtaggaggtgtcttttagaataatggtgtttatactctatacttttctatgttttggaaaggtctaaccagatttctctttccttatcacaggaaaaggagacaattgccaagtgcattgcggacctaaagctgctggcaaagaaggctcaagcacagccagttatgtaaatgtatctatcccaattgagacagctagaaacagttgactgactaaatggaaactagtctatttgacaaagtctttctgtgttggtgtctactgaagttatagtttacccttcctaaaaatgaaaagtttgtttcatatagtgagagaacgaaatctctatcggccagtcagatgtttctcatccttcttgctctgcctttgagttgttccgtgatcacttctgaataagcagtttgcctttataaaaacttgctgcctgactaaagattaacaggttatagtttaaatttgtaattaattctaccatcttgcaataaagtgacaattgaatgaaacagggtttttcaagttgtataattctctgaaatactcagcttttgtcatatgggtaaaaattaaagatgtcattgaactactgtcttgtttatgagaccattcagtggtgaactgtttctggctgataggttatgagatatgtaaagctttctagtactcttaaaataactaaatggagtattatatatcaattcatatcattgactttattattttagtagtatgcctatagaaaatattatggactcagagtgtcataaaatcactcttaagaatccatgcagcaggccaggcacagtggctcacacctgtaatgcctgcactttggaaggccgagacaggcggatcacttgaggtcaggagtttgaaaccagccaggccaacacagtgaaaccctgtctctactaaaaatacaaaaggttagccgggcatggtggcaggcgcctgtaatcccagctactcaggaggctgaggcaggagaa

SEQ ID NO: 6532 - DNA, 1197 bp, Homo sapiens
gatggcttgatttggcataggtggggagctttgacatctacacaagggagtgggttgaatcacttgagttacttgaaagcaccttgctctgtttctgacatgtgatagggacaccgtaaatgttcattgaacctcagatcacttctaatctcgtgattctaaaattctcttattttagttggtcaatgaaaataactaatgtaaagcatttatattttaatattggaatacatttgaaattgtgaatgtaagtttactcgtttataatgtcccttttcaaattaattggttataacaattaattgattacatctaatcatttgtaagaagagttacggcctatttccaagaattttttgcttattctgatgtcatataattgctgcattacttaatgccagattcatatcttatgaaaaagattagcattaaacaaaaatatttaagctttagtatgttactgagacagatgaagtgtccattttttcttttattgtgtgcatgaagtatggggattacaagcagtagtttttatgtgctttttagtttttcatatacaaagataatgttaatattagctcatttacattttgaaacttttgtaatagtggtatagatttgcactgcataattcacattctctcagtctcctgcacacagttgtgagatgactggttaagagggcactttgtttcaaagttaaatgatccagatgagtattgaacctataagcttagctttgttcattatcatgaggttctgatcaacaaagcagttcaacagagaaccatgccatgctgtcatttctgcttgaaaataagccttttagaggtagaaggtacaaacatgcatatacacatgcaccaataaaaaaaggaaattgtgtatggttattaaggtagagttgaaacaggaaataacgtgcgtttataagtggtttaaaaataattcttttaataaaattttcagaaatacttgatatacgcatggaaaattaaatgttttatgaaataaactccaatcagtagacaagttaatggcttttttaaaagcactaatgacttatttacttaggctatataaatttaggttagataaatctgaaaaaaaaattctttataaatcactcaaattttcccagtgtttcttacctctaacctatttagtttacactggtagagtggttcaaagtgttaa

SEQ ID NO: 6533 - DNA, 1265 bp, Homo sapiens
ccagagcaaaggaaataagtcatacttggaaggctcttctgataatcagctgaaagactctgaatctacgcctgtggatgatcgtatttctttggaacaaccaccaaatggaagtgacacccccaatccagagaaatatcaagaatcacctggaatccagatgaagacaagacttaaagagggggctagccagagagctaagcagagccggagaaacctacccaggcggtcttccttcagattgcagactgaagcccaggaagatgattggtatgactgtcatagggaaatacgtctgagtttttctgatacctatcaggattatgaggagtactggagagcttactacagggcatggcaagaatattatgctgccgcttctcattcatattattggaatgctcagagacatccaagttggatggcagcttatcacatgaataccatttatctacaagaaatgatgcatagtaaccagtgattataggatatacctgagaccatcaggaactgtcaacaaatgatacctttggatatccatcctcctcgacttatagtacagtggtgtatagtggcatttctgataaacttgaaaagacttgagtctttccactgggacacatccatttttcagattgttttgatttaggccaggtatattatcttcatttttaagagtttctttaagaaacttcatcagattgttgaaagataatttttgggacatagagctgaaagtttcagggtgccattttctataagatcttcccaaaagaaacatttaaaaagatgacatataccaccacttacttaaaaacaataaaagcaatagatttgattagtaatattattgctgtggagttctttacaaagggcttaggctgcatttccttctatagaggtgcattcttgtagaaatttgtagcatggtagatcagaaaatcctcttaggttttaggcaggaaggaatatttaaacattgctttagattttcctaaaggtatttgatttgatctgttagcttccagtaaaaatatttgtttttagtaaaaacaaatttaaatatatttacatgtttgttgtttatcttttgaatgtcttttgaggctgtgaaagctgtccacatttttgctgtgtattaaatagctgtgggtcatcagttgctgtcttacttgtgttgctcagatagaggagcagctcttaatcttttttggttcttggatccttttatgaatcagctgatagctatagattgacttcaggaa

SEQ ID NO: 6534 - DNA, 1608 bp, Homo sapiens
cttgaacagaatgaaatcacatctccattcaaaaaatgtctcaagcatctactgttgtgtaaggaacttctgattctgattgctgttacttgaataggaaatggttactcattctgtataaaagttttgcaagagaatgaattttttattctgtaatcaaaaagcaataacttgaaattcactctgtaatattataggtcagtcagaattatacaagttttaccaaattgttacacttattctccaagctgccagaacctggtatctgtatctgtaaaaccaaattaacttttgcttaaatgggaagtatacatatatctgtatagatacattacccctttacatgtttaacatacacacacttaaacacataaatactagtgtgattatatctttggagtttgcaatatagcataaaggacaagtagaactgcacattaagattacctaccgaagcaactagatgtggctgggacacaatcaaaggaggaattttgtccacaggaaggtgaggaaattccaaatgaagcctagatcttcagtatcataaaaaggcagagctggccaggcacagtggctcatgcctgtaatcttatcactttgggaggctgagatgggaggatctcttgagaccaggtgttcaagaccagcctcatcaacatagtgagaccccatctctattaaaaaaataaataggcagagctaaactaaccccagtgtcacaaaactcaactggtcatataaatgagtgaaacaggcctctcacacaagcgatgtaaaacagctgggagcagtgggagctgtggcaaactaaagtgcccaagccgcatttaaaaagggcatctgttcagctccatctgcttgctgcggtgcaagaatgctaaaccaggattaccagttcttcacattttttgaaatccaaattttcatgagaaacattctcatttttaaatatcaagaagtgattttaaaatgtttaaatggtgctggttaaacaaacacgtctgcagctggatttagcttgcaagctgccaagttgcaacctctttcattctagaaacttctgtcattttcatcatagcaagtctatgcggacaaaagcctccaaactttccaactgtgtaggccagtacagctggcaaggttcatagaatataatggctatccccctctgccaaataagactatccacaacccagctcagacacagtggttatatgattttgtgtccatacaggagaggccttggtgtcttcacatacattctctgagccaacatctatccagcagccctgacctcctgctataatttaagtctatttccttttaatctaataagagttgatagtaaaaaggcaggtgatggaaatcagtgtataaatcacaatggagtatattggcaactccacagcttatagtttgataaaggcaaatacatgaaaaataaaaatgctactaatgccccaaggtgtctatcaaaatgatgtagggggtatcttaaactgtccaaggcaatcatgcattgaactttattcctatgcagagccaaaacgaatagtgttgataaaatagctaaactttctaaactggagaggaggctacagtgcc

SEQ ID NO: 6535 - DNA, 1149 bp, Homo sapiens
cttctaggttcaagcagttttcctgcctcagcctcccacatagctgggactacaggcacgtgccacaacgcccagctaacttttgtatttttagtagagatggggttttgccatgttggccaggctggtctcgaacttctgacctcaagtgatcaacccaccttggcctcccaaagtgctgggactacaggcgtgagccaccgcacccggccagtttccagcttataaacacaatgtgtagatgcctttatagacagacaaacagcaagggaactaaaggcttaaattacacttcttcaccacttcacagtgtttgctctatgcagtaggagcatcaccatcacccaggagctcatgaaaaatgcataacttcaggcaccattccagaccttctgaatcagaatctacattttaacaagatccccaggtgatcctatatatacatttaaagcttggagaaacttgctgtactctacccccaataagaggaatttagaacagctcgatagtgctgccttgtcaaggtggaaaagaggcagcattgcagagtcattatgaaatagattctggaggcaggctgctttgctttgaattctagccctgaaacaatgctgtacaacctcgggttagttacttaaccttttctacccttagttgtaaaatgagaataatactacctctcatgggttttggtgagcgttaaatgactttaaaatatgcaagtgttaggactatgtctacccacagtaaaaactaggtgagtgttagctgttgttgctacctttattgtcatcatcatcaccaaagtgcaatagtgggaaaccctacccccttcttgtttaaaggagatatgtcctaacagtcagctcaaaatgcatttttccatagaaactgtagtataaatggtgattgggtataatttttaaaacactattagtaggccaggtgcaatggctctcgtgcttgtaatcccagcactttgggaggccaaggcaggcggatcacttgagctcaggagttcatgaccagcccgggtaacatggtgaaaccccatctcttccaaatatacaaaaaaattagccaggcgtggtggtgtgcacctgtggtcccagctattcagggggctaaaatgggaggatcgcttgagcc

SEQ ID NO: 6536 - DNA, 2258 bp, Homo sapiens
gctgacctggctagagttgtcaagtgggccgcccccctctgcccctccctgcacatgttcttgcgtacctctcacatctgcttacacttcgcgctccctcttgtgcccaggtaatgcccactcatcctcaggactcagttcttatgctgcctcctgggaaggccttcatggacacctcctctgcccccagactgggctcagtgtccctctgtggcactgagcccctctgtggccgatgagctgccctccaagcaccacgctggaatgtatatgttcagtctgtgtgctcctcgaggcaagcgctgagtttctagcatctttgaacccctagcatccagcatagtgtctggcacataacaggcctccgtaagtgtttgttgaattgactgaactgaactccaggcactgagccttgaggttattgtccttctgaccagttttccctgtcttcaccttctctaggcacaaagccaggctatttgatctctggagaaggatcctttcccttcctgcttgggttccacctgcaccctatgacttcgggtggaaactgctgtctgatcagccaccttgcccacacacttggacatctgtactgtctctgatcccttctctcctcaccaacaggctggaccccacatccacccctctgaatcaaatcattccgcttccccttagcctcagctctttcttctgggttgtttgtattttcttttctgtcccaaacagtttcccccacaaaaagaactttatgtctttctctgtcttccctcagtccttccagtcagcagcctgtgattgggcttttcccctcagaaacgaacaatccagaacccactgtttaaaacaactgtattttgccttgggaagtcccattgccttccctgaaaacattaaacattcctccgatccccagcctgagtctctctgtctctgggccccatcctgctccacagcagggctggtgtgtccagcacagagtgaccctccgatgccctttcccacccgccgccctgcctccctcgagccctgccttccctcacttcccagtctcctctgcttctggcagctttgggacccccgcccctggcttctcctccatgctgtatggaatgaagattgcaaatctggcctacgtcaccaagactcgggtcaggttcttcagactcgaccgctgggccgacgtgcggttcccagaaaagaggagaatgaagctggggtcagatatcagcaaacaccacaagtcactgctagccaagatcttttatgacaggtgtgtgtgtgttgtatgttgtgtgtacggggaggtctgcagggtgtgagggaagggggctatctgtgtgaggaaagagtgggttacacaagtgggaataagtccccctccttcagggaatgggggaagggcagggaactggtctgctgggagggggtgagtttcctaagcacagctggcactttgcctgcctcccaagcctaaagctttccccagggtaactccccagtcagaccgctcccaccccaacccccccttgactccccttctccccagggctgagtatcttcatgggaaacatggtgtggatgtggaagtccaggggccccatgaagcccgagatgggcagctccttatccgcctggatttgaaccgcaaagaggtgctgaccctgaggcttcggaatggcggaacccagtctgttaccctcactcacctcttcccactctgccggacaccccagtttgctttctacaatgaagaccaggagttgccctgtccactgggccccggtgagtgagtttccaaaggaaagagctggtggacaggggcttgtcccaggcagtgcttatgctttgggaaacacactgtcactgtccatgggactcttgccttgggatggggcttcctgggggagtgtccgggataaggatatgggtgggagggtccctacccccattcactcatccattctcctccaggtgaatgctatgaactccatgtccattgtaagaccagctttgtgggctacttcccagccacagtgctctgggagctgctgggacctggggagtcgggttcagaaggagccggcacattctacattgcccgcttcttggctgccgtcgcccacagccccctggctgcacagctgaagcccatgactcccttcaagcggacccggatcaccggaaaccctgtggtgaccaatcggatagaggaaggagagagacctgaccggtaactcctccctccaactcagccc

SEQ ID NO: 6537 - DNA, 1241 bp, Homo sapiens
aaaaagaaagaaaaatagggaagatacagttttttcataaacctattgttattcaaattaaagagctgtatacttttagtgaatgagttcagccatctaaaatgcttagataagttttatgctgtcactaagagctcaataaatgttagttattgtgtcatcactgcttatattttttgatttaacacatggtctcatcaaataacgtgatagtcaaggagaatttggtttcgtactgtccttggtaaatttgaaacctgaaaatgggcccctaattatttagttttaaatgtcatgggtctgtggagtccctggactagatgctctctggaactatatttggttctgctttctgtggtttacagtgcctggcagcagatattatggaggagtgtcctgctatccagggagccagcggggtagcaggctattgtgtgtgggcccagagtgggtagagcggagcccctgtagggcagagggaatctgacccttggtcttgcttttcctcctccggcctcccaggtctcatcccaccatcctggacattcctaaccagctctattatgaaggggagctgcaggcctgtgctgatgtcgtggatcgagaacgcttctgccgctgggcgggcctacctcgacaggtgaggctgagcagggcaggccccacccctgtaccctgacttccctcccactgaaggtgcagcccctccctttgtcaccttggcctaggatctcttactctctggaagggtttgggaagggagggaatagagggagggtggtctggctgacggtttcccccgaccccatgtccagggctttcccatcatctttcacggcgtaatgggcaaagatgagcgtgaaggcaacagcccatccttcttcaaccctgaagaggctgccacagtgacttcctacctgaagctgctcctggccccctcctccaagaagggcaaagctcgcctgagccctcgaagtgtgggcgtcatctccccgtaccggaaacaggtcaggtcctcagttaccagcaagggtggggcccctcccccagatggtacctccttaatatccagaccactaggcagaggctccaggagcttaggcctctgctggctccgtatctcagaagagcaccaaggtcagctgccgcctccctttgttccccagctccctggcctcctgccaggctccctcttgcattaggttaatggcacgagagaaaggcacctgtcccctccttcc

SEQ ID NO: 6538 - DNA, 1096 bp, Homo sapiens
gtgttctttgcaatgctgttttctttccttagaacactttgcaggccccagccctcagcaggattcaaccttcatgtttcagcttccacagcctacctcccatcccctttccctgggccgtgtcgcagcactggttcactcactgatctacaattgcccagtgacctctctgtaccctccttggaaggcaagctccctggggtagggcacccctttgacacccctggctggtctcaggccctgcctctttccccactaggtgggttcagtagaagaattccaaggccaagaacgaagcgtcatcctcatctccaccgtgcgaagcagccagagctttgtgcagctggatctggactttaatctgggtttccttaagaaccccaaggtttgagggctggtcggggtggcaggaattcttccattctcggggctcttccctcccatgaccacaccacttcttccttccagaggttcaatgtagctgtgacccgggccaaggccctgctcatcatcgtggggaacccccttctcctgggccatgaccctgactggaaagtgtgagcattcccaccccattctccctcttagtggccacagcccctgcctagggcaggtggatcttttttaagcgcttgcttatcgctcagttaatcctcagatgtgtccattttcacagcatcactattgtatttataagttaaatgacatccagaggttgagcaagtacagctcagatgggacaggaccgtggcttagcctccagtctctgctggcactcctctgtaccccacagattcctggagttctgtaaagaaaacggagggtataccgggtgtcccttccctgccaaactggacctgcaacagggacagaatttactgcaaggtctgagcaagctcagcccctctacctcaggtatggctgggccagggtggggacagtgccagaggaggtggtaaggaagacacagtgtactttctctctttccagggccccacagccatgactacctcccccaggagcgggagggtgaagggggcctgtctctgcaagtggagccagagtggaggaatgagctctgaagacacagcaccca

SEQ ID NO: 6539 - DNA, 1381 bp, Homo sapiens
aacatgtcctctaataatgaggatttatatcctattccttccattatttatacctcttattatttatttatttatttatttatttatttatttatttatttatttattgtcttcacaggtcttgggcttgccttcaacttgaatccagctctgaccatgattggcaagtatttctacaagaggcgaccattggccaacggactggccatggcaggcagccctgtgttcctctgtactctggcccccctcaatcaggttttcttcggtatctttggatggagaggaagctttctaattcttgggggcttgctactaaactgctgtgttgctggagccctcatgcgaccaatcgggcccaagccaaccaaggcagggaaagataagtctaaagcatcccttgagaaagctggaaaatctggtgtgaaaaaagatctgcatgatgcaaatacagatcttattggaagacaccctaaacaagagaaacgatcagtcttccaaacaattaatcagttcctggacttaaccctattcacccacagaggctttttgctatacctctctggaaatgtgatcatgttttttggactctttgcacctttggtgtttcttagtagttatgggaagagtcagcattattctagtgagaagtctgccttccttctttccattctggcttttgttgacatggtagcccgaccatctatgggacttgtagccaacacaaagccaataagacctcgaattcagtatttctttgcggcttccgttgttgcaaatggagtgtgtcatatgctagcacctttatccactacctatgttggattctgtgtctatgcgggattctttggatttgccttcgggtggctcagctccgtattgtttgaaacattgatggaccttgttggaccccagaggttctccagcgctgtgggattggtgaccattgtggaatgctgtcctgtcctcctggggccaccacttttaggtatagtatatctccctactaatgtgggtctattacaaaacaagcatgtaagatgggaatgctgacagaaagcaaacattagtgagctatttgggtaagaataaatctttctcatttatgtacccttgatgctgggacaatgcttggcacagcataattgctcaaatatagaatctaattaaatggaaccatcaaggcaaaagggggatcaaatattgttacaaatgtcagtgttttttctttttttttgagatggagtcttgctctgttgcccaggctggagtgcagtggcaccatctcagctcactgcaacctccgcctcccaggttcaagcgattcccctgcctcagcctcccggtagctgggattacagatgcatgccaccatgcctggcca

SEQ ID NO: 6540 - DNA, 1171 bp, Homo sapiens
ggctctacagcgccggcccccagcgtcttcccgggtgccagcggcacccgcatccattcaaatgctgcccattccccgctcctcagtcgcttcccgctactccgcacgcgcatctcccccacccgtcagggtcaggcctctcggtgacttttcctttttctctggcagaaactgaggggtgagaccgatggttgtgtcccgaacgagggcagattgcctagagctcgtcagacagggacccaagggcgagtctggcagggcgtggtagctccgcgccgctcagcaggggcgcagcgcgcgggtcggactgggacgccggtcacgtggcggggagggggcgccggcgcgcgcgggcgagctagagggcgcgcgcggctgaaagcgtgtggaggcgcgggctgcagttcggatgtctgtgtggcggggagggggcggcggccgggagagacgactccgccccctgcgcgcatgctccggccccggcgggttataaggcagcctcgctggcccggccagacaaagtggtgagctgcgacgtgactggctagctgcgtgggtactggaacaagcaaacgaggcagcgagcgaaggacgggagccggaccctgggccccgtggaactccagcctgcgccaccacgtcacgcacacgctcggcgctgcgatccgcgcatataacggttagttgggtaacagccggcggcacgcggcgcggaccccacggtgccctcgctgccctggtggggtcggaggggacctccggggttgggagactttgtctccggcggagggaggcggcccagcagagggcatcgtggtcacaggcagccgcgtggcctcggactgcagtgctggtgaaggagaccttgaggcgctggggtcagcgcctctcttagccgagccgcgggccccgtgctaagatgccggtcccaggcctggccgaggagttgggtcgtggtgcccggtgacggtggggaagtcccttcccccctaagtcttcaataggctcctcgagagatgctttgatctggaaaagggataacatgaggctgctgcatgtggtacctccagactctcctggccgcttctgccccaagggaagggactcggggcagaagttatttatgattcgtgacattgtccgccccaaccttcttggcccgccgatcctt

SEQ ID NO: 6541 - DNA, 1286 bp, Homo sapiens
tctgcctcagcctcccaagtacctgggattacaggcatgcaccaccatgcccggctaattttatttgtatttttagtagagacggggtttctccatgttggtcaggctggcctcgaactcctgacctcaggtgatccacccgcctcggcctcctagagtgctgggattacaggcgtgagccaccgagcccggccggtccttattttatacaagtgattaagccaaaaattttcttgaatttctgataccaaagagctttaggtaaataacttcacactctaatgcaatgtaattctttctttgtgctttcagatttccttacacttcctgtccagttctctcttctaaatccaatattactcactagataatttcagccacttaaataaaaatatctatttttaagtcctggttcaagggttccaaactcacataatttctcaactttttgccagaaagttgagcatttattcatacttattttcaatcctaagtgttctcccatgggcagcagcacttcttgagctgtttagtactgccacacctttttatgtctttactatgtcagcctctgatcattttcactttgaacttcctaaagatcacaatttcctatcccttcaatctgcgatccctcttcttcctttcttactagattatggtgtagtttgtactagactgactcattaagaccttgtacgcttcctgagtctgcttattactggctttgtaatcaagggtgagtctttttacttctctaggctagattttctcatttatgaaatgaggacatttttctagatgctgtaaagccctttccagctgtaacattctatgaatctgtaattccctcgaggagctaaggaggattatgctactttaataaaaagctgctttggtgacatttgttcgagtagaacaagagtgatgctgctcattctgacttgagccagatgtatttcctttatagcaggagtaatggtctaagaaatactcattaggagaaaaaaattctgcttctaaacagtattagtaaacaaagaatcttgactcagttgaaaaaccacccattgctctctagagcagaatgtctgaatgctggttttatagcacactagaatatcagaatgagttgacaggtataccacaactaatttgtaactagtttgtgactcacctttctaatgtattcgaagttatccctataattatattactctcgctcaaattctgatagatttcctgaatggaataggtggaattagggctaggctgccagagactgt

SEQ ID NO: 6542 - DNA, 1158 bp, Homo sapiens
tatatatgaaatggaaaggcaacatagcatagtagttaagagtgaggactctggagcctgactacctgggttcaatccccatctttgctgtttgctttctgtgtagccttggaaaatactcttcctttgagcaacacagcacttcaaaatgtgttttatatacagcatctagttgtttttgtggtggaaacccttttgaaatatctaaattatcatgctgctagaaaggtaaatccttttaacacagtattcttcacttgccgagggatctagggcttcagtttttcacttggctaatgtgcatctggatgggcattgtaggaaactatttatttgtgtacttttttaaatgatggatttttatagaaacaatttgtatagtttttagaattaattttaaagaagagctctaatgttttacatcttaaaacctcttcttttcagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaaggtaagatgagaaattacactgtagttgtatattttctgggagagttattgtagagatttataaaacctttgattaatttaaaatctccctcttttgtgtttttcattattttttggcttagaaaatgaatgcattactttgcacttttctccttgatgctgagaaaaccttgttacaaacttttagttccagtttgggatttttgtcattcagtacagttgtttaaaaggaaaatttctatactatattattctttataaaatttatcatatattggcttcaaagaaaacattctctttgaaattcagtcttaatcaaaatttggtgaaaattcactgtaaacaaggatcttggtacatttggttagcgctaccaaaattttaccttttttcaaagatgtgtaataagaattgatttctaagtggtctaaactttttttttttctttttgagacagagtttcgctcttgttgcccaggctggagtgcaatggcgcaatctcggctcactgcaaccgatacctcctgagttcaagcgattctcctgcctcagcctctc

SEQ ID NO: 6543 - DNA, 2163 bp, Homo sapiens
tgataaactattcttgtcacttggcatcaacctcttcatgataaatatctactactgagacacttcaattcacagttttaactggtgaatacctgggtttatttactattactctgtgttgctattttctaagaaagaatacagcactagacttcatcctagagtttcaggtaggctaatgcttagtgcctgagtatttaaattttcttttcaaacaggcacagttcacattgctagtatggtcctaactttctgttattttagaatgttaacatgattcacattatactttctcttagttaataatacagtaggccttttgtttattaatggaagagtactccccacacctaagaccagattcttatatctccctggttacagtgcaatttggagattttttttttttcctggatggtaagatttgaaatatttacattaacataggcaaaaaaaaaaaaaaatacaagatgctgctttattatgtctgtcaccatgaaaacttagctgcatcttttgaaatatcaaatatgaattttctctaaaatattctgaaataggttaaatcttatataaatattactttgtgcaatattgttgtgtagttaaatgcatattagcaaagtatagaggtcactgtgtaaaccgatagaaaagtaaccatcagcaaatactgcagtgattagttagaatctgtattattccttatatatatgtatatgtatgtattctctgttacaaaggatgaagacaaatagggatacatttcaatgtaaaccatttatgaattggaagtgatgttggctttagttatctttgtaaataaggtaattagaatggtatgaaaggtaatgtgattattgcaggggtgtttttaaatcttgggtataaattctagggtaaattccagtttatccagactagtttttaacgggacctgcctttgagggtgttttttgttattttgttggggaggggtttaatcacaaagtgtgtgggtttgggttatttcttgtttttatttttctgtccagaagagctttaccaggctgtgcaaagtaaaattcttctcaggcaacatttgcttttaaaaataatcatgaagagaaggctgttaaagcaaaaattttttttttttaattttttcttgtcttccaagatccgatttccccatctcccacttgccatccagcagatgccatctgtcatccaagctggtcattgctaataaacaaggagactgtctcctgacagccagcactgtgtattatcactcaggaaccagcggatctgcaaagacctacaatcaaaagcaaatccccattttccttttataaaacattctaccctcacctccaatataaacacattaaaagagtacaataaaaatgtttaaaatcatgtactaataaattcattgtatgttagaattgcaatagaatgaagagaaacatttagctagtaacgtgatctgaaaactgaatgtcctatgtgagtattagattttaatagcatgctttaaagactgatgagtataaaagcagaagttttgcgttttttactgctttcaaagctgtatcctagtttagtgatacaaatgattgcaatttttctaaatcattaaattatttggtttggtggagtgaggcatggagcaatctggcgtcttctgatttgttaaagtagtgatggcagtgaagttgtaactgaaatttaagctgatcttcctttttggtatattatccgttgtgccagctcttgagattacttgcacaatgtggctataagttttaatattttgtggagcagagggatggtttttaaatgtgcttatggaaaggacccaataaatgaatattcctaacttagtaaagtagaataatttcatggtattcattaaaaagcataaaagtcttcctcttgccccagaagtaattctctataccaagatatgctaggagtaggatgatgattcaaagtggtaacccaaattcataaagcaataataataaaaacctatatagtatgttctctcctccaaagttttaactctaaaaattggttcctaggtttaattgtacctttaatttgcttattcagtacttagaatttgtttaactggtacttttattattttttagtgaaagacttttgaaaagtgcc

SEQ ID NO: 6544 - DNA, 1125 bp, Homo sapiens
ctgggttcatgggaatcttatgcctcagcctcctgagtagctgggattacaggcgcccaccaccacacccagctaattttgtatttttagtagagatggggtttcaccatgttggccagactggtctcaaactcctgacctcaggtgatgtgcctcccacaagtgctgggattacaggcatgagccactgtgcctggcctaacaatggtttttacaatttaaaatagttggaacgaccttgtagcgcatggaaatcatacgaaatttaaactgtgtccagaaataaagctttattggaatatagctctgttcattcatatatattgtctatggtagtttttgcactacagtagcagaatacagtaattgagacagagaccataagacctgcaaagcctgctgttcggctctttagagaagtttgccacccttgagttcacttaagagacatgttccttcctgcacagcagttcaacagtatttaatctgaattcatgtggagactaattacaaattattacaatctcagacatttggagttgttcataaacagttgaaacaaaaatttaatctgtaaatgctagggtaaacttgttcatctttaaaacagaaagaagtgattttcagagagatgaagtgaaatgcttaaaattttttagttggtgatagagctgaatacagaactcaatttttttccctcatggcccagttgacctctctttctgctatgcacactggggttgattatttaacagagatatttaaatgctgtttttatttcttatagggaataagcttgagtgtaactaaactggaggttacctatgtgttttgaaatcttaatttttttctctccctcttattgctcataaaaacataggacaggccgggcgcggtggctcatgcctgtattcccagaccaaggtgggcaaatcacgaggtcgggagtttgacaccagcctagtcaacatggtgaaaccctgtctctacgaaaaatacaaaaaattagctgggctacttgggaggctgaggcaggagaatcacttgaacctggaaggcggaggttgcactgagctgagattgcgccacttgcattccagcctggtcgacagagtcagactccgt

SEQ ID NO: 6545 - DNA, 1198 bp, Homo sapiens
cttctgcagtgcgaagaaactgaaaatagagccctctggctgggatgtttcaggacagagtagcaacgacaaatattatacccacagcaaaaccctcccagccacacaagggcaagccaactcctctcaccaggtagcaaatttcaacatccctgcttacgaccagggcctcctcctcccagctcctgcagtggagcatattgttgtaacagccgctgatagctcgggcagtgctgctacatcaaccttccaaagcagccagaccctgactcacagaagcaacgtttctttgcttgagccatatcaaaaatgtggattgaaacgaaaaagtgaggaagttgacagcaacggtagtgtgcagatcatagaagaacatccccctctcatgctgcaaaacaggactgtggtgggtgctgctgccacaaccaccactgtgaccacaaagagtagcagttccagcggagaaggggattaccagctggtccagcatgagatcctttgctctatgaccaatagctatgaagtcttggagttcctaggccgggggacatttggacaggtggctaagtgctggaagaggagcaccaaggaaattgtggctattaaaatcttgaagaaccacccctcctatgccagacaaggacagattgaagtgagcatcctttcccgcctaagcagtgaaaatgctgatgagtataattttgtccgttcatacgagtgctttcagcataagaatcacacctgccttgtttttgaaatgttggagcagaacttatatgattttctaaagcaaaacaaatttagcccactgccactcaagtacatcagaccaatcttgcagcaggtggccacagccttgatgaagctcaagagtcttggtctgatccacgctgaccttaagcctgaaaacatcatgctggttgatccagttcgccagccctaccgagtgaaggtcattgactttggttctgctagtcacgtttccaaagctgtgtgctcaacctacttacagtcacgttactacaggcaagtggcaaatgctgaaaatcgtatcttaggctagagttctgtccttatatttaacatataccccgtaggctacatatagcaatgaatttgtttatagattctgagatagaaataggatatgttttagctcattctatgtgtgtggcattcctatatatgacatttattt

SEQ ID NO: 6546 - DNA, 1225 bp, Homo sapiens
agatgtatgtggagcatgagagtagtgcctgatacataagtacccagaagtttactgctgctaatattactattattattaccatctttatcatcattgttatcatgggagaaccagagacagatcatctaagaaacattgcttaaaagggtggttgaagctcggcatggtggctcatgcctgcaatcctagcactttgggaggccaaagcaggaagatcacttgagcccaggaatttgagaccagcctgcgaaacatagtgacatctcatcactacaaaagataaaaacagttgggcatggtggtacacacctgtagtcccagctactcgggaggctaagatgggaggatagcttgagcccaggaggttgaggtcgcagcgagctgtgatcactccactgcactccagcctgggtgacagaacaagacgctgtcacacacacaaaaaagaacaattcaattttcatgtatttttcttttcctcagctctggactgaagccaaggtctaatgtcatcagttatgtcactgtcaatgattctccagactctgactcttctttgagcagcccttattccactgataccctgagtgctctccgaggcaatagtggatccgttttggaggggcctggcagagttgtggcagatggcactggcacccgcactatcattgtgcctccactgaaaactcagcttggtgactgcactgtagcaacccaggcctcaggtcagtgttatcttcacagcttgagttgaattctcctttgatgtgtgaatgcttaaatattttgccataatccacttatatcagtggtagagaccagtggtgtagacattcttaaagagaccttaattcagaaatcagttccctgcacaatgtgaaattatttttggccatcactttatcttcctgtgtttattttgcttggattaatatacaaatgagattgtagtctcagaaacacattcagtgctgatgggagaaagcagacaagacgtgtgatattgcaagaagaattagcaggcaattaggtttgccacagatgatttgaatttggcaattgagatgtagacaggacttgataatattgaaaatgactgcaaaagtgttttggaaaacagttatattctttagatttttttctcacccagtgtcatagcagtgatgcttttgatggttttattaccaacccaattacttccatcatctttgccctgttagat

SEQ ID NO: 6547 - DNA, 1075 bp, Homo sapiens
cgacttctgctgctgcactgggctcaaccagctccattgctcatcttttctccccacagggttcctcaaggcatgctgcagcctataccactcaccctagcactttggtgcaccaggtccctgtcagtgttgggcccagcctcctcacttctgccagcgtggcccctgctcagtaccaacaccagtttgccacccaatcctacattgggtcttcccgaggctcaacaatttacactggatacccgctgagtcctaccaagatcagccagtattcctacttatagttggtgagcatgagggaggaggaatcatggctaccttctcctggccctgcgttcttaatattgggctatggagagatcctcctttaccctcttgaaatttcttagccagcaacttgttctgcaggggcccactgaagcagaaggtttttctctgggggaacctgtctcagtgttgactgcattgttgtagtcttcccaaagtttgccctatttttaaattcattatttttgtgacagtaattttggtacttggaagagttcagatgcccatcttctgcagttaccaaggaagagagattgttctgaagttaccctctgaaaaatattttgtctctctgacttgatttctataaatgcttttaaaaacaagtgaagcccctctttatttcattttgtgttattgtgattgctggtcaggaaaaatgctgatagaaggagttgaaatctgatgacaaaaaaagaaaaattactttttgtttgtttataaactcagacttgcctattttattttaaaagcggcttacacaatctcccttttgtttattggacatttaaacttacagagtttcagttttgttttaatgtcatattatacttaatgggcaattgttatttttgcaaaactggttacgtattactctgtgttactattgagattctctcaattgctcctgtgtttgttataaagtagtgtttaaaaggcagctcaccatttgctggtaacttaatgtgagagaatccatatctgcgtgaaaacaccaagtattctttttaaatgaagcaccatgaat

SEQ ID NO: 6548 - DNA, 2674 bp, Homo sapiens
caaaatctctgtctattatgagatactggcattgatgagctttgcctaaagattagtatgaattttcagtaatacacctctgttttgctcatctctcccttctgttttatgtgatttgtttggggagaaagctaaaaaaacctgaaaccagataagaacatttcttgtgtatagcttttatacttcaaagtagcttcctttgtatgccagcagcaaattgaatgctctcttattaagacttatataataagtgcatgtaggaattgcaaaaaatattttaaaaatttattactgaatttaaaaatattttagaagttttgtaatggtggtgttttaatattttacataattaaatatgtacatattgattagaaaaatataacaagcaatttttcctgctaacccaaaatgttatttgtaatcaaatgtgtagtgattacacttgaattgtgtacttagtgtgtatgtgatcctccagtgttatcccggagatggattgatgtctccattgtatttaaaccaaaatgaactgatacttgttggaatgtatgtgaactaattgcaattatattagagcatattactgtagtgctgaatgagcaggggcattgcctgcaaggagaggagacccttggaattgttttgcacaggtgtgtctggtgaggagtttttcagtgtgtgtctcttccttccctttcttcctccttcccttattgtagtgccttatatgataatgtagtggttaatagagtttacagtgagcttgccttaggatggaccagcaagcccccgtggaccctaagttgttcaccgggatttatcagaacaggattagtagctgtattgtgtaatgcattgttctcagtttccctgccaacattgaaaaataaaaacagcagcttttctcctttaccaccacctctacccctttccattttggattctcggctgagttctcacagaagcattttccccatgtggctctctcactgtgcgttgctaccttgcttctgtgagaattcaggaagcaggtgagaggagtcaagccaatattaaatatgcattcttttaaagtatgtgcaatcacttttagaatgaatttttttttccttttcccatgtggcagtccttcctgcacatagttgacattcctagtaaaatatttgcttgttgaaaaaaacatgttaacagatgtgtttataccaaagagcctgttgtattgcttaccatgtccccatactatgaggagaagttttgtggtgccgctggtgacaaggaactcacagaaaggtttcttagctggtgaagaatatagagaaggaaccaaagcctgttgagtcattgaggcttttgaggtttcttttttaacagcttgtatagtcttggggcccttcaagctgtgaaattgtccttgtactctcagctcctgcatggatctgggtcaagtagaaggtactggggatggggacattcctgcccataaaggatttggggaaagaagattaatcctaaaatacaggtgtgttccatctgaattgaaaatgatatatttgagatataattttaggactggttctgtgtagatagagatggtgtcaaggaggtgcaggatggagatgggagatttcatggagcctggtcagccagctctgtaccaggttgaacaccgaggagctgtcaaagtatttggagtttcttcattgtaaggagtaagggcttccaagatggggcaggtagtccgtacagcctaccaggaacatgttgtgttttctttattttttaaaatcattatattgagttgtgttttcagcactatattggtcaagatagccaagcagtttgtataatttctgtcactagtgtcatacagttttctggtcaacatgtgtgatctttgtgtctcctttttgccaagcacattctgattttcttgttggaacacaggtctagtttctaaaggacaaattttttgttccttgtcttttttctgtaagggacaagatttgttgtttttgtaagaaatgagatgcaggaaagaaaaccaaatcccattcctgcaccccagtccaataagcagataccacttaagataggagtctaaactccacagaaaaggataataccaagagcttgtattgttaccttagtcacttgcctagcagtgtgtggctttaaaaactagagatttttcagtcttagtctgcaaactggcatttccgattttccagcataaaaatccacctgtgtctgctgaatgtgtatgtatgtgctcactgtggctttagattctgtccctggggttagccctgttggccctgacaggaagggaggaagcctggtgaatttagtgagcagctggcctgggtcacagtgacctgacctcaaaccagcttaaggctttaagtcctctctcagaacttggcatttccaacttcttcctttccgggtgagagaagaagcggagaagggttcagtgtagccactctgggctcatagggacacttggtcactccagagtttttaatagctcccaggaggtgatattattttcagtgctcagctgaaataccaaccccaggaataagaactccatttcaaacagttctggccattctgagcctgcttttgtgattgctcatccattgtcctccactagaggggctaagcttgactg

SEQ ID NO: 6549 - DNA, 2417 bp, Homo sapiens
caggcagggaaagcagttgcattgtactttgaagataaactcacagagatctactcagacaggaccttcgcacctttgccagagtttgagcaggaagaggatgatggtgaggtaactgaggactctgatgaagactttatacagccccgcagaaaacgcctaaagtcagatgagagaccagtacatataaagtaaaatgacatggatttaaatcaattgtttaaaaaaaaaaaaacgaaaaaaaaaaaaaaaacacaaaaaacccagaaaacttttaagtgttgctggaatatcctgcctacagtgggcacctccttgaagaagctgatagcttttacacagtattagattgaaataatggacagaaacacattcttgtcaagaaagggggagagaagtctgtttgcaagtttcaaagcaaaaagcaaaagtgaaatgatttgaggatttctgttctaatggagatgattctctgattgttagaaatggcaaatattgatgattgtgtgctattgattggtgcaggatacttggtatacgagtaaatacttgagactcgtgtcacttgataaattttctttttggactaggtcgcacagttattaaaacaacttttaaccctcccccttcacacacatacatatcaggttgttttctagttaaaaacccaagtagctcagattctactttaatgtcagtgcagatttgcattgaatcatgccattatgttttttctcatttttatgctgttgggtcttagtttttaaattgatataaagaactcagcaatggttttattttctactcatacttagggtttaggaaacactaccactagttatcatttaatcaacttcaatggtctactgaaacaaaaatggtaacttttcattagtggattatttagagttatagtagttgtttccagaaaacacttcctcacaattgtacttcccaatcaaatcatgtgatcatacagttattcccatgaaaggcagaatgtttgtttcaaaattaatctagttttctgtacatttaaatttgagaaggtgacaactggctcttttccagtcttccttcatgtcagttttctgatagaccactattggcaaacagtatctgtcaactaccaaatgtgtaaaattttctgtatttcactttgtcttatttgtaaatagtgaactaaaacttttggcagatcagcaacatttgctgagcctgttttttaagctaatgtgtattcttactaatgttcctatcaagaatggatttgtaatatatgctgtctatttctaatgttcacattcatattttgaggttctatcttattttaatagagaacagacttctcaaaaaatcttcagaagcagcttattattgaaatatcgaaatattgaaataaacccggtggggttagattactcatctgtccaccaagtgggacatttgcatggactgggggcttaaaggacttagaagagacctgtaagtaaatcctgaaaatgagccaatccccacttgaatggttactggagtaaacccacctttaccaccccaattacagcacccgaggccgataaaccaacttggctctggttcatttttcttttcttcatttgtgatgctcagattcaaaatgtgtgttctacactgttacaggcttctcttttgtttgattaaagattttagtcctacttttgtatggacacattagaatattcagagaccaaaatagaagaatttgctgttagatatttttcagaagtcagcagatttgtggcaaatcatttatttgcctttttaaaaattcatttaagcagttcagagagtagactactcagaaaattatttcacgtaattgtctaagaggtcaatattttttaatgcatattgaatcaaataaagtgctctaaagaaattattatacaaattcctttgggttgtttttcttttcttaacaaggggtgggggtaaacaggaatatgattcaggctttctggttgtgtatttaaagagtattgattttattattactattgatttactttattcctggcttccttttcacttttctttcaatttttaaaaaataatttaagccgttgaaaatataccaaactgttgaaacattttactcaaattttaaattcctaaaaatgttttttaataagagggagaaaattatttaaaaatacttatgcctatgccaatttccctcttttttcacaaaatccatgatttcagtttgtaagtagacatatatctaagggcacatttttggaaagtgaggaatagcagcagtataacttcattttgtcaggcctttgagttctaatattttgtattgctcttcaaatggatccttttaaaaaaattgtagataatgagtcataaatagattctgccaactgagggga

SEQ ID NO: 6550 - DNA, 1145 bp, Homo sapiens
ttgcagccttcctacaatatagtagaatgataggtgagcagaagaatattatagaatgcttctaaaatgctatgcaaaagattctgggtgtgaaaaggggtgtgccataattagctctctcaaggaaaagtataaccctatgctcacttcccaatcaatagcttaacagtttaattaatttacttattatttgagtgagacattatcagaggagcagaccccttaaaatcatatgttagcgtgcctgaataattttggggttattgtcatttctttatggcactattgtgatctataaaataaatttgttacgtcagtatatctatatgcatattcacataactgttaaatacacatatggcatacaataaagattaaatgattcttcaagaatttgtcatcgttttgttttagttgagcagtcctgagagtagcttgacaccacctctctcaaccaacctgcatctagaaagtgaattggatgcattggcaagcctggaaaaccatgtgaaaattgaacctgcagatatgaatgaaagctgcaaacagtcagggctcagcagccttgttaatggaaagtccccaattcgaagcctcatgcacaggtcggcaaggattggaggagatggcaacaataaagatgatgacccaaatgaagactggtgtgctgtctgccaaaacggaggagatctcttgtgctgcgaaaaatgtccaaaggtctttcatctaacttgtcatgttccaacactacttagctttccaaggtaccagtgaaataattgatttttggtgttgattttcataagctaaaaataaataacagaagaatgttcagggcagatggccttctaaccagtgcacagtatttctataaaacagggagcctgttattcttttggtattagcttccagagaaactaacaataaaatatctaagatctaagtagtacattaatgttaaagagtagatttcatctcctggcctttagtttatattcagtataaggaaaatagataaaactctaaattaatagggggctaaggttacaaaacctgcagtctggttctaattctgtagtaagcttgagcaattcactaattatcagggatcagtttttgcatctacaagtggtaggttttggttt

SEQ ID NO: 6551 - DNA, 1141 bp, Homo sapiens
cataactgctttgagtgcttacacctacttataaaacatctaaagctattcttaaaaatggattgaaaatgttttatgccctttactgtatacaaagggaaaccatattaagagtaattttgaagggagtgtatcagaacccatgtttgaagtggctaagttataaatgaaaataaatgcttctatgtttaactattatcctttcaaaagataattattgcttgtgacattgtccttttgcacattgttcttggaaaacgtcaaggttaaacagaaccaatgtgccacatttgacactatccagaagtcactggtgtttgtgcatcacattcatgtcatagttacttaagtagattgccatccagcttaataaactgtcctttatgagcataatttaaaattactaaatattagtttcattatttgtctatgtacataacttgtttggaccaaattggtcaggtctgctgaaacatgagttgtacattttgacaaagttttcattttaattactcggttaagtgcccagttggatgaatttctgtaacagttgatgattcagagacctaggataagttgataacctaatgatgcatttctcttattcaggataaaagaagtaaatgagactaacaaacgagtagaacaggaaattaaagtggccattttcacccttatcaatgaaattaataagaaaggaaaatctctcttacaacagctagaggtatggttcaaagccaaaataaaacaaaaactgcttctcttgctctttagctgtttttaatgtttattgaaaactattttagatggattggggggtatggaaataaaggaaaacgtaaaataaggtttttaaaatttacttttggaagagaccttttctagttagttactttgcggcccaatttaataacactgactttagctgtataccttaggaaatagtgatgtcctcttagaaatcaaataattgttactaagactgggtatggtgactcacacctgtaatcccaacactttgggagcccaaggcagacagatcgcttgagccccgggatccagcccagcccaggcaacatggcgaaacctgcctctacaaaaaatacaaaaattagccagggtggtggcatgcaccagtagt

SEQ ID NO: 6552 - DNA, 1194 bp, Homo sapiens
gcttccctggctgggaatattgcatgtgtattatcacacattgttactgtgagaagaatagctccactgggagaggacaactagatgctctgcatttaaaactctcctggggcacagcagctgcacatcctggggctcctgacctctttgcgtttgcagtgtagcccaaatcggtcagcactggaggacctcagcagccatgttgaagccccatagtgaagccgggactgccttcattcagacccagcagctacatgcagccacggctgacacattcctggagcacatgtgccacctggacattcacacaccacccatcccagcctggaacactggcatcatctgtaccattagcccagcttcccaatcggtggagatgttgaaggagatgattaagtctggaacgaatgtggcttgtctgaacttctctcatggaactcatgagtaccacgtggagaccatcaagaacatgtgcacagccacggaaagctttgctgctgaccccatcctctaccggcctgttgctttggctctggatactaaaggacctgagatccgaactgggctcatcaagggcagcagcaccatggaggtggggctgaagatgggagccactctcaaaatcatgctggataacacctacatgaaaaagtgtgacgagaacatcctgtggctggactacaagaacatctgcaaggtgatggaagtgggcagcaagatctacgtggatgatgggcttatttctctccaggtaaagcagaaaggtgctgacttcctggtgacggaggtggaaactggtggttcctcgggcagcaagaagggtgtgaaccttcctggggctgctgtggacttgcctgctgtgtcagaggacatccaggacctgaattttggggtcgagcaggatgtcgatatggtgtttgcgtcgttcatccgcaaggcatctgatgtccatgaagttagggaggccctgggagagaagggaaagaacatcaagacaatcaacacaatcgagaatcatgtgggggttcagaggtttgatgaaatcctagaggccagtgatgggatcatggtggctcgtggtaatccaggcattgagattcctgcagagaaggtcttccttgctcagaggatgatgattgggcgttgcagctgagctgggaagcctatctgtgacagtgatgtggccagtgcagt

SEQ ID NO: 6553 - DNA, 1158 bp, Homo sapiens
aaaagaatacagagagattccatgtaccctttacctacttttccacaattgtgccttgatttttttttaatggaaagttgaaagtgaaggttaggccaggcatggtagctcatgcctgtaatcccagcacattaggagaccgaggtgggtggatcacctggggtcaggagtttgagaccagcctggccaacgtggtgaaaccccatctctactaaaaatacaaaaaagtagccagctgtggtggcgtgtgcctgtaatccagctactcgggaggctgagtcaggagaatcccttgaacccgggaggcggaggttgcagtgagctgaggttgcgccattgttctccagcctgggcaacaagagcgagactccgtctcaaaaaaaaaaaaaaagtgaaggttagtgttatagctctgggtgaacatgtgtatacatttaaaataaaatcttctaagagaagttttacattgagtaatttttttcttttcttcccccccattctagttgggtatccctggtcagtaagaattatgagattgaacggactattgttcagctagaaaatgaaatctatcaaattaagcagcaacatggagaggcaaacaaagaaaacatccggcaagacttctgaaaagacaatttagcaggtagaagaaaagttgggctttcacaaaaggcatctgaacttttaatgaactttgaaggacaacagcatcttcccaaaaccattgatgtttaagtgtttagaaatcatagaaggtgtaggctgctgtggtaattctatttgtatatctcaacagaattaaaatgtctagcttggtggtatttttatagccataaaagaaaatctttaggctttcaaaataaggatgactttagaataatattgtgtcatagaattaattttcagccatgtggaccatattttgtatccaaggatccttatttaaagctttcaacatgtacaggaagttggaaatttttggtttatgactttgtctaataaagagatagttctaaacacattcttgatcaccaaacaacttcagaaagacagtgactgtacagttatcattatcatcatcatcgtcatcatcataggtaacagttatatcaagcttaatatgtgctgaacattgttctgaacactttaggtaga

SEQ ID NO: 6554 - DNA, 1180 bp, Homo sapiens
ggcatgggagccacctttattttttagtgtccaccatgtgccatgcactgtggtatatgtatgcatatcatctcaaccaatccttaaatcaaccttatgagatagatatttgcatctccattttactaataaactgaggctgggtgctatggctcacgtctgtaatcccagcactatgggagtccaaggcgagtggatcatttgaggtcaggagttcgagaccagcctggcaacatggtgaaactctgtctctactaaaaatacacacaaaaaattagctgggtgtggtggcaggtgcctgtaatcctggctgctcgggaggctgagccatgagaatcgcttgagcccaggaggcagaggttgcagtgagccgagatcgcgccactgcattccagccagggtgacagagcgagactccatctcaaaaaaaagaaaaaaggaaaagaaaaaagaaaaaaacaaattcaaagaagttaaatacgttgcccaaagttgtacaacacagaactgaagccaagacttttatggacacagaaaaagttggttagtcctacagatggaaatttcatctcagtaggattatatagctatttcttttattaataaaaattttctattaagtgtaccagagccacttttcagctctgaggataaggaactttataggtgcctagatgagactctttttattcccctagaaatgttgaaatttttgctctaattaaattagactcaaaatatgaacattccttgaacatataccacttagtcatccagacctttaatatctaaagtagtagtagtagtgattggaaagagaaagttttcagtgatggtgcagtgttttttttgtgtgtgtatgtgtgtgtgtgtgtgttttgtttcggttttttttttttttttttgagatggagtttcgctctttttgcccaggctggagtgcaatggtgtgatctcggctcactgcaacctccgcctcccggcttcaagcaattctcctgcctcagcctcctgagtagctggaattataggcacccgccaccacacctggctaattttgtacttttagtggagacgggggtttcaccatgttggccaggctggtctcgaactcctgacctcaggtgatccacccaccttggcctcccaaagtgctgggattacaggcatgagtcactgc

SEQ ID NO: 6555 - DNA, 1815 bp, Homo sapiens
atggggccaaaattcagacttgagtatgttctttgaataccttaagaagttacaattagccgggcatggtggcccgtgcctgtagtcccagctacttgagaggctgaggcaggagaatcacttcaacccaggaggtggaggttacagtgagcagagatcgtgccactgcactccagcctgggtgacaagagagacttgtctccaaaaaaaaagttacacctaggtgtgaattttggcacaaaggagtgacaaacttatagttaaaagctgaataacttcagtgtggtataaaacgtggtttttaggctatgtttgtgattgctgaaaagaattctagtttacctcaaaatccttctctttccccaaattaagtgcctggccagctgtcataaattacatattccttttggtttttttaaaggttacatgttcaagagtgaaaataagatgttctgtctgaaggctaccatgccggatctgtaaatgaacctgttaaatgctgtatttgctccaacggcttactatagaatgttacttaatacaatatcatacttattacaatttttactataggagtgtaataggtaaaattaatctctattttagtgggcccatgtttagtctttcaccatcctttaaactgctgtgaatttttttgtcatgacttgaaagcaaggatagagaaacactttagagatatgtggggtttttttaccattccagagcttgtgagcataatcatatttgctttatatttatagtcatgaactcctaagttggcagctacaaccaagaaccaaaaaatggtgcgttctgcttcttgtaattcatctctgctaataaattataagaagcaaggaaaattagggaaaatattttatttggatggtttctataaacaagggactataattcttgtacattatttttcatctttgctgtttctttgagcagtctaatgtgccacacaattatctaaggtatttgttttctataagaattgttttaaaagtattcttgttaccagagtagttgtattatatttcaaaacgtaagatgatttttaaaagcctgagtactgacctaagatggaattgtatgaactctgctctggagggaggggaggatgtccgtggaagttgtaagacttttatttttttgtgccatcaaatataggtaaaaataattgtgcaattctgctgtttaaacaggaactattggcctccttggccctaaatggaagggccgatattttaagttgattattttattgtaaattaatccaacctagttctttttaatttggttgaatgttttttcttgttaaatgatgtttaaaaaataaaaactggaagttcttggcttagtcataattcttatattcactgaagtgcctttatagaatgctaatattaatttcaaacttttggatgtgacatttggaagtgttggaatatctgagttcctcatttcatcataacatcaaatatatcaaagcctgctttaaagtattaccttggggatgattcatagctatttgtcagatttgcatacattaagatgccattggagctcttttgtctcgtttttgcattactgcacaatctagccatcttggtataggtggaggagcattgatgctaggggctggagaacttgaggcccgatataattttactacgccggcccagtttcttcaattgcaaaatagaagagttgaattaggatatatcagatttcccaaccttaaggagactttaaaaagaataatatcaaacctaggcattttcaactaacactggaatactaattttg

SEQ ID NO: 6556 - DNA, 1360 bp, Homo sapiens
gaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactgatttaaaaacaaaacaaaaaaaaataaaaaagttgtgcctgaaatgaatcttgtttttttttataagtagccgcctggttactgtgtcctgtaaaatacagacacttgacccttggtgtagcttctgttcaactttatatcacgggaatggatgggtctgatttcttggccctcttcttgaattggccatatacagggtccctggccagtggactgaaggctttgtctaagatgacaagggtcagctcaggggatgtgggggagggcggttttatcttcccccttgtcgtttgaggttttgatctctgggtaaagaggccgtttatctttgtaaacacgaaacatttttgctttctccagttttctgttaatggcgaaagaatggaagcgaataaagttttactgatttttgagacactagcacctagcgctttcattattgaaacgtcccgtgtgggaggggcgggtctgggtgcggcctgccgcatgactcgtggttcggaggcccacgtggccggggcggggactcaggcgcctggggcgccgactgattacgtagcgggcggggccggaagtgccgctccttggtgggggctgttcatggcggttccggggtctccaacatttttcccggctgtggtcctaaatctgtccaaagcagaggcagtggagcttgaggtaagtttatctcatgcatagtgttcggctttgggctgtggaatgttcaggcgtttcactgatgccagaaatggagcagaatctatcagctggagacaaaggccttgggcgggggtccttccatttggtgcctacgtggggagatctttggagacagaagggagaatgggaaggagttgcggcctggaggcttc

SEQ ID NO: 6557 - DNA, 1360 bp, Homo sapiens; identical to SEQ ID NO: 6556

SEQ ID NO: 6558 - DNA, 2977 bp, Homo sapiens
gtcaaatttatctaaattgtttttgcctgtgcccgcctagttgtttactggctcattgagtatgggacaaaagtatttttggttggctcatattgtgaacttgggaagaagatagtcctgtgaatattggcaacccatagtgcttaaaatttaggcaatgggattgtaaatgacagtattttttgttttaatttataaatgcagtttaaaattgttcatcagctaataaagtactgatgggagctgtgacattctcatttggttccatggtagtatttaacatttaggatttcatttaagctttaaggtgaaacttctgagtactgaaaatgtaaatatattttaagtaacataacacatttttagcagttatataaacttcctagggtcatcagcagaggactgttgtgaaatactagcttttagactttgtacctgttttacaggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcaggtaagtgccagcatctctgtatctgaatttgatccttctatgagttggtaaccaaaaccttcaaatattttcagccaaggggaaatcatcaacattcattcgtttttttatttctacttcaccttttttcagtcatttgaggtagcttaataaaaacagaaaactacacaaaaagtgactatattagcaatgagaaagtaagattggtattagtaactaatattatgcaatggggaaaataagttaggggtgagatttccagaatagaaggactatatggttttgtacacttttgcttagagcttcttttgcatatcacacaaacacagaaaccacgttcaaaagtacttaaaaaataagcttagggcaaacaaacttagtcttactcctgagatctcagggaaatctgagtcctcagaatgtttttcatcagtacagagaataataacattttgtatggctgctactataacccagcttaattctagaggggatccaaacaatatatatgttgaagtaacagcttcctgatgagtttgcttaattcaaaaagcttagttcataatatacgaaggaacaaggcaagttttatttgtttggttcaagtttgtgatatagtgaatggcactttcagagatacatttcttccctgacaggttttgccacaggcagctggactggagtatcaacattaataccatgttttatacatccttttagataggggcaggcattgtgcttcattcagagtgaggtgtggcatgccctctcttttttacctacttttttttttcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctggtgagttttgttgttgtggtttgattagtaactaccctggagtgtctcaactttatagtctctgttttgtcacatcacttttctgtgccttgtcttctgccacttattatttcttgatacttcctacttctagttgaatacaaaaagattgtttagtacatgttttttaaaatttttgccaaattcttcttcttccattaagtcatttctaggttatatgctacttaaaattctaatagtttagccatgctgattcataatgccgctttgcttccccagagacagtctcacagtctgattcggttacccaggcgctatcacgactcactgcagactcaaccccctgggcctaagcaattctcccacgtcagcttccccagtagctgggactacaagcatgcgccaccacatgcagccaattttattttttgtagagacatggtcccactgttttgcccaggctgatctcgaacttctgggctcaagtgttcctcctgccctgtcctctcaaagcgctgggattacaggtgttagctaccacatctgctaccttgtttttttatgcatctgtggaactggtcactcttgattgcattcaagtctagggtctgcaaatgattccttccattcctattaagttgggaccttgagttggggataataatacataaacaaacttgtctgtcctgtctttctagctaggtatatgaggcaagagtcccatcataaaaagtgagtcatttgggcagttaggtggaaaacacactcctttgcaagtgcttgctgtctgcccaccaagtgtggtttcttctcatcttttgacttaattacagtgagggccccaaggctgttgcagctcctcgacctgatcggttggtcaatcgcttgaagaatatcactctggatgatgccagtgctcctcgcctaatggttcttcgtcagccaaggggaccagataactcaatggtatgagggcatacaaggcttgggggaggccaactgatagaccaacataaaatatgtggtcctatttaaacaataggtcaggaaacttaatgaagcagggagacttccatattgcttataactagttaggactttctacacattggttcagccccctaacctaatggttgcttacagtaagaagcacatttcttttcttgatgctttgaagacagtttaggtaatgaatgggtcaggagtgcttactgtggattttctcctctaggaaagaattagtactgcataagatgattaaaaataatgcttttgtagtttcatttcggaatagtgaatgtactatgattgttgtgcgctcaaatcattaactgcagggttttttttttctcccccccacaggggtttggtgcagaaagaaagatccgtcaa

SEQ ID NO: 6559 - DNA, 6171 bp, Homo sapiens
tagtgcatatttgccaggaagtagcaattggagagtcttagaaaattgctcaggttaagttactttgttgaaagcaatgagtttgtacttaagtgagaacagttcaaatgtggatacagtatttgtgtcacatcagagaaaattcctgatgaatttaacttgatggtggttgtaaagttgaatgttgccttcttgacaagtttcacagccagtgaaaatattatttgggtttcagggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgtgagttgtttctgagaaaagttgggaggtgtttcttgatgctttctttttcaattgaaagttaattttgttttatcatttttaggatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggtaggttttgcataatccaaatgatttttgtagctgtttatttctcttctgctttaacagcacatagtaatagagtacatataatcagcggaagtttgtctctttcagaatttctgtcatattaacagtgaactaaacaaagtaaggtttcttaaccttgggattattgacattttgggatgaatgattctttactgtgggggatgggatgtttagcagcatttctggcctctacccactggaagttagtattctgaccccttttccctgcctcccattgtgacagccaaaaatgtgtccagacattgccaaatgtcccctgggaggcaaactcattccaagtagagaactagttatataaaatgatagtactgtcttccaggcaatttaaaactttcaaagttgggtgtatcctcagttcacacatttaaatttcatttattgaaaaatccactaaataggaaatagaaagatgtctgagatgaattctcctttcaagttaataacaaattgagagttttatagaaacaagtaattcatatagaatataaaatattgctattgaaggtcagcgatagtgctctggtgaaaattaactggtagggtatgtgatggttttactaacagatggagacaggaaagagcattcttcacagagtaaaagtatagatgagaaaaattcagggtttctttaggaagcaatgagtaactagtccgacaggaatttttttttttttttttttggttttgtgtgtgggtttttgttggtgagggaggttaggagaaataaggatgaaaaatcaggatccagctagactgggagggtgttgattgctgctctaaagaatttagaccttattgtcaggtgcggtggctcacacctgtaaacccagcactttgggaggctgaggcgggcggatcacgaggtcaggagattgagaccatcctggctaacatggtgaaaccccatctctactaaaaatacaaaaaaattagccgggcatagtagtgggcacctgtaatcccagctactcgggaggctgaggcaggagaatggcgtgaacccaggaggcagagcttttagtgagctgagatggcgccattgcactccatcctgggcgactgagtgagactccgtctccaaaaaaaaaatttagaccttgttctgtacttcaaggaaaagatttcttttggataatgacatcaggtatgtgctttgggagagtaatggcagcaatatgaagcctagatgggatggagaaagacaaaagatgaaaaggattactatgaaattacttggatagttaaggtagtccttgaactaggcacacagatagtgactatagacaagtgaaggtacatgagagatactggaaagtcatgttataatttaataattgctattagccagaaagagcaaggctagtatcttgcttatcacttactgtagcttgggaaattatttcacctctgagcttcagtttttaaatttcaaaaatgattgtgtaatagtttaaaaagccctcgaagtacctagctcataataggaatttcgcatgtgacagatgatactgttaacaaaaataaaaatacacttcagttgggcttatttttaataacttttaattcttggaatgctctgcttcccaaatgtgtctggcaaaactggcttgatgaagagagcctttgtgtgagactttccctgccattttttgtttttttttctttcttagtccaacagtaccctagtaaatcctctgtcatcatgcttcttacagtatataacatttacctgttaatgaatctgtctctgctgcactggactccctcagggcagggattctcctatctctatttaatatatttgatgtatagtatattgtcagctgttgatgttgaagttggtgagttaagagcaaaaggtgaacagtaagcttttgagtttggttgtggaaaagttgatgacattggagtcagacctgagttcactgacattgttcttaaccaaactcaaatcctctggattattttgcgctgggttttgtaaccttggtaaggtttacttaattcctcagatttccccaatttgtaaaatgagggaaaagagaaactatggagatgattttgtacaagattaatttgataatacataatacctggtaatgttgtaagtgttcaataaattattatatagcagttatggaaggaatgtgattggtagaagaggaaaatgaattggttttgaatatatcgtagtttgtaatgaggactggagtttaggaaggaagtcagggctagagtagggacatgggcattatcttcatagaaatgttgaaaccataaaatcagtataatttatgtagttgctgtacactgtcattacttaacggtgtgattcaatacgacacacctgaactttcttagacttttatttttttagtcaagtgcagtagtgagaaggggggaaagaggagaacaaggaagttcgatctgtaactgactgaacaatcgagataacccactaccttcagaccagcccttagattttttaagagttaatcattcttacacgtacgatgactgaaatgttgtttctccttgaagtctggtattaaaaaaaattgttgaaatactagtatgtcataatttttaatcatctactttatgtcaagtacttgaactgtgctagatcatacaccaaattatcctgcattgttaagtatattgattgacattatatattaaatactgtgcaaggtgctgtgtgctactaaaagaggatacttcagcagcttctttaggaaatactaaagcttcttgcccttatagaatttccacttccttggaagtaacatgcccagtttaatttctgattggctatgaggagcgcaggtgtattaaacattttcagtaagcttttttctcctcaatagcaaaaattagattcttaagattgaaagaccaattaaaaattacagcagactgagctaggcttaaggcaagactaccttttattcatatgaataatcttttagaaaatgctggaataagacatttttacagctgtaccaatcctttggcacaagaatatgtaagaactatagttgtttttattggtttttgttcttgagattgttttcattctgtttttgactgtatctctttaggaggctgaggatggcattattgcttatgatgactgtggggtgaaactgactattgcttttcaagccaaggatgtggaaggatctacttctcctcaaataggagataaggcaagataattctgctcattcgagagagggttaagagttgtcatcttaatcataaatcctgcaggatgggttcttcaaattttatcaagttttgctgaaatatattttgtgtttaagagaaatacatgaatatcttgtatttgaaagcagcttattaaaagtgtctgtcaagctctttgttaatcaaagccttgttaatctagctgtttaaacgttagataaaacatgcttaataaaatcgttattggtaagaaagttaaaacagttactactgaaacattatcaaagtaaaagcacaccaaagattttacgttgttgttcattttttctcatacttaatatgtttggtttttggatagccctctagagaaattcagaatctataaggaatacagactgaaagataaaagtttgatcctttgtgaaaagtgggatgagacataaatgttttggtgaaaatcaatttcattgaagtaataacaaaggatatttggaatgaaaagcatgcgctgggggagttataggtcttgttttctgagttaaggagattggtgtggaagtgatatggtgttaatgagcatccttaattttcacaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacaggtaaggcgtgactttcaggaactttacagctaacttaccatccattctttggtgttggaataaaaaacatttagtattgattgattatacttgttgaggttcagatttcatattggtagaattatggcaagatataaactgaagttaatcactgatcttactatatacagagcctgtggccaaaagaaatagaaaggcctgtgccaccttattttttgtgttggtaccatagagttggccatttggtgtataatgtagtgtaagagtaaggggtctgactgggtgtggtggctcatgcctataatcccagcactttgggggctgaggcaggtggatcccttgagcccaggagttcgaggccagcctgagcaacacggtgaaactccatctccacaaaaattaccaaaattagcctgacatggtggtgcatacctgtagtctcaccaactcaggaggctgatgtgggaggaccacttgatcctgggaggcagaggttgcagtaagctgagatcgcaccactgtactccagcctagccaacagagtgagactctgtctcaaaaaaaaaaatagaaagtaagggttcttagaaccagacagttcagtttttgaatccaggccctgccactttatacctgtgtaatttttaccaaataacttcttggtatcttagtttcattatcctgaagttagggataatgttacctcttcatggggcattcttgaggattaaatgagtcaatacatagaaattacttaaaatggtgtctaatgtaaataagcatgccatgccatgactgttactgtaaaataaagactgcctgttactgttgatgtttatggtaatgtttagttaaatgtcatttcctttctccttagtgagttctctggtgatgttgatagcctggaactgggggacatggtcgagtatagcttgtccaaaggcaaaggcaacaaagtcagtgcagaaaaagtgaacaaaacacactcaggtaataaattgtgacttcttattcagcctgtgcttttaagtgggagataaaggatggagtagtagagggagatgaggcctaattattctacatcagtcattctcatgtgcgattccatagaacagcagcatcacctggttgcttgttagaaatatacgttctctgaccctatcccatacccactgaaactctgtgagtgggcattcttttttaataaatcctttaggtgattctggtatacactgaagtttgagaaggattggcctagatattttaggaaatttgctttatattttcaattcattgtcttcttttgaaaaataaacccaggatagccagctgtggtagtggatgcctgtagtcacagttacttgggaggctgaggtgggagggccgcttgtgctggtaggttgagactgcagtgagccatgatgatcctaccactgcactccaacctgggtgacagagcaagactgtctgaaaaaaacaaaaataaccccaagatatg

SEQ ID NO: 6560 - DNA, 6466 bp, Homo sapiens
aatagctaacaagatgcatgctataggaacattgttttggttaatcctcatggcagtcctgttaggaattattctccttttacataagagaaaactgaggtacagaggagtttaaaaaaaaaactcgccaaaggttatgattgttaagtcatctcatttgtagtatgtgtaaatgccataaaaactaagattaagacatggctatcttagcataagatggtggttctgaaacatttgtgtgtatcagaattagtggaaggcttgttaaaacacagattgctatacttgatccccagagtttgtctttggctaggactagagttaggcccagtatttcttttaagctcccaggtgatgttaatgctgctggtccagggaccacactttgaaaaccactggtctaaggcaattcaaatgctatgttaagtatagcttggaagcaatatatcgtttcgcaaaaatcagttcaacaaacataacacattatttatttttagatgatgttgaatttgaagtatcatcggaccgacggactgggaaacccattgctgttaaactggtgaagataaaacaagaaatcctccctgaagaacgaatgaatggacaagttagtgactttgatgctttgtgtttttttagggccctgcatttgcatatctttcacattagaaaaggaagattctccccatctcctcagtttgcacgaaagagagctatagtatataaagattactattttaaaattaatcaaaagcactggcatttcttgacctgaaataaaaatatggtcaagactcaattgggtttttacatataaccctgagtcaatgcttacagtcaatttacatactgtaagtttgaaacttggcagcatgacatcctcttgtggatcatattaaaatgcatccctgtatatagtatagaggatattaaaattcagtttatattgcacagtgctgctcctgaaatgattagcaatggaaatttttttttttttgactggtaggttgtgtgcgctgttcctcacaacttagagagtaaatctccagctgccccgggtcagagtccaacagggagtgtatgctacgaacgtaatggggtaaacttgtgtatttttcttaaacctttgcctgatccaccatgtgatctataagcgtactttaaaattcaaaatagaaaacgtaagctgcaattgttaaaatcagttttaaatttggtttctaagaggcttcaaatgcagcataatcaaaaaatttaaaaagaaaaattccataggacttccaagtgtcttagtttgcccaagtatgaccttagttagaacattaaggtaaaatgttccttttaatcacttttttgggggttgtgggggggatctttttctggtttcttttaagcactaacaccagctttttttgtttggaatgccttatataaaattgtttttttgaaatgtaactatagtctctgggcaaatgcttccacgtgtgtaagctttttgaagttggattgctgctcagctgtggactcgcagaagtcatcagcaccatggaggggaagtgtgtgtttatatgaataaagtgacttgtcataaagcatttaattttaagaaatttggcttaaaatgccagtataagaggtttttaagtaagtaaatcacagtatacagtgaatatgcatcctgccaaaatagtaataatgatttattaattcacaggaagtgttttatctgacttacacccctgaagatgtcgaagggaacgttcagctggaaactggagataaaataaactttgtaattgataacaataaacagtaagttctttttttttaaattttctcacctaagcggtttttttttcccccctccattaagaaatttgaatagagttaaaaacctaacttgtaagtctggatagttttcatgaactttcaattcatcaactaatgctttgaggtctatgaatattgtattacagccatgatgcagggtctcagaggaagatgataattaaaacattgttaggcattttaaggacttgttctagagatcagtgaaggtttttcaaaaaatagtgctttgaggtaagttttgagggaggggtatagtcactatagagaggtgagaaaaaagcattatgattagaagtatcatgacatgttgggggaaaatggccaaaagtttggtcgaactgaccagaaggtaaagtttgagcattcttctatgtaggaatctgcgttgtttaaaacaaggaagtgtgattggtttagatctttggaggtggtggaagtggtagacttttgaaaggtggggatgctgttgaccagaggcagtgatgtgagagttaacgtgaaagatgaccgcctgatatggatagactaagaggatggggtggaggagtcaagtcatattgagaagatagaatcatcaatcttaattgatttgataaaggtggggttggaattaaagggagtcccaaatactgtttttctggcctggcctactgggcagatgatggtaccataaactgggctaaggagacataaggagaatgttcaaggtgggaaaagaatcatacttatcttggcaatttttgagtgtgagatgtttgtgatatatctgggtagagatatcaaatctacagttgcgtgtataggtctgagacttagacctattaagtctaaggtctatttcctgcctataggggaagtatatagagctgtagaattcatcagcatacacagttaaggaaaatgtagttaagaaagcccagggagaatattatttttatcttggcataggagagatgagagatgcaagaggagaaggaaattaaaatagaaagttggagaaagtgctagtaatgtaccttccagtagcatgtggagggaaaagtcctaagagcatgtctgggattatctgccttgaaccttatctctttcttggcaagccttgaaggaatcagattgtgttgtaggtgtggttattattagttacagtctgaaggcctcaatttatatagttgttaatctcagaacagccttacctggtaagtttcttcatctgtaaaatgacgtataagttctcacaaagttacttgtcgatgttcatactgcttttaaatagcaggcatttaaattcccatctgactctaaagcgttttcactgcagtaagttacaaaaacaggtagaatttttctggtgtctttgttagtctgtaacatttttttaaataaaaagcacattttgggttatttgtctgtgaaaaattaagggaagtaattgcttggtgtataggtcttttcttaaaacatttagactaacagtaccattatgtcttatacagtctatgttatcttaaaaacaaaattgaatttacatcgctgctacacaaatatgaaggcataaaagcaacatgtggtgtctctaacttgtttccattctccaatggaggtggatatcattacttttaaaagcatagcaagttctcttaaagtcacttcatttactcaacttttatggctgtttactcagaaataattaatgagatagctactaaatttagcactcactgaaaatagagaccatctcctatttatctctgtatcaccagtaccttactttgccgcagattatacctacacaaatgtttgtttaatgaataacctttataagactttagtattccccacctttggtagcattcgctttgtggctttatttcagttattttgttgaaatagaaaaacagagtagaacatcacgcacccatgtgtaagtttgtaaaaaagcaaatcttccaacaacagtcccagagaaagatgacctatatatatatttgccaaacgtagaaggctaaggagttaaagtcctttgcatataaagccatatgaaaataatcaaatgtcataaaccctgtatttattcttagtgatgatagaattcttaaagccccaggaaactagtttctttagactcatatctaagcaggccaatacatttttaatccctgtttcattcctcctccctgcaattattttttttctagtactggtgctgtaagtgctcgcaacattatgctgttgaaaaagaaacaagcccgctgtcagggagtagtttgtgccatgaaggtaagtgttaaatttgagaaacttgagttttctttggccacttgaaatgttgtacttcaaactccagcctttgtttttttttttcttttttatcttacccttttaaaatatttcactgttaacctcaaaagtagtctcttaaaattccttggttgctaatacattatcttctttaaaattggctgtttaattgataatattaggttgtaccaaattatattattgtgactacagtataattttacaaaaattactggttttaagttgtaatcataaatttgtacagagtggtaataatgttcttggttttttattttgcttcaggaggcatttggctttattgaaagaggtgatgttgtaaaagagatattctttcactatagtgaatttaagggtgacttagaaaccttacagcctggcgatgatgtggaattcacaatcaaggacagaaatgtaagacagtcagttaacttgatctttggccttttaagatcagagttggtttatgtttttaagaaacacttaaaattatgtgattcttccttcctctgtccccccaccacctccaaccccttctgatttagggtaaagaagttgcaacagatgtcagactattgcctcaaggaacagtcatttttgaagatatcagcattgaacattttgaaggaactgtaaccaaagttatcccaaaagtacccagtaaaaaccaggtaaataatctttttcaggagagtcctatttcgcctcagtagtaatagaataatatggtgtggtatactgagattttatcttattcagttaatataatgtggtagtggaacaactaaggacctcttgttacgtatatttaaactaaaagagaaaccagatttatatattcataaatatggtgtttttttttttttttttctttttttgtgacagagtctcgctctgtcgccaggctggagtgcagtggcgcgatctcggctcactgcaacctccgcctcccgggtttaagcgattctcctgcctcagcctcccaagtagctgggactacaagggcatgccaccacacccagctaatttttgtattcttagtaaagacggggtttcaccctgttggcaaggatggtctcgatctcttgaccttgcgatctgtccaccttggcctcccaaagtgctgggattacaagtatgagccacctcgcccagccaaatatgtatttttttttactgggtgatgaaaaaaggccaaagaagaaaatgctaattaaattggaaagcacctgattggattagactgcagttcaggtgtacatttgttccctcctctgcccctgccctacccctccagtttgtggggaaggtgaggacacaagtggtgtcattcctggaaaaattccttaaataaaatcttttggtaccagagtgctgggtcttaattgcattgttgtaattttatggttgactcgtgtgaccatagaccatgaagctttcacattggacttatgttgtcaacaccttttttcgcttcagggaactaagttaaaaataacatgggtttactatgtgttcttcttgtttgacttagaactaggaaggatgagaaatctccagctaaaatcgtttttccttctcatcagaatgacccattgccaggacgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcactaatgaagcccgagaaatggtaagtgttggatattactggatatgtatctaatatgcgaaagccaatgttatattcaagtttatactactaaattaaaatttttcttaagttaaatgaccctaatgggcatttaccttgttaaggtgattaagaatcatacacatttgagtcagtctgggttatctctggcagttatcttggaaatatatgtgaaaaaattttttgaatggaaatctggacaggattactaagatatttttagagtcagtgattctcaggcccttaatatgaagagtaagaaaattcaagttcatcattgtagaaagtagattttcccaaactatttcctaagacatttaattagtggtttctgtttttaggaaacacaattcttcctccagtgtggtccagggaagccaaaagattgaacacccatgatctagacactagatcacacataaaatacactaacagcaatgatagctgatgagcttttttaaaaaaaaaatcataggcac

SEQ ID NO: 6561 - DNA, 1126 bp, Homo sapiens
aacttgaaatatgccttccaaatgcatgacttactaaacagtattaaggtattggctgaagtttcaaaatagcgttaccaaatctcttaagagtctttggtagtttgtggtcgctgtctcttaatattaattacctttgttctgaaattgttgttttagtaattttcacttcatgtaaaggcagcatttgctaatgtagttgctataccttaatattaaaccccagaaattctatttttgtctgataagtggaaattctaccataatttggggcaattccccaatataataagttgtttcctctgaaatgttttattagctaaattaatgctgcagtaataaagtctataatcttcccttcattttacttttttttgcgtttttatatggaagatttagtgacttattaaccagacttaatatgctatggagataatgtacagatatgtatatattctttttctttttaaaacagatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggaggtaatctgtcagttctcctttgtaaaaatgtaatcacaaaatttgtcttgcatatcaatttgttcatgagtgtttttcaaaaagttttatgtaaattaaaacattttggacttttagttgtactgtttagtgaagaatatctgtataaaccagcagaatccttgaaagattatatttgcatatatttacaataaatgcttggaagatttcattgtttttccccataatgatgactgtttacccgtaagattttaagccagtacgaatattgaacttttgtaatgttacttatgattattctgtcaggtactattttgggtagtacctgaaaaaagtaatccttagagtgtcacctcttagaagctgggcgcggtggcttacgcctgtaatcccagcactttgggaggccgaggcgggcagatcacgaggtcaggagatagagaccatcctgg

SEQ ID NO: 6562 - DNA, 1087 bp, Homo sapiens
aatttgacaaaaaaaacacttccaagtgtgagcattttttatttcatttcccaagagtaagtaagtaactattagcccagccatctgcctcgaagtataccttaagtgaccccataaatccattcaagaggcaggtactctataccatttggcagccacggccaaacctaccatggccagatttcagtgaaaatgatgaagtaatcaaatcaaggtataatatggtgtccctttatgtgctttatgttcctttagagctgtttataaagttctttatatctcaagtgttaggataaatcgacatactaacttttccccctgcaaaattaaaagcctgaggtacaagtctaagaagcttttagtgctctacataatataaattctggctggtgttaatgctatgaagataatatgtagttagaaaattgagtcggggaggaatgctcttcattttaagtggattttaaagtttctccttgagtggatgaagaacttgcctggtttgcaaaaatcttagttcaaaattatattttctaacaaaaactgcattttgagaagataagctaattttactcagtagtaagtcaaatgaggaagtgcagagggtttttttacatatatatagcaaccttgtcaagtggtcctcacaagagtcataaatactttgtaattagcacagtatattcagcagtgtataactctacaaatagtaccttatattagtgtagtattatatcaatatcttatgtataattcttatattaataccttatgcataattggattcaaacattgaaggtctattttagtgttcttcaaaatgtgcttccctgacctactgaaatagaaacttggtgatgaagttcaagaatttgtattctaatcatctcaaacaattcctaaagacactgattttaaaatatctagtctaggccccattgtgtaatagttagcactctaaaagatgaaaaagaaaatagtctatgtgccaaccacttcattagtacttatgaatttaaaaatgaaaaagtctggtacaggagacaagtatatatataaaattataatgcagtgtgataaatccatt

SEQ ID NO: 6563 - DNA, 1245 bp, Homo sapiens
ggacttcgtaagcctttataacccagcgtgaattggaaagaagatgcaggaggtttatctctatagatgagctctcacaagattagtctaatacctgggttgcgcattgcagggcaaacagctccaggccctcagagctgctcaaggcttttcaacccaggggatgataatcaatgttatgtcaatgaatcagccaaacagacagaaagatcacattatgttttctctgtttgaaaaggtaaatacctcatacattttgaaaatttcaatgaaaatcgtttgagttaagaagttctaatatttaaagagttaagctttcattttctggaagcctttgtgaatagggctgggtagatgcagcgggccctgcatgttcactgccctttgtagcttttacaaatgacctgtgtcatgtcatcctcactgtcttctccccaccaggatgacaactggggagagaccaccacggccatcacaggcacctcggagcacagcatatcccaagaggacattgccaggatcagcaaggacatggaggacagcgtggggctggattgcaaacgctacctgggcctcaccgtcgcctcttttcttggacttctagttttcctcacccctattgccttcatccttttacctccgatcctgtggagggatgagctggagccttgtggcacaatttgtgaggggctctttatctccatggcattcaaactcctcattctgctcatagggacctgggcactttttttccgcaagcggagagctgacatgccacgggtgtttgtgtttcgtgcccttttgttggtcctcatctttctctttgtggtttcctattggcttttttacggggtccgcattttggactctcgggaccggaattaccagggcattgtgcaatatgcagtctcccttgtggatgccctcctcttcatccattacctggccatcgtcctgctggagctcaggcagctgcagcccatgttcacgctgcaggtggtccgctccaccgatggcgagtcccgcttctacagcctgggacacctgaggtaagaggcaacatccaggaggcagaaaggatggctgatgtcttgctgggagacagctgctctgtagcacgtgaggggtggtgacagatgccaagagctaggaccagagtctgactcttttctggtttggggaggagatgcgagggtggggagggtgtccatgttcattgagtttctggacttctagatggtgcgg

SEQ ID NO: 6564 - DNA, 1127 bp, Homo sapiens
ttgtcagtgatgaggctgtgactaatggattacgggatggaattgtgttcgtccttaagtgcttggacttcagcctcgtagtcaatgtgaagaaaattccattcatcatactctctgaagagttcatagaccccaaatctcacaaatttgtccttcgcttacagtctgagacatccgtttaaaagttctatatttgtggctttattaaaaaaaaaagaaaaatatatagagagatatatatctatgccagaggggtgtcttttttaaaaattcttcttcattgctgactgaaactggcagatgattgaccagtatcctttgaccatctgcactttatttggaaggaagcaggggctgtccaccctgaaaaagagtgactgatgacatctgacttttgtcgatgggacttctcaagaagccattccttggagcttctgttacagctgtaaaccaaagtggagctggtgcttcttgggagcctcgccttacaactaattcctgcctttcgtccagtaccaagtcccccgttgcttctggtcagcccacttgtagacttccaggggacacatctttattctgtttcaggaaaccagtcacgacacgtccacatatgtatttgtgtatgttaatgtccagtatcacatcacccatgaaagtcgtgggcagttcaggagatacctgccttcatctttgttctttgttgccttaggttcttcagagaaagatcacaacaaaaaatgtacactgtcgtttacagctattaagtgatttgattttgtttttttcccaaagagaaaacctacctgccctgtttctgatcccacccctctgctggcttgaagcaggtaaccctttcccagccctgcagctgcccacctggcctccatgccatcctgcccccacctggctggcagccctggctctccatgtgtgccctccggctctgtgtgaagcctcaagtcagtcccagcattgtttccatagggaagtgtggggtgcccagcaggtaaagcacagggagagagggcagtgggaatgccacctttaggctgcagcaggagccccacactgcccagttttcctccccactgttctacaccaaccaggggagactaacactgtgactc

SEQ ID NO: 6565 - DNA, 1164 bp, Homo sapiens
tgtgtttctgtttataaaaaacacataccatggaaccatggtgcttttgttcttagtttttgccgttagatcccttcaaactggaagttccttacaatatctttctcaggaaatattttgggaaatggggtaagagatggcaagtgtgagacgggctgtgtcagaggttgctacgtcatggatacagtgcagttccaagtgccataagtgtatgtacatatagttaataatgacactgttcatcaccattctaaaatactgttcttccaaccctatcttcaatgaccagtccagaaggggttaagctggattcatttgctctggcatgtgcattcccagcagggtgaagaaaggtttaaattaaagaatttattttctctctcccccttcctctttctcccagtctttgcataggagaatgttagacattcagaaattactgtttctgttttaaattgagtattgatttttttatattgactttgtattgagttctttttgaaagaataacaaaataaaatgcaggatctttgtaaagcctttgcactttcaacctctttatagcttgagttacttttgcagtgggaacaatgtaaatgacatttaaaagatttaaggtttcagaaagctgcatcccacaattgaacacaatgcatttttatttcaattcttggaactggtaggctattctttttaaaagggggtaaacttcgccctaaggctggtagaatgtatgttcacattatagtagacaggatttcatttgccttatatgtttatagattttttataattttcatcctacgttattaaaattagagcattgagtgttaaagaacttaatgaggagtctatatctgagattgctctcttccctggtgatgttttaactggtagataatttgttcttaaatatgtacttttgaagataggacagtttttatagtccatgaactgaatgttaaaaagttctgtatgcattctcagagaggattttaaagctatatagttcatccatcctttgcattatcaaaatgttaagtcaaatctgtaatactttggctaaaattcataaagtaagccctagagaaaatacttgaccaccaaatttttgcccaactatcatcacctcccttcccccgcctctgttcttgccttttgaca

SEQ ID NO: 6566 - DNA, 1246 bp, Homo sapiens
cacccgagcgccagccccctccagcatccctgagtcccagaggagatcgccgaagcgctggaaaagccgttccgcccacgacttctggtgccgggtcggcggcgactgggggagcccagttccgagaccgtaccgcacccactgcggacctcctgggccctacatagtaggcgggtcatgcagggcagcgggaggaggggcgtgggagggccaaggccgccgagtccccgctgttcagccagcaggagcgccccgcagccctcccgggacacggtggacacgcttgtcccagacctgggcgccctcctgccgggagccaggactggccgcagcaggcgctgtccgggcccgtgggcggggtttcgggagggggcggagccaggcccacggccggtgtcaggttgctccggtaacggtgacgtttcgcggcgtgggcggggccagcacgcaggttgcatattttaggaagtgaggaggaggcgcgggctggagctgcggcggggtctggggcgcagagcagcggcgggaggaggcggacacgtggcaacagcggtagcagcccgggcggcggcagcaacagcggcggcggcatcggcccgagccgccggccgccctcccaccctcccgccccgcggcagccctagctccctccacttggctcccctggtcccgctcgctcggccgggagctgctctgtgcttttctctctgattctccagcgacaggacccggcgccgggcactgagcaccgccaccatggggaagggggtgagtgtccggcgcgcccggggagggggctcggggagccctcgaggggaagaggaggaagtcgggagggcgaccgcggccagcgggaggcggcggaggaggaagcggcgccgcgtggagtgggctggcagagccgcgcggcttaaaagacgacgcagtttggaaatggagggagcgcagtaacggggggcgggggaagggagcgccgaggggctggagcgcggcattgcttaggggggtgggcggaccctgggcgggggctgcgcgccccggaggccgagcgggccgggggctccgagaggcggtgcttgggaagcctcggggccgggaggagggggcttgcagcagcgggggcggccccgggactgagccggcatccctgagcctggctcccctccctgcgaccgccgtcacctccttctccttccttttccctccgccctccgtgccctgaggaaaggcgcgctcctccccttcc

SEQ ID NO: 6567 - DNA, 1179 bp, Homo sapiens
tcaaagaactgctatatattaaaagagatcatagcagctgtacagatctcatctagtcgtagaggttaatgttgaacatatactttttaaaagctgttagagggtaggaaaagttattcagtcactctggcataaccagagataacagaaggaacttaggttgataccatgagtctttgcttttctctgtattatatcaaacattgggaaattcagcctctccaggcgatggaagcttccatagacttaacctgtctagaatcgacctggtcatcagagaaggcagataaggttttactagatccctgagagctgctgggtttctctgaagtgttatggcaaatagtaatgggccacggtcactcagctttagccattctccagtgaagagctgtcaatgataactgtgtggttgcaaagccacaaagcgatggtgaaaattgtaccaacttatgcactgaagaaaacatctgcactttgtttaataagcttaatgatagtaatgaataatgctattttttctgtcatttttttatactacactgtttaactattttctttgtttctgttttcccttaggatgatcataaacttagccttgatgaacttcatcgtaaatatggaacagacttgagccgggtatgttctagtttgaaagctgttgtacaaaatcctagttttccgtattatattttcccctgtattacatacaggtctaacctcaggggctctagtaagaaaatgacagacaccatctgcgtatctaccatgtgacatgcacagaatttgggcatttatatgctaccgtttcttttccctgaaactttttgaaagtagatgttattttcttttccctattttatagcagttgagagccagtaagtgggaacaccaggacttgcagttggcttcaaagccatgcttatgccttgaccttttgatgataaattttccctttatttttctacatttgttaaatagagttgaatctttcacctagttgaatcttcaacaattcccatttttgcacttttcccagctagcccattgcagtgtgttatggttatactatcatttgtttagttattctatcatttagttggaaattgttttgtacaaaaattaaagaaaccttttcataaaataggcgttatgtatccttgttatgtagaggatttt

SEQ ID NO: 6568 - DNA, 1359 bp, Homo sapiens
tgggtgtggtgctatcagccgttgtaatcataactggttgcttctcctactatcaagaagctaaaagttcaaagatcatggaatccttcaaaaacatggtccctcaggtaccagacgctttgtccttccccagtggatgacttgacagccccaagcatgtcagcctgtgaattagtgtgaagttaaggttttccaagtattacatgactcatcagagagatggatgtcttctaccccacccaaaaccaacctattttccttctatccaaaaagtggtagcctttcttttgaatgtaaactctgaatacaggcacaccatgtaacagcaatatctcttaaactggcgagcaagcttttgtaacttgtgtaaataaaaaagtgaataatatctttgttttgtattcaggtaattaggattatgactatttttattttcttgttttggacactaccttctctttgttggtatactaacggtgtaaattgtttcttttccaaagcaagcccttgtgattcgaaatggtgagaaaatgagcataaatgcggaggaagttgtggttggggatctggtggaagtaaaaggaggagaccgaattcctgctgacctcagaatcatatctgcaaatggctgcaaggtagctcttttattttaacaaacctcatagctagctctgctgttcgggcagcttgatttgaggggtacagtagcccatgataaggctggtgtattcacatgacatttttcttcttttcctcacatataggtggataactcctcgctcactggtgaatcagaaccccagactaggtctccagatttcacaaatgaaaaccccctggagacgaggaacattgccttcttttcaaccaattgtgttgaaggtaggccatttttgggcactttgagcatggcgtggtatttctcttgggcattaacaaaatcaaaaccataggcacaatctcttgttttattggctccatttctgagaacttgtgtcaagcacagagcagaggtgttttcctagctggcaggaaaccttgtggcagtttcccttccctccacctccaccctgcctcttctgtcaacaacaccagtctggcatgggtgttggagctgctgtcctgctactggagagaagtccctttgccaaacagcatgtacagccaaagagctggcccttaaaaagtgcttttatcaactctttttgtttttttagtcatcctatgtaattgtgtaaaatccgtggcttccttcaggttagatacaattaggtacagttctccctccccttctttttaaggcaccgcacgtggtattgttgtctacactggggatcgcactgtgatgggaagaattgc

SEQ ID NO: 6569 - DNA, 1174 bp, Homo sapiens
atggtcaccctgactcagatcagcttgcacgaatgttacactcttccgctatcctattctaaggtattgccaacttatgttttattctggatgtttgatatagttcttcttgagagccacatcacgtggtgaattttgacagtgagaaaacctcagcatttgtttatacgtaagataaccccaaagcatacattttgcttttaaattatcacgtggtcctgaacagtgcagtggagaaaggagaagaacttgggatcaagtagggggatagaatatggtagaatcctgttattatttttcttaatagattgcttttctggaaggaaggggaagcctcatgtatgggttccccttattatttcttcaaacttcagaagaaggttggagagatttaattttagacaaatttcttccacattaggatatagcaagaatctgtatagaattccagcctggttgagtgaagtaataatcttcctaatattttttaggtctgtctgacacttactgccaaacgcatggcaaggaaaaactgcttagtgaagaacttagaagctgtggagaccttggggtccacgtccaccatctgctctgataaaactggaactctgactcagaaccggatgacagtggcccacatgtggtttgacaatcaaatccatgaagctgatacgacagagaatcagagtggtaaggccagggttaccacacacctcagccacctgctgacttcgcttggttttttttcttttaagaaattgcatgaaatttcttttttttttttaagctcatggcagctttttctttcttttttgttttttttttttttatcatttagtgaagagtcaagggtatgggatattgattttttgcatgtcagtagaaactttaaattgccctacaaacgtgactgaagaatgcctaaaatgtgattggtttcattaattgggaaatgagatgtatcactgcagatttctatgggactttaataggagaactgagaacacagcctttgaagttaatgcattgttgttctgttgtgttttcttgcctccatcaggtgtctcttttgacaagacttcagctacctggcttgctctgtccagaattgcaggtctttgtaacagggcagtgtttcaggctaaccaggaaaacctacctattcttaaggtat

SEQ ID NO: 6570 - DNA, 1173 bp, Homo sapiens
gctcagtaatatgtttcagttaaatgaacaagagagcagaggtatggccttgatgtttccagagaaggcagctgaggcagataattccatgatttgccaaatccaaataacttaatgtcatcatcagtgggcaagtctagaaccctaatatcctggtgctcaaaattagtgttatcaattcagtcttctccacattaaacaatttccaattcctttgaggcctggtgtgatggattctgtctttcaaatgctttttttctttcagtgactctatcgttcataaatgttaaataaaaccctcactctgttataaaaatatagactttaaaaattttccaaagtaaacactccagagaaaggtaggcgggctgaataggctgctgttgtccttcttactgcccagcgtcactgaaattttcaaaggctcctgtcctcctcgcaggtttctgccacctctttctgccagatgaacagtttcctgaagggttccagtttgacactgacgatgtgaatttccctatcgataatctgtgctttgttgggctcatctccatgattgaccctccacgggcggccgttcctgatgccgtgggcaaatgtcgaagtgctggaattaaggtagtgcccaggcgcctccttggcttcatctcttagtgccttgggacaccctactcagtgaatgttgccttttgaggtccagatggccagctgttctatctcacctggagtattaatttctcatctccaaagctttacttccacccagaaaagaccagatagtattaaaatatgatggtgtaaacacacgaggaattaaaaattttttggaaagcaattgtgtaaaaaagaaatgtaagcaaagtaaaaacagcaaaagacttgaagttttaaaatacttgcattattctaagttaatgtaccttatgcaatgaatggcatatcttctgtgttttcagttaactgtttgttaatgagtgtttggtgtcctctgtgtatctgtctttttttaagtagctgaatattactcaagtgcactaatatcctgttgctgggtatttggtttctgttttttactctcaggattttattttatttattttttgagacagagtcttgctctattgcccaggctggaatgtcatagcacgatctcggctcactgcaacctccgcc

SEQ ID NO: 6571 - DNA, 1106 bp, Homo sapiens
tattctaagtataatcactgcatcaaaaaataacaattttgaattcttgtcacatgttgcttttcctccaagttgtgccaatttgagaatgctagccagtagcatgtggtgtcttcacagtcccaccagcatcagatttttatcctttttttttttttttttttttgctggttttagtaattttcaagtatttttatgtaactctgtagaaggaaaaatagacattgtgtatgctagtgattgtataccaagataaaacctgagtattgcctttgtgtttcctttctgtggatatatatgtttatatttttggctaatcgatgtttattagttttatatttgcattcctttccttttgatagtctaagccgaatcatccttagtatttactcttgcctactggatataagactttaaggtcatttacttggcagttgcattcaacacattgtcttgtttattacaggtcatcatggtcacaggagaccatccaatcacagctaaagctattgccaaaggtgtgggcatcatctcagaaggcaatgagaccgtggaagacattgctgcccgcctcaacatcccagtcagccaggtgaaccccaggtaaggcaggaagctcaaatcacagtctgctgtgaacaagcaaatagtgatggtttaaaatcttcagcgtggttctataatggtttgcatctaggcttgctctgagtaggaaatgtacctgcactgccagaaagcaaccttgtcattcctaagaagggttttaagtaagagcaagtcataataattagcacttagatggtatttactgttctaagagcttgatatggtgacctattatttgcagagcagggaaggtaaggattcaagaggcttttgaagtacctcagaactggtgaaatcatgcagtaaattcagcagtctagcttctgatttcatgctgttaaccactgagctctactgcctagcacctagcatcttgacactttccaggtccacactaacaaaataaaataaggaagggacaattacttaggccattcaggcaaacacaggagacatttggcaatgaagtaaaacagataatagcaaattggttttgtttt

SEQ ID NO: 6572 - DNA, 1147 bp, Homo sapiens
ctcatcatcaggcgacgccctggcggtaattatgggcattctgactttggttggaggaggagtgggaggggctatagttctattggttttttgtttccctcaaggtgtctaggctccctcagtggtcagtctgattagctaaggtgactggaccagcaaactgaccatagtcacatcttcagaatgtagatctcagttacagtttgaggactggtcatgttttagactttaaaatacaaaccaagtatgatttagtgaaaacttgtcagaatctaaaccatctttccaggtaacttggtattcctaaaaacatgtaaataagtacagttgaggtcccatgtttggattttaacacacccgacccccatcatcctccggttggttttcatccctgtttccctctgtaatgctggagcgaggaagactcactgtagtgtgtcttgtctgtctctttgccacccacaggctgggtggagaaggaaacctactattagccccccgtcctgcacgccgtggagcatcaggccacacactctgcatccgacacccaccccctctttgtgtacttcagtcttggagtttggaactctaccctggtaggaaagcaccgcagcatgtggggaagcaagacgtcctggaatgaagcatgtagctctatggggggaggggggagggctgcctgaaaaccatccatctgtggaaatgacagcggggaaggtttttatgtgcctttttgtttttgtaaaaaaggaacacccggaaagactgaaagaatacattttatatctggatttttacaaataaagatggctattataatggaatttgtctgtgccctcgtcgcttctttggtacagatgtctatgtgatctggagctgtggttttcaacatgagtccctgaccagcagtttatcagcatcacctggttgcttgctaggaaggcgggcccagacccactgagtcagaaatgcatcagcaatgtggcttaataagccctcaggtgattttgatttacattcaagtttggaaaccactggctaagaggaagcattctgcccgtgctcttttagttggagtaggtgagtttacctgacccattttttctggctgctgcctggggtgatagggctgtaactccacctgctg

SEQ ID NO: 6573 - DNA, 1068 bp, Homo sapiens
catttctatggaaatgcgatgtcagatggatggtaatggtgccctccagtggctgtgagacctcattgcgcattgtctactggagctttagtcttctgagacggaggaaaactgctgaatactctggattcatctatgtctacaatgttgcatttatgaaaaactacactgtgctaggcgcattctaggacatgaatatgaccacaccctctttcaccgggtgtttctgtagcaagttttcatattcttttcaaacaatggtttctctgcgttaattattgaggaaaaaaaaagatggggtaagaaaactacccatgcatgatgtagagagctgttgatttgtttctgtttttttaaaggaaaactatttgtaagatgttgcactaaaacattttatatacacttcagagacctgtagtaaattatgttgaaaatacggctgtttacatttactgcagtcttctatccttctttccccttactaaccagcccccttcctctgtggaactgtgctgtgggagcctacagttctgcccttggcattggcctgctaggctcaaggtctgtgaattgcagtctttattattacaccccataaccttcaaatgataaaaacacctcttcctcaagacacttcactgccatctgctgcaacatatagtaaatagacacctccaccccgatgatcaaggctatgctacctctagagctgtgcaacacacaacacacctagcccctgaaagccaggttcagaatgtagatcttataacctgtagcgtttttgttggggggtggggtgggggtagaagccggatgagaaggagagcaggaacacaggatggccttctctagggcctctgcggcaagtccacaccatccttttccaactatgaagtgctgccctggccatgaaatgcagcggggatttcccagaatggtgataaaagcaggagttgtgcattctagttaagtgagactgcacagcgcactggtctctgtttcctcttccagtgttgggaggggtttacatctgcaaattgagaagaatgttagaatgattaaaaccat

SEQ ID NO: 6574 - DNA, 1116 bp, Homo sapiens
ttggacagttgacagcacccaaactctggggtgcatgtgtgtggaaagttgtcagacttgaaaagtgttccaagttcccagtcagtcacagagacagactgcctctcggtggcagtcttggttggttagctatttgcgcgcaaatgttgtgatcctgccattatagatttcttgtttctgtttttagtaatgtagtgagtagctccaggtgccacatctactcacagatttatctagtattctcagatagatgttacagggcttcttattctttgtaatgtactctttttaaatccctttagtttaccctttttggattccttaatgtggacgaatttctcttacgtacaactgacagcaaaaggaagggcgaactttctagtgacaaggaatctcttccaagactttgtttttgcacatttgaaaatgccacccatggatcaaaatatacccaaacgttttttactttcttaacaagacttaagaattgtgtgtagtgtgggcaaaatttgtatgttgtcttttccctcagctggagttattggaaccactttgtagtcaagacgaaagcactgaattttgcttcaaagaactgtgtatgtacaagagaaatcctgcataaccccattaggagtagatggtgcccggcctatctgtcagggaggcaaaaaaggcttcatcccatccttgccaaaaaataagaaaactgtcttggagaatgggtcagaagccccaaacggcacacactttccaaattaaagtgggcaggggctgcttttagcagctgctgacctgcagatttgtcaaagccagtgactagagaaggaagggagaaaggctggctgttggcttgctctgagctgcaaggatggtctctaactgattaactgtgagcaggtgggcctgtgtcttcaggtgctttgccaaactcttaaaagaaagtgtccagtgaacttggaagtgggcccctgagctgagcacagggccaaagcagccatggcagacacctgacggagggcacggggctggctgacactaagtttggtgggacagtgaggggtgggaggggggtttccagggcctggtgttggagagtgcagagaaatatctacctcc

SEQ ID NO: 6575 - DNA, 3099 bp, Homo sapiens
cccaaagcggcctccctcgcagcactgactggcttcccctttgatctctccctcccagtgctgaacgccttcaagtatcccttgctgatcggcgtcggtctgtccacggtcatcgggctcctgtcctgtctcatcgggtactgcagctcccactggtgttgtaagaaggaggttcaggagacacggcgcgagcgccgcaggctcatgtcgatggagatggactaggctggcccgggaggggagtgacagagggacgttctaggagcaattggggcaagaagaggacagtgatattttaaaacaaagtgtgttacactaaaaaccagtcctctctaatctcaggtgggacttggcgctctctcttttctgcatgtcaagttctgagcgcggacatgtttaccagcacacggctcttcttcccacggcactttctgatgtaacaatcgagtgtgtgttttcccaactgcagctttttaatggttaaccttcatctaattttttttctcccactggtttatagatcctctgacttgtgtgtgtttatagcttttgtttcgcggggttgtggtgaggaaggggtgatggcatgcggagttctttatcttcagtgagaatgtgcctgcccgcctgagagccagcttccgcgttggaggcacgtgttcagagagctgctgagcgccaccctctacccggctgacagacaacacagacctgtgccgaaggctaatttgtggcttttacgaccctaccccaccccctgttttcaggggtttagactacatttgaaatccaaacttggagtatataacttcttattgagcccaactgctttttttttttttttttttgcttctctgccccttttccatttcttttgtatttgttttctgtgagagcactgaaatggcagccctggaatctacaatttggctctccactgagcaccttatcttgccaccttagccttaagaatgaatatgaagaaaaatacacagccacctctgtccagggcagtaagaagggctgcaaggaaggggaggatggggacaaggaaaggatcagatacctgctccagtagttgtgaggccactgtgtctcaggggactccaggaggagcagaagagggatcccacgaagttattcttacgcagctggggccaggagggtcagagtggtgccaggtgcaagttaggctaaagaagccaccactattcctctctcttgcccattgtggggggcaaaggcattggtcaccaagagtcttgcagggggacccacagatatgccatgtccttcacacgtgcttgggctccttaacctgaaggcaaattgctacttgcaagactgactgacttcaaggaatcagaaattacctagaagcaccatgttttttctatgaccttttcagtccttcaggtcattttaaggtccactgcagggggttagtgagaaagggtatactttgtggtatgttttgctttcctaatagggacatgaaggaaacccagcaatttgctgttatgtgaatggcctgtagagcagagtcaagagcggtgtgctttgcccgactgctcccatcaggaataggagagtagacagagatcttccacatcccaggcttctgctgctgctttaaaagctctgtccttggagcctcccgctccctgaagtgtctcgccccctgcacagcactggcctttcggaagcatcccagtagggttttctgaggctcgctggtgactcatgccctaattgcaatcctctgcttttatcttgactttgaaggatctaacactgctctctcttccaaaggggaaaaaaagattcatttgttttgagcaataaactaatacaaaatgatggccattcatgtgcagctctttgtcaccatgggccggatgagttgtgctcctcctggctcaccatttccccctgctcccccacagccggttctgcacttatcaccgagtcgcccctggaagcagattcccattgagttttccccaccaaggggaccatgcacatggtagaaacattagattctgcattgacagtagcctttccttggcccgggcctgtggtgggaagacgggcaacaagtataccccaccagggcctgagtgactagaggaagaggacgaggccttgttggcactagatttgggtattttctgcatgtcataacatatcctaactgctatttcagaagaggcagcttgtaggtgattgtacaagtgagaattaaagagagaacagatatttaaacaggtgctgtattagtaacagccagtgccctttcagcccttgcatctattaaaaggagattcaggattttattggcacaggcccttcttagtaggaagaaagggtgcttagctttggacctgaccgggtgtgtgtaaaaccatggactgagtcacagcagacactcgatggtggtaaatgtgatgggtgcttacacactgtaccttttcctttcatactgatgctgcagttcagggctggagttgttaaggcattgacctccacccacctgccccatgtccactgggctgcccaagctgcatgtcacctgagggctggcaggaaggggcgagaaatcccagggcattgtaccaaggacctagttccttctagggatataaatttccaggaatgtgtatttttaatgtggtgagatgcactcttttgttgtaccaaatagggctccccaccccacccctgcgacaagtgctcttctagaacaggttcctaccagcagcactggtgtgaatgaaagagagacccagccgcgtctcacacaggtggaattgcacttcttaacaaaaaggaactttataaaagtttgggattttttttcctaatcataaaaatagccccagaaagagcctaagctatgttcagatagaagcctcgaaattcctgtaaattgtttactttatgatgtttacatacacgtttcactttgaaaaaaaatgcaaatcgactttttaacaactgttgagatgtttcatgggacagtagaactctgactcaccaactgggctaaattttaatttaaaaatgtatttatttgagtgtctttccccccctcaccct

SEQ ID NO: 6576 - DNA, 1164 bp, Homo sapiens
cgaagtgggagaccttcctccctgtttgcagacgtccgtgggagacccttattttttccaccgctaaggttaagagattctggaatagaagcgtcgaaggagatcaagtgaaccttctacaactcctcggatgtcgccagtctccctttcggggcggaagactacgtttgagcatctcactgaggtgcaggaatggaagaacccaccttgcagcttttctgcagtgtggcttgcctgatctacccctaggaatgaagaggaggcttgtaataatccgatgaagtacagatgttgaagaggatatcgcaggacctaaacttgtgatcgtttgggggaggtcacacacgtttctgagtgggaatggatgggcgtgaatgacgtgccctcttaaaaagcacaacagtcctttaagaggagcaaaattgagttttcccattttggccaagattttgaagacagttcaatgtattctacatttgacataagatgagaactttctaaagtattctctccaagagcgtaaacgatgactaccccagccctgctgcccctctctggacgtaggataccacctctgaacctggggccgccttccttcccacatcacagggctaccttgagactttctgagaagtttattcttctccttattcttagtgccttcatcactctgtgttttggggcattctttttccttccagactcttcaaaacacaaacgctttgatttgggtttagaagatgtgttaattccacatgtagatgccggtaaaggggctaaaaaccccggagtcttcctgatccatggacccgatgaacatagacacaggtttgtttatttcagaagttctggtactaacatttggcagagcaaggtacggtgattggatcgaatctgtcttttttttttcttgcagtaaaatgtaatttttcgagtcataaatattgtattgttacttcaagactggctgaataaaaccatagactggagggactctacctccagtctatggtagagtccatagactggtaggactggagtcctacctaagtcgttcttctcttcggttttatataagaaaaacatttgcgttcagagttgtgtctaatgtggacatctgggaagggaggtatgaaaacttaacctaaagaaatggtgacataa

SEQ ID NO: 6577 - DNA, 1201 bp, Homo sapiens
aaggaaacttcttaccctgataagggcatatatgaaaaacctacagctaacatcatattgaaaaactgaatgtgttgctcttaagattaggaacaagacaaaggtgtctgctctcttcaccacacctggccggatttttttttaaactgttttatttcagtaggtctagttgttcatcttactggatttcttatacactattctgaaacctcttgtctttgtgtttagatcatttgggtgtctgaggtttatttctttgatgtttttcatcaaagctgctcaaaatacgttattggttttctgtgccattaaaagtgagctcacttcatgttcttgttgaattctaactgaagctcatttctcccctttttattttcagatatttgtatctgctgttctccggtgatgaccttttacctttagaccactgggtgtttaatacagaggctcaccctctgcctgtgttacatttagccaacaccacactttcaggtaatcctgctgttcgatgaaagcagttccagaaggaccattctcacctgtgttttgtttacatggaccactacagaaattagtttgaaggggcggcttttgaaaacctggacctctatgtcaacatgacagggtgaaactattccccctaagactgttcaacttgtagatacatcaactttgaaattattccattttatacctgaccaaaacatgttctgatatgtgtaggacagagacctggatgtgctttgatcgttaatgaggtggtcacatgagaaatgatacctgttactactgtattgtttttagagtcctgaagtctggaggctagacttcctgaaagcaagtcaagaatatagagcaccttgcaggagttcaagatggcctttggaaccaattatgtatttgtttcctcctacagtggagcagcattcaaatcaaatatttacatattgcttatcactttttctccattttaataatggaatgaactaaaataaacaagaacaaaagaatagtataattatatcagtaacaagaagactcaaaaaagaaacaggagtacctatccctatctgaattttcaagttccccattggatgaccagactggcaaccatttcaaatcccagtctatttcattgaaatttcttggttaagtttaattttctctgggggcatgatctcacaaagaatactcaagtctt

SEQ ID NO: 6578 - DNA, 2610 bp, Homo sapiens
agaattccaaagaatcagaatagtttcaaaataattttcagtgataaaagagtgttgtaattaatcatattacactaaaattgggatacatctaaggaactttatcttactatcagtaggttttgcattgatatttctttttaaataaactactagttctttatattttgacaaaaagaacttaaattttatcaggaactgtaagataaatatctagtgcttataaattttctgtccttaaatttatgtgacagtgcaagatacttttgctcttttcatttaatataggcatcttccattgacattaataaaacttagaaacagtataattagtataacatttactctgaatttgaagatttcctgaaacaaagtttgtacaagaagcccaccttggaattctgaaggcttattttcttgtttgataagcttttcttttaaacttaggttttaagttggggaaagacttaattaactaatatagtattttctaaggttgatcatcttataccacgaatcgttaattttgacagttctactgatccgtaaatgataaccactgcaaattttttcagtataaaatttttcactgcaaaaaaatttcagtagaaaataaggatgcagggccagttacaatagtccttaagagagttaaattatagcacatgttttgacattgtaatatcttttactacttgaacatttaaatttctaaatgagaaaggtatatatattactgtaactgtagaagggaaaagggaaagtatttggttctaaaaaatgttagccttcctcgtaaaagtagcacaagcccacttatgaatcactgagaaaaagtgaaaaacttgagttggcaaagatgcagagcagcagtgcagatggcaatgaactctctgaattctcttttaccttatttagaagaatgcagagtaaagggaccttcttggttctgcaggaacttctcaagggatgaggagacagaacccctacttccaagtgctctatttgtattacccagatgactgaagcttaagagaaggcagggaagtatacaagcagagccagttctggtacaaacaaagaatttgacagggacaatggaagggtcttcttcaccactccttaccttctatgtgatggaaagactagagcttataaaagtacttccatttttttattctcctgaataccaaaggcaattaaagtcagctacaaatgacttgccagtgtcatgttttatttttgttatagatttttaaattatttccttcaagatcaattcttatcccatataatgcttagcttccaagaatattctttactttcttctgtcttttacagctctttgcattttgtagaccttaatactcaggttaaatattcattgcatttataagatcttctgcaaaaagcccagaaatggtccttttcaggtgcctcttcaaagagctgacaccttaccttgtgcctttggcacaaatgtgcagaatagatacatcagttggtgcataatcgaaaaaaataggaattttgaacactgttcttccttctacatttatttctcttcattttagaatcacactttttatgttaaaccagattattattattattattattcaaccagtattaagttgttaaaaccaagggaatggggccctaaccaaaaagaagtctcaactcagaaaaataagtccccagtcaggtggttcttactttcttgtgggttgcacattttgtatctctctaacatcagcgtattcctgactttaagcaggtgtttatatgtaaaataaaacctgggtatcgaagggaaatgcattctttttatggagtattgaccctgatcctctatgatgtcatatagagcaactcagggctatacttgctagattttaaccaagcagtttgaaatattaatcatcatcctctcatcttctccactctccattgccaaagtctttgtcaaaactccaaatttgttgataaaagattgtgtttgccattctcatttataatgcagtttctccttaagcctggagttttttgaatgagtgcatgagtaaatgagagaatgtgtgaacgaacatttatgaagtatctaacatgtgccaagcattgtgcctggcactttcaatcattagaatgttttatgtgattccacagcattttctgtatgagagtagctcacaacattttaaatgtttccaatatgaatcgtgttacaaaattcttaattttatatttcatataaattaaagaggaaaaagaaaaggtttataatatattttaaaacaatgtgttactgtataatacaactataattgtagttaataactaaaacctcttgaaaatgtcaaagaaatacttgatttctgatgcaactttgactaaaatatttactttagaaataaaaacgttcttattttgctatatcactttaattgcataattaaaaagcagtgttttatagaaatgctggttattttatattcaaaaagattttgtcacataattcatgggtaaaacttgcagttgtaaattgtgtctgctctggtatgggccctattaatagtcccatgctgttaaatataaagaaaaatatactaa

SEQ ID NO: 6579 - DNA, 1487 bp, Homo sapiens
ataaaataatgaggcaaattcctagtgtgatttagaaatagtatagtatgctgtgctttgtctttagcaatacccaccaccgataaatccatatttgagatagtttttgttagaattagtaggaatagaaaaaacaaacaagaaaagttcttaatgagggaaagataagtaacaacacctgaagctttggttaccctaactctcatacgctgctataatgaattgaagtgggagaaaattttttaatatttcttgtattgcactccaggatgttatcggcttcaatatggctggtcttgattatctcaagagggaatgcgaggcaaaaagtgaagttatgttttttgctgatgctactagccacttggaagagaagaagaggaagaggaaaaagagggagaagttgattctaacgttgacttagaactgaaatgtggtatctttttttttttcaactttttcctttaaaggactcctaaactaagcacagaagagttggcgtcatcttaaaaataccaaataacagaagatcgcattgcagatgatatcaggatgtggtttccagctttgcctgagggaattccaacatgagattatgggctggctccatttcttggacttaaaatgcattattagtttaaaaatctttctgtgctctcaaagcttgagccttgcagctcaagcttgttgttccctttatattctagcagggaataaataattgttttaattaggtatttgtttcattggagttgaaattaacatttcaaaagtttttcgtatttttttatggcagatgatttgtcatttatttatattaggttttactgcctattgagacaaccaggtgcataattgattgccctttggccataaaaatgcagtgtcatggatcttagagctaaaaaggactgtaaaaattacccagaacagcgtcctcagacttaaccttctgcaagttatgtctgtatataagaagattctaattgctaactgtttatacttttctgaataaaatagttgtttctaattaaaaagtagccaagctaagatgcctggctgggcttctgaggaattaatacactcgtgtgtgtgtgtgtgtgtgtgtgtgtgtgtgtgtgtgtatgtgtatgtgtatgtacacatacatatatatagttgacacttgaaaaatgcaggtggtaggggcactgacccacccctacgccccgcacagtcaaaaatctgcatataacttttgattccccaaagtcttaagtactagtagcctgttattgactgggagcctgactgatgtattatatatattgtatactgtattcttaaagtaagctagagaaaagaaaatgttacttagaaaatcataaggaagagaaaatatatttactgtgtttatcaatactataagtgtatgtcatctgtttataaaatgaattgtctgtctggattggcaggcaaccacagccgcagacctcaatctgtggtac

SEQ ID NO: 6580 - DNA, 1547 bp, Homo sapiens
cactatggaaagaatctcagaggagaaaaacagataacttgtgataacttccagggaccgaagtctatgcattggtgagggtggacttgtttgcaacctgttgttattttttttaagtgacccaactgttcaagtccaaacttggcccataattattaagagaatcttatccggttaatcagtattaatcaggattcttcagagaaacaaaaccaataggatatatatctatatattagagaatttattatggggattagctcacccaattatgaaggctgagaagttccatgataggctatgtgcaagctggacccaagagagatgatggtgtgatacagtccaagtccttaggctggagaaccaggggaaccaatgatgtaactgtcagtccaaggctgaaggcttgagaacctgggggccactgtaagtcccagagtctaaaggcctgagaaccaggagctgtgatgtcctagggcaggagaggtgaagttccagctcaagaagacagcaaatttgcccttcctctgtctttttcttctagtcagtccctcaactgattggatgtcagcccacatcgatgagggcgtatctcctttattgagtctactgattcaaaggccaatctcttccagaaacaccctcacacacgcgctcagagtaatgctttaccagctatctggatatcccttaactcagtcaagttgacacataaaattatccatcacggccgggcacggtggctcacgcctgtaatcccagcactttgggagaccgaggcgggcggatcacgaggtcaggagatggagaccatcctggctaacatggtgaaaaccccgtctctacttaaaatacaaaaaaaaaaaattagctgagtgtggtggggggcgcctgtagtcccagctactagggaggctgaggcagaagaatggtgtgaacccaggaggtggagcttgcagtgagccgagatcaaaccactacaccccagcctgggcaacagagcgagactccgtctcaaaaaaaaaaaaaaaaaatccatcacacccagtgatctcaggaagttgataaaagagccaacaagtatggaatctagatctattttcacatcccttccacttattgtttataggcccttcacaatctttctaatggagatgacacattggagagaaacctaatttttttttttctgtatgttttgtgggaagttgaaatggtgaaaaatatttcaggtggtaataataatggtcctgtaactggtgctctgaaaccctgcttcaaaccgactttgacagctggtcactcaacacagtgggggtgtcttgccctttgtaggtgacccataaacatttatcaaaagtatgtgtcaaaaaatgggctagagatttctaataaagtgtgaatttttttttgcaaaagccctactgatgtacaccatcaagatgcttatcataataacactattgagttctcattgtgtatcaggcaccatactgaatggcttataacagtgtttttccaagtgtggtccccagaccggcaacatg

SEQ ID NO: 6581 - DNA, 1187 bp, Homo sapiens
gtgccatattttcttaatccagtctatcattgttggacattttctttttgatagtcgaattcccttcaacgtctagcacagtgccttgcacatttacccactcaaaaaaaatttcgtaaggaattaataaatgaatccttaggaggaaaagtgaaaatgaagtttttctctcaggatgaggtgtatttctccgttcatttcagatatgcatcagctagtcagcgtaaattgtgctttttatatgctcaccaggtgtaggtaagagctttggctgagatggagaaattcatcgcgggaggataataaagcgggcagggatttggcaacctcagagccgcgaggaggaggcggagtcgcggagagtttgagtatttccgtccaatcaaaaggagactgtaagaggaggaggaggaggagatgactggggagcgggagctggagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggtaaggcgagagagagaaaattgaggtctctagggcaacctccatggaaaaaggctggctgcgcccaggccagcgcgcccccctcgcatgcaccccgtatcaattagttccggggcctcctgagattggggggtagagaagaacgggggcgggaggaggcagaaagagggaagaacaaacggcggcgagatgcaaacttttcttttagtttgcaaccgcgtctttcacgttggcatgcctccgctagcattgcaaagtgcgggctgctccaactggtcctgcaggctgctcgcggatgccagcgcgggatgccagcgcggcgccccagcgccttagcgcgcaattgttctggcagcctcgcgccgcctctcccccaacccccaaccgcctccgcgcggggcgatcgggagaggggccccaaagtggcttctttgcggggaacccagggactggcgattcttcccaaccaagttctgggccgccccgccgattctagcctgccttggcggtg

SEQ ID NO: 6582 - DNA, 1206 bp, Homo sapiens
ggcagcatcccagaggtggggacctgatgctgaaggggaggaagggaggctcctgtcaccctttatgacatgttctgcctgacctgcactcttctgttttacccccatctctcctcctccgcttctcccttggcatcccacagctctaaagtctttctggaaattgacaaccgccagtgtgttcaagactcagaccactgcttcaagaacacggatgcagcagcagctctcctggcctctcacgccatacaggggaccctgtcataccctcttgtgtctgtcgtcagtgagtggcactggtgtaaaggggaaaggtggcgggggaagagtgtcaattgggggaacaattttcattatgtagccctctattttttcaggactgttgaggtcaaagttgccctctaaatgaatctaatgctgacattgagaggttaatgttttattcagcactttccctgtctctgtggactttcaggtgaatccctgactccagaacgcactcagctcctctatctccttgctgttgctgttgtcatcattctgtttattattctgctgggggtaatcatggcaaaacgaaagcgtaagcatggctctctctggctgcctgaaggtttcactcttcgccgagatgcaagcaatcacaagcgtcgtgagccagtgggacaggatgctgtggggctgaagtaagaggcattgccaataagccactattcacagtataagtagggatgactagaaaagcatatcttgttgaatcatgattttaaattctaagctctgggcatttactcacattgaccatgattctaaatgccttgtgagtgactgaaaccacagtcagagcgtgggtgcatctattctgtgtatattatcacaatgccgcccagcttctgtgttgaggtgcccttttgttgtaagctcacgatcaatgggaagggaaaggatgaatgccaagggaatgtcaccaaaaatactgcccatcttctctgggccaagaccctgcaaaattgtaatatagccacgggagtgtgtcatggtggaaagtgttgaaaaccactgtattagtttatgactgccattcttattttttctttttataatcatattagaaatctctcagtgcaagtctcagaagctaacctaattggtactggaacaagtgaacactgggtcgatgatgaagggccccagccaaagaaagta

SEQ ID NO: 6583 - DNA, 2145 bp, Homo sapiens
tgggtcatgaggatgataaatcagacgtcttgggcattagattgaagcatctcaaaacacctttttatccccttctatataggcacctgtgtctgctaaaaaagaaaagaaagtttcctgcatgttcattcctgatgggcgggtgtctgtctctgctcgaattgacagaaaaggattctgtgaaggtaaaatcctagtgcttatggcagttaaaacaggaactgggtttaggggcaagggcatgggactggggtagaggaagtgtcattaactatactgagtatcagtaagttttcatctttctcattgctaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactggtgggtagatgcagggtggcttcagcagagaaattgttcatctgttaccacagctgtcttgtttctccagacctctggtgtaataaactgccatcttcctttctagatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaaggtgagccagacctaatgtcttttctttgtttctggtctacctgggtttgtaaaattgtgatggtccagcatttcttgggcaggattcttatgtggccatattttcttttctagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtgaggattgtcatctttactgttaaatttgtcctaagctttctataagaagttgacttagacggattgctaaactggtttgttctttttgttcttacctgaactgaaatagtctgtttctttctttaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttatgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttaagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggtta

SEQ ID NO: 6584 - DNA, 1193 bp, Homo sapiens
cactgatggggcccctccctctcttatgatctctggggatgtaaatctgctttcccgtgagggcagtggggtgtaggtatcttattatctcctcagccccactggtagttcctgagattcctacttaggcctccttcctagatcccctgttacttttctgccctggcctactcacccctacccccgtgtgcacttagagcaccatgcctgctctaaccggacattccacacatttcagacgcccacaaagccaagaacctaacaagttggaggagctctctcaaggcagggaaaggggaagggtgtagggaagtaggggaaagagggagaggctctcctgcttctcaagagaataccttcggatccacaggggttgattgctctcatacggcatttctgagatgagtgactgggaggtggggaagtcaggattgagatcttaaactatgcccttgattcttcctagcactatggcccctctgtcatcacctcactagatgaacaggatgcccttggccacttcttccagtaccgagggaccccttctcactttctgggcccactggcccccacgctggggagctcccactgcagcgccactccggcgccccctcctggccgtgtcagcagcattgtggcccctgggggggccttgagggaggggcatggaggacccctgccctcaggtccctctttgactggctgtcggtcagacatcatttccctggactgagttccctggattatggaaacttcgctgtcccccaacactgagcaagtatgctgtggagtcccaaccccagctactctgatccctctgggggctctggccaagggccagacagaccttcacagatgcctacttttggcctcatctctgcctgacaaggccagcacccaaagggttaatatttaacctctttttaaggacactggggtctgtttctggaaatgttctttagatggtggcacattcctttgggtatgttaacctaggcagtgggaggcaaatgggatggtatgtgagctaggagaagggctgaaccctcagccttgactatgtctagagcctcttggggaaggggcacctctcttgaaccccaaatgctctctcttcttattacccaaacccatggctctatttcttcttcacatccattgtctcttcatgtctattccattcccttcggcca

SEQ ID NO: 6585 - DNA, 1183 bp, Homo sapiens
ttagttgccctccctttcttccccagctcaggatgctgacagtcaaatggaaaaaacagggaagcccagctctccatttgactgattatgacataaaccacaaagactgggccgggcacacctgtattctcagcactttgggaaaccaaggcgggatgatcacttgagcccaggaattcaagaccagcctggaaaatatagtgagaccatgtctccaccacccccaaaagattaaaaaattagcggagcatggtggtgcatgcctgtagttccggctacttgggggactgaggtgggaggattgcttgagccggaggtggaagttgcagtgagctgatatcacgccaccgcactccatcctaggtaacagagcaagacccagtctcaaaataaataaataaaataaacacaggtactgaatgactaggaaacaggaaagtgtaagtaaaaaggagggctaagtaactccaggtagaatgagtgtgtgctttgccagttctaaaacagtataatttctgctatttttctttctattggacaaataggaaattcccaaaacaccagaccatgccccatccaggaccttctatttatatactgtgaacatcctgtcagctgcccgaatgttgttgcacaggtgctacaaggtaactcaatctggaccttctccccatttcctccatacggtcaagtacccctcatgtgcccacttcgccctgagctgctgaaatagaactatgtgcattccttgtctgtcttctctttcctcagagcatagccaacttgatagaaaggaggcaatttgaaaccaaagagaataagtaagtaacattttcagttgagttatttacatctttcaagatcaagggcctcaggggaaatttcctctagaaataggaatcaatagacgctgggcctggcagggtggctcatgcctgtaatcccagcacttcgggaggctgaggcgggtggatcacttgaggtcaggagtttgagaccaacctggccaacatggtgaaaccctgtcttcactaaaaatacaaaaattagctgggcatggtggcgggcacctatagtcccagctactcgggaggctaaggcaggagaatcacttaaacccagtgagtggaggttgcagtgaaccaagatcacgccactgcactccagcctgggcgacaaagtg

SEQ ID NO: 6586 - DNA, 2175 bp, Homo sapiens
cctgaatcagggctgtggtaatcatcttaccatagctgtaaattgtatcaaaacaaaaaattagtagatggatttaggaatatgtaagaaactcaacacataatataaatgcaatgaatgtttttcttctttaaatttaaagttagtatctacagatggaattgtatctacaaccaaatgcctcttatccctgaattcagagtgataattttataagtgtgaaacttaattatgtagggctccccccgtctgaatagaattaattccttaaagtctagttagggtcctgctgtctgtcatgttgccttgtaacggatgtttccacctccttctccaacctctaccccaccattagtgtattttactataaaaacagtggaaccacagccctaaagtcctgctgatataaagtccttttgtcttaattgtatttaaaaaaaaaaaaaaactactcttgatcacattagctatgaggcgaggtcaaattcaggtatctaagactaatgattttgttttgtcttgatccccagagagcaaatcaaagaaaaattacagcaagaagagaaaagtggtttatcattgtgtgctttggttttcttattttaattttttttgttttttttttttgagatggagtctcgctctgtcgcctaggctggagtgcagtggcacgatcttggctcattgcaaactctgcctcctgagttcaagcgattctcctacctcagcctccagagtagctgggaccacaggcatttgttaccatgcccagctaattttttgtatatttagtagagatggggtttcaccgtgttagccaggatggtctcaatctcctgaccttgtgctccgcctgcctcagcctcccaaagtgctgggattacaggcgtgagccactgcgcctggcctcttattttaatttttaaagactacttcagttgatgcagtttcccaagaaacctacataacatatattgggagccttatgttgataggaatctgattcccattcctttttgggaatgagttgggcagcatacaggcacagaaagacagatgtttgagacctttgcttctgagattttaaaaaatgattaccgctgggcgcggtggctcacgcctgtaatcccagcactttgggaggccgaggcaggcggatcacaaggtcaagagatcaagaccagcctggccaacaaggtaaaaccttgtctctactaaaaatataaaattagctgggcctggtggtgcatgcctgtaatcccagctactcatgaggctgaggtgggagaatcgcttgaacccaggaggtggaggttgcggtgagccggatcataccaatgcactccagtctgggcaacaagagcgaaactccatctcaaaaaaaaaaaaaaaatccccaactcactgctttttttgtttgtttctgtcgcctaggctggagtgcagtggcacgatctcagctcaccacagcctcgacctcccaggctcaagtgatcctcccacctcagcctaccaagtggctgggactacaggcgtgtgccaccatgcctgggtaatttttgtatttttgtagagatagggttttgccgtgttgcccaggctggtctcaaactcctgggctcaagtgatctgcctgcctcaacctctcaaagtgctcaactcattgtttactgtcttttttcctagtaatcttaaaataatttgcctcacagaaatagagacagtaagtgtctgcagccagttcactgtttttggtaattcattggtcttcaggagttaagattttacattgtcacattttaatttttaagcctatttttcatctctgaaactttccttttctccttggttctggctatacttggactcaaactgatcagtgtgatcatgtccaaaacagcttggcctggaagaggtaggccttattttttcagcctagtagtgtcccatgcacatgctctttgtagcattcaagtgtttaacattggataaattaagaaggtcaagaatgttgttgaaacttcaaggtctcaaaaggaaatgatggggacatagaacaactgttggtgtaccaaaaaaaggtacagaggggcaccatttgtattgtcacacaacaatgatcagaatgatcagtttagaatgatcagaacaaaaacaccactctttaatgggtct

SEQ ID NO: 6587 - DNA, 1228 bp, Homo sapiens
cagtaaacagttctgaaggcaggagtggaacccgggagtattttcatgtctttcatccttgaaagatttttatgtgcctgcattttttttttaattaaaaaatgccttttcattggtcttaagagaccgcattggagaatttcaggcttttgataaatgcttcttcaaagagattttcttctctagtctagccttccacattcttagattaatatggccaaccctgtacacatcactacactaaacactgctctagataaactgctcaagttcatttaactcatttgatgcacctaaaggggttcctcattttaaagatttgttaggccaagaagcaagagagtattcctagtattcccaaccatgaaaagtatcattctttgcaccaaatgttaacaaaatcattttgttctcctgcctcttctttttaaaggtgtttgatgattaagtggggtcactgaattccatttgtggactgaaaagtattcaatccacttttggggttcagagataaaacattttttcccaagtagctggggctcttccattttgcagataagtcaaataatcaacactaaaggaggctaaactgttgatgaatgagagactccctgactgctcagatgaccctagccacactgaaagggcacctacaggtcagtttagctacctcctgtctttcccatgcaaagctgataacacagttgtctttggacttgtagacctcttggattccaggtgtgatggagtaaagtgtgggattgttgttttgctgggatgcaaataactaaatgctttggtggttaattgctaagagtaaatactactttagccatccaaggccaccttctgcagcaaaaggcttttgtggagaaccttttatgttcccaaccactttttgaatggtgtgccatttaaaaatccaggccagatcctattataaccaactctcaggatttacagccttcagttgtactagaattttgtttttatccaatactcattaaataagtgggccacttaggaagattcaaaatcttggttattacatgaagtttgttatatttcttgtcaacagtattgaaatgtaatatgtatgtgttcatgtatgaaaatttttactccacacaggtgtttcagtagagtggggcaggaaaagagatctcttcgatttctttcaggcctgaggcttttgtgaaatgcgtcagccccctgtgacagtaggttt

SEQ ID NO: 6588 - DNA, 1175 bp, Homo sapiens
tctgagttccgcagtatacctggtccagtggacacttgcagaatgccgttggcacatgccactggccattgaggggtccccagatgcataaacagcctgatcctgtagctccccttccccacacggatgcatggaggcaggtggcgaactctaaagcctcactgaaaggcagattgctggactgttagaaggggctcactcacctgcctccaagcgcttgtcttctgtttacataagaattacatctcagcaaagttgaaactatcacacaggatagatgctcagggttgcttgagaatagtcaaaactgagtattaacttcataagtgccaaagacttcaactgcatatatttaaaaaatccagaggagtatgttatggtgagttattttgtaaaatgataattgtccctgttaatttaaatttttccctttgggatttgcttaaagtagggctgtgcctgtatatggaaagggacaaaattggcctttggttttgggcttaattttttattccccaaagactacttgaaaagggttaagatttctgtttttcttcctctctgtaaaggctacagctatgagcgtgtggatggttctgtgagaggagaagagagacacttggccattaagaactttggacagcagcccattttcgtttttctcctgagtactagggcaggtaggctgcaaaggcattgatggaaacagacaaatgagggataatagagtactattacatcccaacggttagtacacttttttccttaattctctgaaaggtgaggttactattgaatgtaaaacaaggtactggacatcaagcatggtgctgttttctatccagcctgtccaaactgtcatctcagcaaagaagtaaggctgaaacctggggttattggaaagtaattctaatctgctttgaccattgacctgggaatgtcctgaaagatttatgtgattttgtggaatgtttcatttacattcagtggaagtagctcttcttcccaaccgtgaatttgggaaataaggtaacagtttgtctactagttgtccttcctctataagtatttctggaatagtgctgaaaagcttaacaaaaatctagttgttaaaaaatgtgattatgttgaaaataccaactttttagaattatttatgacatcatccatatatg

SEQ ID NO: 6589 - DNA, 1233 bp, Homo sapiens
ggccggaggggcgaggcccgcaggcgaggggggcgggtacaagccacttcttgggagccgcggtacgcgcagccttgtgggagttgtagtttccgcagctctgagtctccaggcgaggtgtcaccacaggactcgttttcccgtgctcctgtgcgcgggtccacttgggacgggtccctgagtaggtgaggaggtgggtaggagcttgcttatagaaaagtggaatcgagtagtccttgctggtggagccgctgccgccagggaactcagggccggctcctgttccttcaagagtgctggaggccaaacttgaaatacaagtttaatgttcctcgtcgggcaaaagataaggatccgatctcccccggcccggtgtgcagcaggagcgaccaaccccgacccgggttaaaactcccagggactcttcgctgctgccacctcttgttctctcccccgttcccactcggggtctccctcagggccgggaggcacagcggtccctgcttgctgaagggctggatgtacgcatccgcaggttcccgcggacttgggggcgcccgctgagccccggcgcccgcagaagacttgtgtttgcctcctgcagcctcaacccggagggcagcgagggcctaccaccatgatcactggtgtgttcagcatgcgcttgtggaccccagtgggcgtcctgacctcgctggcgtactgcctgcaccagcggcgggtggccctggccgagctgcaggaggccgatggccagtgtccggtcgaccgcagcctgctgaagttgaaaatggtgcaggtcgtgtttcgacacggggctcggagtcctctcaagccgctcccgctggaggagcaggtgagaggtcggcccgggctggggctggtggggcgaggaccgtgtgccaggccaggagtctcgccctgacacacatcttcagagctttactcgcgcggagcggggctcgggttgggtccagaagaagggaaaacagcagtagccagtgactccccaggctcttgagcaaaggacctgctggggttaggacagccccggaacttccagttttgccctgatggcgcagccatcagtaagcgctgcttaagacgcatgggagtcgcctggggatcctgctacgttgcagattctgattcagcaggtgtggagtagtgccccaggtcagcatttctattaagggtctaggtgaacttgaatacaagggtgcagtgcacttc

SEQ ID NO: 6590 - DNA, 1078 bp, Homo sapiens
aaacaatattgtctttaaccgtcaccacttacatgctcactatgagccagccactattcaaagcactttaatatagttaatcttagttaacatgatcctgataacaatcctacaaattattcctgttttatgggtgggaaaactgaggaacagaacaaataaatccatttccccacagctgacaaatgacagaaccagaattcatatctagatcatccgattcaggctcttttgggggttcccattacaatactgataaactttttacttcttgatttattagctctagacagttgctgtcagctgcatgctatgaaagtaagaaatttgttgttcttatactgcctcctgtcctctacaataacttgatttgttagttatctttacattgtcattttctagttttaaaaaaaatctgtggcaaacatagacattaaatatactcatagggactgtacccatactctagtaaattagatcatgaaaagaaataggcccccactcacccgttcttttgccatgtgcgagtcatgctttgactccaccactattccttctttagaatctggaggggtgtcaagtggatcagccagggaggaaacaatagggattttcttagcttggaaataatcataggccttctttccacagactagaagtgtgacattcttcccactgctctggattctatccaccaccttctcatagggttcatctagcacattcaccccattcacttcaatgatgacatcctcatcctctagcccagccaagtcagcaggaccgcccttctgtacctgtgaacagaagttctgagttatcaatttcaaacagagaaggggacatcagactagctctccttaagaggatagatgaggagctcaagaatttatttttaatcatgttattatttctccttgaggtatagaagttgagaaaggtgttctaatgcttttatatttatgaaggctataacttccatattcacatgattagtggtattataaatagtggttcagcgtcatatgtcttctgggatgaagggggataaataggtcccccttcttcactcccaact

SEQ ID NO: 6591 - DNA, 1371 bp, Homo sapiens
aaaaacgaggcaagagagttaacttgtctagctggcgttaagatttcttccgtatgcaagtctaatggaaagtgaaaaccaagaaaaaaccccaagccgtagaaactatcgcttcacctagcttaaaactggttagtgtgaaatggaccattctgataggataacaagacttttgttacagtgaccattaaggaagcaagactagaatctattatttacatagactccaccccctctgacgacaccgttgtaagttaaccaatgaaagcgcagcactttgcgagtcttcatttgcatacgggctctataagtagcgcataaccagcccgttttgcggtagttcggattacttctttaagtctcttttctcttttttcgcgcaaaaatgccggatccagcgaaatccgctcctgctcccaagaagggctccaaaaaggctgttacgaaagtgcagaagaaggacggcaagaagcgcaagcgcagccgcaaggagagctactccgtttacgtgtacaaggtgctgaagcaggtccaccccgacaccggcatctcgtccaaggccatgggcatcatgaactccttcgtcaacgacatcttcgagcgcatcgcgggagaggcgtcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctcgaagtaagagtgtgcaagggacgcaatagatcaaccacctaaccccaaaggctcttttcagagccacttcagtaatcgagaaagcagctgtaaacacttgtcagagcgtttgatagcttttggtcaggtagggagtgttaccatggtcacggatgcattcgggtttaggactaaggagtttcctgtagtcctgtaatgagttggccctcagtcatccccgtccagtcttactgagttgcttgttatctgtgctacgagattcgaaaggtttgactcgttctgggatatttgggagggatggagggaaggaggcggggggtggttctacaccccttcggcctttaacctgtatctttaaagtcgttttcctttttgtttctgaaagtaatgaacgagatgagatttcccatacagatgagaaaccctcggtccgacctcttactatttcttagtgttttaatctgttttccttaccatatacctacaggcgtctgtcacaaactttgtctaatatagccatgtgctttcgtcccttagcctttttgcaagtcctgacttagccatcctcccctaacttccattccagtgacttcaaacagggagatatattgc

SEQ ID NO: 6592 - DNA, 1176 bp, Homo sapiens
atggtagaagagctacagtaacaggtaacctgaaacaggctgatagctcatagaagggcatgcttgaattcggggaaaaaaaaaatctctgttaaaatgggatgcaaaacactttatacattgcttttacaaaagttagactaatttaaaggaaagtcttcaaaaacaatccgtgatcgataaaattacagaaaaaaatcaggaaagggggaaataataagggaagaaagattagcagaacaatcttccgccccagtaaagaggattgaattttaaccaatgagatcacaagtttgaaaatttccttttcaggcccaatcaagaggagactatgtctataaatatgactgcctagaccctctcctatcaatgagacagcatggcccgtactaagcagactgcccgcaagtcgaccggcggcaaggccccgaggaagcagctggctaccaaagcggcccgcaagagcgcgccggccacgggcggggtgaagaagccgcaccgctaccggcccggcaccgtggctctgcgggagatccggcgctaccagaagtctacggagctgctgatccgcaagctgcccttccagcggctggtacgcgagatcgcgcaggactttaagacggacctgcgcttccagagctcggccgtgatggcgctgcaggaggccagcgaggcctacctggtggggctgttcgaagacacgaacctgtgcgccatccatgccaagcgcgtgaccatcatgcccaaggacatccagttggcccgccgcatccgcggggagcgggcctaaggcatatttttaagtggtcgatctaaaggctcttttcagagccactgccgttttcatcaagagcagctgtaccggctctccatctgatgtgcgtctgccttgcgcagcggtcaggggccaggggcactcgtggtgggtgacgttacagaacccaaagcccagccgtgagttggccggcagtagagaaagccgcagaggcatggtccttgtggttccggccgagcgttttcacgctggtttaaggctagaggtccggctcccaattctgtgggtaaagttttgcatgggggcaagagactatggggagtttctagatgtggaagatcctgagtgtaagggtggggcgagtcccttaaaaattataaacccgtttcctggtttattta

SEQ ID NO: 6593 - DNA, 1200 bp, Homo sapiens
ttgcggctgcgcttgcgcttcttgccgtctttcttctgggctttggtgacggctttcttggagcccttcttgggagccggcgcgaactttgcaggctcaggcatggccagacccaagaccgacaccgacccccgagaacgcaagcagagcggtaggctcggggtctaccggaaacgactgtgtacttacagaggctgtgcgcatgacgctgcgttatggttcgcgagttttccgcggcgcgcaatgcgagggagacgagattatgtaaatgagtggattctggctgagctatcctattggctatcgggacaaaatttgcttgagccaatcaaagtgctccgtggacaatcgccgttctgtctataaaaaggtgaagcagcggcgttttcggcgactttcccgatcgccaggcaggagtttctctcggtgactactatcgctgtcatgtctggtcgtggcaagcaaggaggcaaggcccgcgccaaggccaagtcgcgctcgtcccgcgctggccttcagttcccggtagggcgagtgcatcgcttgctgcgcaaaggcaactacgcggagcgagtgggggccggcgcgcccgtctacatggctgcggtcctcgagtatctgaccgccgagatcctggagctggcgggcaacgcggctcgggacaacaagaagacgcgcatcatccctcgtcacctccagctggccatccgcaacgacgaggaactgaacaagctgctgggcaaagtcaccatcgcccagggcggcgtcttgcctaacatccaggccgtactgctccctaagaagacggagagtcaccacaaggcaaagggcaagtgaggctgacgtccggcccaagtgggcccagcccggcccgcgtctcgaaggggcacctgtgaactcaaaaggctcttttcagagccacccacgttttcaaataaaagagttgttaatgctggccactctcagtccagcgttcctcagtagtgaatagcgaacctggagctgacgggacgggacgggacgggacgggacggggcggggcggggcggggtgtgtgtgtgtgcgcgccgtcttccatctggagcacgtaactgccttggctcttcgatgagtgggtccccagtcctaggacttcccagggcaggtgcaggcaccaaacgtcctgggcgccgccacggtccgctccacacagtcacaaac

SEQ ID NO: 6594 - DNA, 1200 bp, Homo sapiens; identical to SEQ ID NO: 6593

SEQ ID NO: 6595 - DNA, 1476 bp, Homo sapiens
ctctctgccccatctccaatggagtaagtattactgtaggataggcctccgcttctcccttaacctatgctgcatttattgaaagttacaagatttaaccagaagtttttcctccatactggtttttatcaacaaaataaaaagattatatccaaagattttttaaagattcagtctttttaaggagtggagatggtgttaaactcagtgctgtagagggcagtggaagggaagtaccttccctctattagctcagtttttttttttctatcaagcgaaactaaggcccacagacaaacaagaattagcagtgacttcgtgttgtatatctgcggggtgatactgagcccaaaagaataaagctggttttgaatgtgttctgagaacctagcttttgccattcttaactccttttagccatgtgtccaaggttccagtcacattttttttctcaataaagagtatttcagagatgattgtctctgaattactcagacacctctggactctgagtcttctttctttttcctttttctttctttcttttttttttggtttgagacggagtctcgctcagctgcccaggctggagtgcagtggtgcaatctcggctcactccaaccaccgtctcctgggttcaagtgattctcctgtctcagcctcccaggtggctgggattacaggcacccgcaatcatgcccggctaatttttgtattttagtagagatggggtttcaccatgttggccaggctgatcttgaactcctgacctcaggtgatccgccagcctcggcctcccaaagtgctgggattacaggcatgagccaccgcgactggcctctgtgtcttccttctccaatgagtcagtgccccagacatatagccacaggtgagaagacagaattagaagccccttcccggcctggaatcacctgcactccagatttttctaatttccttctttccctccaggcctttcaactatagatctggatgagtcatgcaggcattctgtctcttctactttgcagacagccagtctgcaaatcacagggtattttgccaccatacatcagttgggtaacaaaatattacgatgtccccatgtagactttctctgtgccatctcttgcattggccaagtgggtaaggggcagtacaaaagagcaacggaagctggctggcagcagttaagaggagtaggggtgggaaggaccttggcctctttctgtgcttataactggatctgtgactcatcttgtgagtcactcagctccacctccctcctccggctgcccctcccagcagcctttactcctggcacaaacctgcagccagaacaggattctgaaaatggaaaaatctgatatagccccttgcctctccacccttcccttcatctagtgcttctactgggggtgtgtggggtggtgagaggcagccttaaccctcagctcctgcccactccattcctgg

SEQ ID NO: 6596 - DNA, 1134 bp, Homo sapiens
agaagcagaaggaggcagagaggaagatcatgaatggaggaatagggggtggccctcctccagccaaaaagccagagccagatgctagggaagagcagccgaccggtcccccagcagagtccagggcaatggcattttccactggctaccctggggactttactatccctcggccgtctgggggcggagtccactgccaggaaccccggaggcagttggcagggggtccatgtgtcgggggcctaccaccatatgccaccttccccagacagtgccctcctgggcgaccctacccccaccaggacagcatcccttctctggagccaggcagccactctaaggatggacttcacaggggtgccttgttaccacccccctaccgagtggctgattcctatagcaatggctacagagagccccctgagccagatggatgggctggaggtctccggggccttcccccaactcagaccaaatgcaaacaaccgaactgcagcttctatggacaccctgagacaaacaacttctgttcctgttgttacagggaagaactgaggaggagggagcgggaaccggatggggagctcctggtgcacaggttctgaacgggtggaacactgaagggcaaggaggctaaacaaagttaagctcaactaattggctcatcaagaacacagtccccatgttgagggggaaaatgcagtaatgtttgtgggagcctggctggaaacttttaagtgtgtgcacacaggagtgctgccaggctggcaagagcaggtcggggctggatggcacctcaggggctgtactattcctctgcagagcttgacttgatgaggtttgaggtacaaggggaaaagatggcgattctgtcttataacctcctgggtcccatccagggacctaagagaaagtagcaggggaaggtttggtgtgtgggggtgggaggtgggcagaagtcttggggaggaatgggcaaaggaggttctcagtcaataaaaccaaagttctttaggttgggaaaaagcacatggtggagtgagaagtgtggaggggaagtgggaaattggacacatttgctattgatttgaattaagctagaaattaaggttggataaattcttccccttgaag

SEQ ID NO: 6597 - DNA, 2835 bp, Homo sapiens
tccactctttaagaagaaggaggtcttcgaggggagaagaggaaacgagatgctgaagacgatggagaggaagaagatgactagatcattctaagaccagattctctaatgtttctgggtgtgcaatagagtgatcacatctttgtttcttcatgtacgatagctatccctacagaagataatgtgtaactttttataggaaaagtgtggttttactatttttgccttatcattccaaataagaactagtctgttaatgatcatattgtatgtagagaaaaattttcattgactcccattgtggaattccctagcaatttatttagacttaattttttaaattcaagcttactgtattagtcatttttagcccataattaaaacatgatcacttttacacaggtgtagtatggtgcatttcattccttatttataaattaactgaaattacagtttgctataatataaaatgacaatagtctcttgagtggtaagttggttatttttttagaggtgatccaggaatctttagtttgaaggcagttaccttttttttttttttttttttttgactaagagtgtttggttgcttttttgtcacaagtaacttggaaaatagaagcagaatagtaaaggttctattcagcaacatagttcatggattttgtggaggttctattcagtaatatggttcatggatttagtggtgactgataagattttatttttgaaggaaaaattgcttatactaagtccagagacatgcaggtgagcccttttgtcaggctgcaaatcatgacatgccgatggttgtttattttgtttttaggtgtgcattctttttcttcttagcaattcctttatgatcaccttcccttcttgtttcactccctcccgctctctcaaaaggaacttgggaaacttgtgaaacccaggaaaacctttagtcttatacctcaactacctttcagtcctgtctgggttttaaataagtgaagtagaagaaattgagtattttctgacataagaatatattatcaatacagttttatgcagtaagctctccttaccataaatgtttcttggttgacaacatctaagacaatattagtgggatgaagaaagaaaagcaggggtgcttttggaagcagtgttagtgttcctcaaaagtcggaacaattgcctgttgatatattaataagacattaaagtcaaattttaatgttggcctctcaaatgatttggataccactctgcaaagtatttctaacctttaattcccagttttaaaacagatataataatagcatttaattggaatatactaggcagctggaaaagtatttgaaactaaattgacattaaaattaagatttgttttcaagtggatgtccattaaaagtagaaaaatatttgggataagtgagtgtgtgtttccttacatggctactaaataaaatataatgagtatacaagtatatctcctcttttgctatggaggctccatgttcaaggcaatggctttttaaatcttggctatctaaaattttttccctttgttttgaatatttgtaagtttttaagaagttagtgtcagcaaattaattgaagttatgcttctatactgggacatatttaaatactgagtatagtactgctgctactgcttctacaatgtaaaatgtatgacttggtgttttaaagtaaaaattatgatgttacttgtggagaaactaaaaatgttgtacaactgaccgaaagaaaacccttggggataagtttagtgaggggattggaatccccaaaaagataacatttttcttctgcttttaaaaactgaaattccctgttctagttcctaacaattctcattacatactatgccagattacaaaatacttatttttaaaatgaaatctatatattgactttcttatcaatcatcttactgtgcaatcaaaattagagtactttggtttgaaaacaacacttagagcctccagataacttttaagacttatttagctttgtgggtggtattttcatgcaaataagtaagggtgggttttatattttgtagaagttttcggtcctattttaatgctctttgtatggcagtatgtatatattgtgttaagttcctcaagaatctccttaaaaactttgaagttaatacttttgtgcaactgtgttttgaataaagccatgacagtgttaaaaacaaacaaaaaaatttgcagtactcctgattattcttttattgtttttgactgttccctgtttttttctgtgactgctgtaacttaaagtttttgaaactgaattgcttcaaataaattgaagatttgttataatgattagtttcagtgtatagcattcactttttcaacaataccattagcggctttgaaggtctttttaaaaactaacagcttgaaagttaactgatttaaatacttggatgtgatataaggcattacaatttatttatttattttttgagatggaatcttgctctatcgccatgctggagtgcaatggcgccatctcgactcactgcaacctctgcctcccgggttcaagcgattcccctgtcttagcctcctgagtagctgggactacaggcatgcaccaccatgcctggctaattttttgtattttagtagagacagggtttcaccatgttggccaggatggtctcgatctcctgacctcatgatctgcctgcctcagcctcccaaagtactgggattacaggcatgagccactgctcccagctggcattacaatttaatagttttaactcatcatcttctttcttaacttttttttttt

SEQ ID NO: 6598 - DNA, 1235 bp, Homo sapiens
acacggtgaaaccccgtctctactagaaatacaaaaaatcagctgggcgtggtagcgggcgcctgtagtcccagctactccagaggctgaggcaggagaatggtgtgaacccgggaggcggagcttgcagtgagccgagatcgtgccactgcactccagcctgggcgacagagcgagactctgtctcagaaaaacacaaatatccaaggaaatggaggtcacaatttttttttaaccataaaatcacgttcagctgggcacatgtctcacaaatgttactaggtcttcttataaaagaatattatctgatttaaataagaaattgaagtgtttttattatatatctcttttctagggtacagccaaagaccggagctttggagagatgaagtttaaacagtgtcctacagagaacatggctcgtgagcatttcaaaaagcatggggctgaacactactgggaccttgcgctgagtgaatctgtgttagagtccactgattgagactactgcaagcccttgcctctcctcccttgcctttgtctcttcagtcctctcacttattctatttcccaaccccctcccacttgtttgtgtgatctcagaactgtgccaagcagacactgggacaaagggagaatatcttgctcccctcctgagtcagcctggtgttgccctttattccccttatgtgcatatgattaaagagttatttttaaacttggtgtgatatttttcacacattcgtaagtattagagtttgggtctacaggtgatcttttttccggacttttagcaattgctgtggaaaaaaacattttttgtcattgacatttatttatatatataaatggatgaatggatggatggatagatggatgtgtatttttgaagtctagtggaaatgtttgatctcatcctggagctagaatgataaatactgttttcctggagcagaatgaagcagggagatgtgtaaagtggtaagggaggaaggagggacaaatgagtatccatcccttaaccaagagaatcaccaggttagacagattacctcaggacttggctaagtagtctttccaggaaatcagttcctctaagggatgcatatgtgggaatgtgtgttgtgggtgaaatggacacagggaaagtccaaggaggatgctatgggtcagtttgtaaagtggaataggatttaagaatttagcccattttgtctcttttactagtttaaaaa

SEQ ID NO: 6599 - DNA, 1165 bp, Homo sapiens
agagaggggacgggaatccttccattgactactcgataagccaagcccaaaataacatcccaacattgcacatgtggttatctgtactgatggaagttttatttcaaatgtaataatactcttcaatagatggggtaaaataaagattgttttcctccccactccccaaccccccagccaaatgaaatggctttggttgtgtttctttactttttttttttttttttttttttaatacaaacaacttggggaaggtagataagtgcaatgggagggaggattgaattgaatagtaaaacgtaagcgtatgtgatttcttactttggaagagaggccctttgttataataaaaaaaaaatcgagaaagagaaaacaaataaaaacaacaacaataaaccaaactcctacttccaatgttctctagactgttcaaaatgcctttcccttggtttccatcagtacctgggagggaagaatgggcgttttggtgcaaagaacggagggcccctagcaaaaggtggcctgggtctctttaaactgtgaaatgggtctctgctgagaaaaggttccctaggccgaaagtctggccggggactccgtaagattataccactccggctgatggtgtctctgtgtgagggacccaagggggggccactgctgctgttgctgcctcccccacctcctcctccatggggtgggcccaggtgttccagagaatgggagggtagggtgaggctctctcgtacacggctaaggccagggccgttgaggtcccgttgggtggggcccccgtggtccctgggtcctgggagtaccccaaaatgctcagccagggtcccttgaaggagggaactatggtccttgggaaatactgccacagcccctgccactccgtgctctgccagtggtggggctgggaagggtacaactccagagtggtcaacagggggtggaggagggggtggagtagaaaaggggacaccactcccaccactgctgctatgttccccaggagggggaggaggaggtggggtagggaaaggaattccactgtgctctccaggaggagggggtggggcagcatgggccagggctgcctcctttgtgaaggggttcgaaagatccacagagggtagatgagtgggtgcatctcgagagaaga

SEQ ID NO: 6600 - DNA, 1545 bp, Homo sapiens
agcattttcctttatattatacacatgtgtctatcccatttcaaggctcaagtcttacccccacctctcgctcccaataggaaataaagaccatttctgcccttagttgttttacatgcaagataagtgctttccttctccctggactgaaagacttgtttgtatttctacatctagtacttgggaaatagacaatcactgtactttgagtgtttatatctttatatctagggacactgaaaagtaaatgttgctttactacaatttttttttaatttagtgtcttaccccaaggcatactcaactgataatctccagctagatgagtaaaacagtatgtgtttagttttccagagaattctggcaagtttcatattttcttccaagttagtatagaactaactataggaagtatggggttgctttttcctccagtagaatattaaagatgggggagggtgggcaatgtagtgacagaaaatgattctctcagaatgaacttttcagagaaagagcagcataaaccaggtgcacatcatgatttgggagtttttgcgtaatttattctgttatttatttgggctcgccatgtgttctggggttaggatgctgcaggtcattcatcttcttaatgcctgtctggtcttaagccaactgttctttctttcctcgaccctctctgccctgtagctctccccacaaaaatgcatgataccatgaccttacgtgtgggatggggtatgtagtgtagcaaagaaaagaaagtatagttatattgagtcctaagacatttgttagggaaaagcataagagaaaatggggtgggaggtggggaaatgatatttgactttcaaaattgaaataggttttttttttgcagaaattaaatgggatgtttttcattctagaataaaagaatgtgaattctctttgctgctcttgtttaagctaaaagtagtgtttacttgataaggctctctgaccatttaatttttatcagaaaatgtggggatgtcaggaaagtggcttcctgaacgttggggcgggataattgtcctcaaaagtatgatggttaatacatgaaaggaagactttgttggacagtttcgaaggtgggcttttaaggagttgggtttttgtggggtacttttttgttttttaagccacaaaatcctcaatatgtttgttttaggatggaagtgaggatttgtatgagactgtcagctattaattttaaggaaatcttaaaatttacatttacatcagtaaatgaagatgacagtgtgtatatatgtgataaatagtgaaacagaaaagacagttctggtattcataacgtgaaagaaaggggttttattctttctgtgtctgtgatttaaaactccgtgaccatgctctgacttttgtatttcaacctgagtttaaacaaataaacaagatattttttaaagaaagcataacatagtgtgtcttagcaaggacatgattcatatggaagcagaatgtgagaagttgtaaggtccttggtactcactgtaaaatcac

SEQ ID NO: 6601 - DNA, 1229 bp, Homo sapiens
attctgaagagccgggaagtccatctgaagttcagctttgaacactggagaagtgaggcttggaagccaccccagccaccaagcctgactctctttgcccccttcttctcactttgagtccttcccacccctgctcctcatcccactcttagttctgctttccaggaaaaaaaaaatctgtttctgttggatctgaaaggcacccgggagaggaatccagggagccctcgcattgctgaggtgggccagctctggggcagaaaatgaccaagagaagggtaggaatgtgcctgggggcagacactcagccccactgccctccctgagacctagggttcggaatttgagggaggggtcagagtggctgagccagagcgggcgcctcagggattggggttggggtgggggttgccgatggccactccttcccctggctgggccggccactaaggtcagcaactccaccctgactgaacgggggaggccaggatctccagagaagggcccatgttccacccaagtcttcaggctctgcctgactcttgttactccagctgagggaagaagaaatggggtgatagtcactgcctgccccttctctgatgccgacccctcttcatgccctctctgcctctgcttctctctgccaccgagatctcttctcgcagcccctctccacgggtctacccagtacacataatcccatcccgagctgggtttggctttggcagttccctggagaagtgaggggtgggggtgacgtgagctcccggggcccgggccaggcctggctccctctctggaaaagtcccaccccaccctcccctgcgcagcccggcaggggcccatgccccctcctctgcagaaacacacgcacatttatgcttctcacccctttccatgtccctcatttggtgtcgttcccggcccaggacgaggaaaggagaggtcagaggtggtcactctggtgccagagtagaccctggtctggacaaacgcgggctcctcctggccacacctctccacactgcccagtgaagaccaaggaacagagacctgcgcagggctcaccccttcacccccaggtctccctgctggagagtggttggaccctgtgtttctgggcctagccatggagaatccctgtcctgagtccgaattcccgggccctcagagccctccactcctgggtctggcaggccaccccaacaggtgtctttcttttttgt

SEQ ID NO: 6602 - DNA, 3092 bp, Homo sapiens
ggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttaggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatcttttattcaaatacagggtgtgatatgggtcttttctcatcgacgcctctttttccttccctctcttaggcaaaccttttagagaagtcagctgagcaaatatgtacaggtgaattcaaagcaaaagcctcacaaagttgatttgccttagagcaaaggacagttcctttcttcaattctaattagaggtgttgggtttttaattaaatatattactgctgtacttagaggagttcttaaacctccaagtaaaatc

SEQ ID NO: 6603 - DNA, 2529 bp, Homo sapiens
ccaaagccaagatgaagaataagcagctgccaagtgcaggaccagacaagaacctggtgactggtgatcacatccccaccccacaggatctgccccagagaaagtcctcgctcgtcaccagcaagcttgcggggtaacctgagcccccctctcctccccttcctcaaccactggacgtttatatattataggcagggatgaaatgggcacctagtcagatcttctcagcttgctagccagaaatgactgtgattctgctgggggctgctgagaaggtaatgtaggttgaaaaggggctctaagtttatttatttcgttagattgacacttccacacactccctgtagtccaggtagggcccagaaataggaaaggctaggattggataatgctgcaaatgctttttttgtgtgagaaactggagagatgtgatttctccttttgggagagaatgtcccaaaattgattaggctgagccttgggaatagtttggcaggtttaacatcccaaggctaacctaacgtagttgggaaaggtagattgaatgagacatgttttctgtgcttctaagtgttctgtcccttaggctgctattgcttcatgtttccattatggcaggtttagagaatccttaaaaagaaaaattgacttgcttgcctaaaactacagtgcccccttagcctccattacttagtatctcttacagtttgctctggctctcaaataatataaagattgatgaacattattcacagaaaatgggcaccttctctctctcttccagcatgttgcttttgaaagtatcatgggatagtgggacgagcactggtttaggagtcaagatatctgggttctcactctactcagtcccagcagagctgttgtataaccttgattaagtcatttagcctctctggatttctatttcctcatctgtaaaatagagttaaatgtatgtaagattgattctgattctgaagtcttaactgccagcagaaaaactccatactgttcattgtaaaactaaaagtgaggaaggctcgtgggtggtgaacctctgctctgtaatactgggaaagtactacagaggggaaccatttgagggatacatgaggagagagtaaattgaggtttggggattataaattcaggcaagagaaccttatagatatcacagtcttgagggtcaaaaaaaaatacttaggaagctagccatggaagcttcttgcctctgacccagcccactttcccagcctacctctgggccttagctgctaaaaagcttctctggcagcggagctgcaggcctgaggaaacatgctcagtcatgcacatgtgttgacccatgtttcagatgcagtctgatgccaggtatattgttagggaaagaggaagaagggtaaactgagctagcccctggggctgagtactcctgcagggctggaggaacaggttcttagaagatgattcaccttggaggaagctggggaaagtggttagggagggagaggaggaagactgagaaatctctgcatccccagaactcagcaacccagctcttttatcatgaggagaggtagccatgctgactcatgaacaggtggaggaaaggggttgcaggtgaccagcatcttcaatctagttaccaccagcttggctagaattttattgaacgcaacttgctagttatgacagagaggaccagggtgagaactaatgctcaagagagcaagattctgtaatcctcttgccctctcacatcacaaattctgatatgccaaacatttggcccaatgagaatgactgatagacttgctgatgtgcatgtggggggatgaggtgtgtatatgcctttctcctgactggccattcagtgttcaggctgtcattcaaattggataggagaaagttggtgaggaaggaatggagagagcaggatccctggactccctggtccccaaactccttgactgtcacttgtaattgtatataatttttgtgtttcttgctccatttcctcatgctgtcatccttaaagtccatctgggaaggggaaaatgctgaacaccattgtatagtttcttcaactgtcccagccatgttgtacatagatatgtcatgttattatatatataaatatatatataattttgtacgttttcttcatctccgatcttctcaaattctgtactttttttcttttctgtctgagctgccttctctatcattcagcttgagtcctcaagactactggtcacaatgagtctgatttttaggaaggaataggaggagcagggaaatcagaaaaactgttggtctcactctgtctctctacctggtcatcttcaaggctaagaaaacaaacaagctacattctgtatttgccagtttccacagcatgaagtacatagcttccttagcaaggagtggtcattccaaaatccaaatgcaaattgctttgattaaacctagattattaaatccattcagaacagcatgtgtgtggtctggttctggcctccacacagt

SEQ ID NO: 6604 - DNA, 2609 bp, Homo sapiens
tggaagtaaggaaggctaagagctcagcacagcaaagactcggggtcagggatggtagtgcaggggaatggtggagtagaacttggtaagtgtaagagatcaaggtgtgtgacccaaacttaatctttttcttttatcaggagatgctgtccatgctgggagatcagagcaacagctacaacaatgaagaattccctgatctaactatgtttccccccttttcagaatagaactattggggtgaggataaggggtgggggagaaaaaatcactgtttgtttttaaaaagcaaatctttctgtaaacagaataaaagttcctctcccttcccttccctcacccctgacatgtaccccctttcccttctggctgttcccctgctctgttgcctctctaaggtaacatttatagaagaaatggaatgaatctccaaggcttttaggactgtctgaaaatttgaggctgggtgaagttaaaacacctttccttatgtctcctgacctgaaattgtatagtgttgatttgtgctgagatcaagaggcaggttagaagaacctgacatccactgtttgccttggatagtatggcttgtttttggaaagaaattctgaagagagtggaggagaggagaaatgtcctcatatttgaggaccatgaaacattgtaggtatatatggggctttagcaagtttgagcataggctctttttgctgcctgtgagcagtccctctggaaagaaacatgtgagtaagtgagagagagtgtgtgtgtatgtgtgtgtgtgtgtgtgtgcgcacacatgcttctgtatttcactctttctccctattagggagttatgcaaaatttgtccccgattttacctttgtctttctgtgtacttttcaaagagtcctaaggagttaaatcttccaggtattttccacttagtattgcagccaaagaatatttaaataaacgtctttgctgcgcttgcatccatgcccagccaatatacaactgtaaagcaaatatagaaagtcggctgttgatacgattgtctgttatcgaacacattcagtgataaagctgggttactgctgcttttggtgctctcaccttatctggaagatctgcaaacattacctaaataggctggcaagataaacactttctggaacccgagacttggccataaagataatgctgcatttttctgtcagaatcacatatgatgtgtgttctgtagaggttatttctgcatggaaactcaacttcttggattagccgtcccagtgaaaatcctcattgttggagtgtaaaccaaatacgaagccctcttgcaaagtagcctctttcatcccatactcaaaatacccagtttagcaagcaactgagatttaagtctctctggccctaagaggtttttcctctttgctccctccaatcttgagattgggttttgctttagagtgcaagtatcataattccgtatgatagatggggcctggacacccatctcaacagggtcacttggtaattaacaatagccatataaatgcggatacaggttactaccctcaccctttaccttcctcaggtaacagtcgtagataccagcttttttttttttttttttaaattggctttggccagtagctaaagtgcaagactgaattaatgagaagatatattaaatgtagtcataggggactgaggagcaagggtggccttgaagaggccaaaggaatgtccatttgctgagtttcccttccttatgtctccagtctggtgccaggtagtggagtaaaaaaggagacagtttatttttttattctatgtgcacacttacagtatacatatatatttatatcacaatttacgaaaccaaaaagttgagtttccaatggaacccttgttttttaataatcgactttttaaatgtgatcaggactataatattgtacagttattatagggcttttggggaaggggaggatagcgagaagatgctctgggggttttgtttttgcttttccttcagggttttatttttgactgttttgttttcttgttggccatttctgtattgctggcatctgtgctaagctttacagtggcaaaaataatgacatgtagcaaagattttcaaacaaaatattttttccttttgtaaaatttcttgtgttgtgtgatcttgattgcggctttatcattcctttccagttcataaacaacaggcacccacaaccagaggaatctatagtttaagctccagacatacaaacataaggcacattgtgtctttaatttcaggaatcagaaatcatagggttctgatcacattgcacgcctcccccctcacttgtcctcctgatcctgacacattctgagtaacatcagcaggaatgctctgaccatgaggtgggggttttggggtgggcgttgcctgggttcttgggagagaggggaagagtcgggacttgaaaaccactagggcacatctggatgccttcccccagtatgtccttttctggattaaaatgagtgaaatttaaactgttcaagtctggacctggtttccctctaggagactatgttggttcattagcaacttttttttttttttt

SEQ ID NO: 6605 - DNA, 1213 bp, Homo sapiens
tgcttcccaggctcaggtgatcctcccacctcagcctccggagtagctgggactacaggcgtgtgccaccacacctggctagttttgtttttgtttttgttttgttttgttttgtttgtttgtaaagatggagtttcgccccattgcctaggctggtcttgaactcctggactcagtgaccctcccactttgacctcccaaagtgctgggattaccggcgggagccgctgtgcctagcccaagcctttttattcttcttgaatcctgagatagagaggaagaggtggatagtgacatagagaaagtgaggaaacatgtattagaaaaaactttcttatcgatgaactacatttagggtggaaacctgtggctgtggatcaggtgtgaaccagcagttgcttacggagagatgcatgtggcctgaagtgtcttacttcttcctgtgaatagaaatacttgttttttcagagtaaaatattaacttctatttctttttcttgcgcaggaactgaaacatttgatcttggaggcagcagatggctttctgtttattgtctcatgtgagacaggcagggtggtgtatgtgtctgactccgtgactcctgttttgaaccagccacagtctgaatggtttggcagcacactctatgatcaggtgcacccagatgatgtggataaacttcgtgagcagctttccacttcagaaaatgccctgacaggtgagagttatgtgtatgggaaatgaatgagaagtcctttcttgtttttttcctgagacttaagagatgttttagctgttaaattggtttgttgactctggcaaggcttcaagaattttctactttaatgaatatagtcagttctttttatccatatgagattatctactttgtggctcagccttagaaaatatttcattggtgataatattttacatttatcttaatattggtataaatagaacagtaaaagccaaacctacaatacttttttttttccgttctaaaagaattatccatgtttttatctcatttgtatggataattatctggtattttttctacctcctggtgcttggctttgtgctaggttcaatgataacagctttttattctatagatatggttattggtcaatgtataaggtgttttctgttgttgttgttgttgttgtttgtatctgtactgttgttctttttttctcccctatttta

SEQ ID NO: 6606 - DNA, 1111 bp, Homo sapiens
cctttaggctccacagcctctgccccagcaccctcagcactcccggcccctccagcacccccagtcttccatggcatgctggagcgggccccagcagagccctcctaccgtgctcccatggagaagcttttctacttacctcatgtctgcagctatacctgtctgtctcgagtcagacctatgaggaatgagcagtaccggggcaagaaccctctgctggtcccgttactatatgacttccggcggatgacagcccggcgtcgagttaaccgcaagatgggctttcatgttatctataagacaccttgtggtctctgccttcggacaatgcaggagatagaacgctaccttttcgagactggctgtgacttcctcttcctggagatgttctgtttggatccatatgttcttgtggaccgaaagtttcagccctataagcctttttactatattttggacatcacttatgggaaggaagatgttcccctatcctgtgtcaatgagattgacacaacccctccaccccaggtggcctacagcaaggaacgtatcccgggcaagggtgttttcattaacacaggccctgaatttctggttggctgtgactgcaaggatgggtgtcgggacaagtgagttggtggggggaattgctgcccctgcttccaactttgttatggtgtctgtttcacctcttcctttgccttgtatctgtactgctttccccatcttcctttacctcctccctcacctggaactcctgctataaggcctccatgaaagctatgaggtagggaggctggagtctgacatggccacactgagcaaccttgggtacatgtgtattgtgttatttttgttctctgatccccccgctcctttcctttatttccctctgtcatataggtccaagtgtgcctgccatcaactaactatccaggctacagcctgtaccccaggaggccaaatcaaccctaactctggctaccagtacaagagactagaagagtgtctacccacagggtaagtggtcaaggaatggcacagtacctcagagagactgaggagcatgttcttgtttttctgtgcttatagaaatcatcagaaatctaaa

SEQ ID NO: 6607 - DNA, 1160 bp, Homo sapiens
ggtggctaacacctgtaatcccaacactgtgggaggctgaggcgggcagatcacctgaggtcaggagttcgagaccaacctggccaacatggtgaaacgccatctctaccaaaaatacaaaaaaaattagccaggcatggtggcgtgcacctgtagtcctatctactcaggaggctaaggcaggagaatcacttgaacctgggaggcagaggttgcagtgagccgagatcgcgccactgcactccagcctgggtgacagagcaagactccatctggaaaaaaaaaaaaaaaaaagcaaacaaaaaaaaaaactaataggtccccataaccctagaaggcctttaattctcttcattctcaggcaaaatcctgacagatgactttgcagacaaggagggtctggaaatgggtgatgagtactttgcaaatctggaccatatcgagagcgtggagaacttcaaagaaggatatgagagtgatgccccctgttcctctgacagcagtggtgtagacttgaaggaccaggaagatggcaacagcggtacagaggaccctgaagagtccaatgatgatagctcagatgataacttctgtaaggatgaggacttcagcaccagttcagtgtggcggagctatgctacccggaggcagacccggggccagaaagagaacggactctctgagacaacttccaaggactcccaccccccagatcttggacccccacatattcctgttcctccctcaatccctgtaggtggctgcaatccaccttcctccgaagagacacccaagaacaaggtggcctcatggttgagctgcaatagtgtcagtgaaggtggttttgctgactctgatagccattcatccttcaagactaatgaaggtggggagggccgggctgggggaagccgaatggaggctgagaaggcctccacctcaggactaggcatcaaggatgagggagacatcaaacaggccaagaaagaggtaagcagtggcagaacactctgagagctatggctttaactttggtgcagtaacaatgcagtctcaccatgagtctttgcatgtagattattctacttgatggatatttctgtggccacctcgttatctctccccctaactagcacattcctagtgtttgtttaaagaac

SEQ ID NO: 6608 - DNA, 1310 bp, Homo sapiens
tgtcttcgtggatacccatgatcttcgcttcccctgggtggccttctttgccagcaagtaaggagtcaggaaaggggatgactggggaggggcaaggaccactgaagttctaagggcccctcctccattcatgatccaactccacctacatattcagtaaccccaagtgcctgggttatctgctgtctttgccacacaccatccttttcttcctcttcagaagaatccgggctgggacagaacttacttgggactacaactacgaggtgggcagtgtggaaggcaaggagctactctgttgctgtggggccattgaatgcagaggacgtcttctttagaggacagccttcttcccaacccttcttgaactgtcgtttcctcaggaactgggtcttcctgattgttgaaccctgacccgaagtctctgggctagctactccccccagctcctagttgatagaaatgggggttctggaccagatgatcccttccaatgtggtgctagcaggcaggatcccttctccacctccaaaggccctaaagggtggggagagatcaccactctaacctcggcctgacatccctcccatcccatatttgtccaagtgttcctgcttctaacagactttgttcttagaatggagcctgtgtatctactatctccagtttgtattatttcttgaaagtcttttaacaatatgataaaactaagattgtggttttgtttctctctctcagcccgatactcccaattctggatctttcagtgaggtattatccccatcctcccctgtgggctgctgtcattcatcttctaccttgtctacctttgcttcttgcatgtgaatttttttagatggagttctcgctctgtcacccaggctggagtgcaatggtgcaatctcgactcactgcagcctccgcctcccgggttcaggtgattctcctgcctcagcctcctaagtagctgagattacagtcgcccgccaccacacccagctagatgtatttttagtagagatggggtttcgccatgttggccaggctggtctcaaactcctgacctctagtgatccaccctccttggcccctcaaagtgctcaaattacatgcatgtgaaatttaaaaaagaaaatattacataactgcaaggaaggcataagaaagactctcttcgtttatttagttgatcccccttctcaattcctaatagtctgacacttattgccatgttttatttaatattttttatttaatcttttaatttttaaaaaaaacccattaacagtacattttggtctaaaatggtc

SEQ ID NO: 6609 - DNA, 1818 bp, Homo sapiens
gctgctgcatatcttctgggcctacctcattttgcgcatggcccacaagttcataactggaaaggtgaagccctgttcccattgtgtaggccttactactctctacaacttcctgaactcccatcttgccagtaactctctaaaaaactagtgtggagccctgggtataacaggaacaagccctcagagagaagcagtacttaggggtttgaggatctcatgtaataacccttcttgtcccttttccacagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattactccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggttttttttaaaaattaaaagattaaataaaaaatattaaataaaacatggcaataagtgtcagactattaggaattgagaagggggatcaactaaataaacgaagagagtctttcttatgccttccttgcagttatgtaatattttcttttttaaatttcacatgcatgtaatttgagcactttgaggggccaaggagggtggatcactagaggtcaggagtttgagaccagcctggccaacatggcgaaaccccatctctactaaaaatacatctagctgggtgtggtggcgggcgactgtaatctcagctacttaggaggctgaggcaggagaatcacctgaacccgggaggcggaggctgcagtgagtcgagattgcaccattgcactccagcctgggtgacagagcgagaactccatctaaaaaaattcacatgcaagaagcaaaggtagacaaggtagaagatgaatgacagcagcccacaggggaggatggggataatacctcactgaaagatccagaattgggagtatcgggctgagagagagaaacaaaaccacaatcttagttttatcatatt

SEQ ID NO: 6610 - DNA, 1399 bp, Homo sapiens
agtcttaagatcctcacagcacgggagcagggagaggctctagaacaaggtttcacaaccgagatgcctttgacattttgggctgaagtgttctttgtaaggaaaacctgtttcctattttgtgcattacaggatatttagcagcaaccctggcccactctagttatgacaaccaaaaatgtctctatacattgccagatttctcctagggggcaaaatcgcctccatttgagaaccacaactctaaagtcaagatatttttctctgaagtgatttctgcttggcacgctaccctcatcatcttactcatcttaagcccgagccatggatcaactaggagcccatataaatgaggctcagtagggctgcacataatctccaaacaattctttattcagtgttttgcttgtgtttgcatgttgctatgatggacaggtccccctcctccattcttgccctctggagaagtggttcctgcagtgtagagatatgaacagggtatggtaggattggggaaaggggagagagaagcagtagatacactccttatcctccccaaattttaagctctatttctgtgccctagtcctagacacacattagactcagggagttttgtctgaagaccaggtcccactgccccctggctgaagagtctgctttaaatgggaaaacaacgtaggagcaggggtttttaggcactttcagtattctcaggtgttcttcgttctggcccttccagggtaattaggaaggcagaacaagacagatgagctcctgcctgctctgagacaagaagggtggggtctcattagctttgcaacaggaaacatcctgttttatggtagtggggtcaggaatgtaggaactggtatccattctgccaattccaccacccattcagtttgcttatccctacagaacagtgactgaggttctttttttttttttttttttttttttttcaaatttccatgtattttctgccatttttcagggtctaagattggtcatacattcccaatttactctcagttccagtcaagctggttgctctgaaagtaacccagcttgttgctctaaaatacctcagtagcctgagtgttatactagagatctaaagggttaacaggatagggtggaaaggttagagactcctagaaatctctggtcaccgtgatcttcggcctcattctaatacctgttctttggacagtctttttcctttggtgctctcttgcctttagctaccttctctaatatgtatgctaccatcactaataaagtgatgggaatgggtttgagagtcgtaatttatattaaaaagttgttggacttttaaatacattttttcaaataaaaaattaagcaaaatagttgcacagtaatcattgcaggt

SEQ ID NO: 6611 - DNA, 1174 bp, Homo sapiens
cccagttactcaggcggctgaggccgaagaatcacttgaactcgggaggtggaggttgcagtgagtctagattgcgccactgcactccagcctgggcaacagagtgagattccatctcaaaaaaaaaaagaatgtaggatatagaaagactgagagggtgttgtgcagacagaagtaaagaacacactgtggaaatagcttaaagtctgcactaggtagtgccttcttcctaaagccttggttttctttgaggctaatcttctttaagaaaaactttttttttatttcaggttctgccatcttgaaacccccattctgtttccagcccagaagaaatgctgcccctaccagatccctccttgaaccagtgatctaaggacccctcttttccctatctgcctaacagtgcctcacaaggcttgggggctggactccctctactccctctggccatagcccctcctggagatggggtcaaggcagcaggactgatcaagtgactactggttagccagaggagctcagctgaagccctggaaaccctcaggtctgagataggagttctctaggaacctggaatgagttcctgtctcctgaatgatggtctgggtgccacctgtttttaaactcttaaacctggaactccttaaatggggtaggtgggtgagattatcaaagctgaagctggctttgctgagaagctccctacctccctgcccttctcctccttcctgctggaatgaactaaagcagatgtcaagcaggggctggtgggggtgcctactcccttttccactctatctttagatttcaaaccttaggcttacagcccctcaatatctctctgctaacaccagtgtctctttctagttaggcctctaatcttctgtttctgtttaccagcttcccagcaactttccttttttaaaatattaaaaatttaattcaggttctcttaattatcctcatcctgctgttgcctccgcccttaactctatccctattaggaaccttgtttcccaccgaataagagttaaggtaagaggtagctcttcacctgatgacattccatttaagttttggggcatctttcctgccctctgccaacctccctgctggcccaggtgagaggaggaagaggggtctggaaagaaacccagaatgcggcagaact

SEQ ID NO: 6612 - DNA, 1069 bp, Homo sapiens
tggccagaaaaaggcttataggggctatgaaactctggtcttgacatataaactttgctctgactggatttcataaaattacagtgaggagggtagtctcttgtcagaaaaacttgtttccaaacatttatgtaatgtcaagctcagtctctcttttttttttttttttttttgagacggagtcttgctcttgttgcccaggctggagtgcaatggtgtgatctcaactcaccgcaacttccacctcccggtttcaagctattctcctgcctcagcctcccgagtagctgggattacaggcacgcgccaccacgcccggctaattttgtatattcagtagagacagggtttctctatgttggtcaggctggtctggaactcctggcctcaggtgatccacccgccttggcctcccaaaatgctgagattacaggcgtgagccaccccgcgcacagcctagactctaattttataaaactttgttgaattttctaagtgtcatttaggacatattgtgcttttctgtggagcttatatcttatcctcttatgtgcaacaaaaagggggtcggaggtaaatgctgatgatgttgtttagttttatttccttttgatctggcatgagtaaattgctctgtttccttaagcttgggtctgttacagagctttgtgccttatagggtgctcagtgtgtgttgacaaagggaataagaactgtcagtgccataaagaaccaaagattctggctactttgtcttcttcctttctctcccactatgcctacacttcctctgcccagacacttttggaaagtgtttaactgctgggttttctttttctttttctttttttttttgagacggagtttcactcttgttgcccaggctggagtgcaatggcgtgatcttggctcaccgcaacctctacctcctgggttcaagtgattctcctgcctcagcctcccgagtagctgggactacaggcatgcgccacaatgcctggctaattttgtatttttagtagagatggggtttctccatgttagtcgggctggtcttgaactcctgacc

SEQ ID NO: 6613 - DNA, 1733 bp, Homo sapiens
agccgggggtggtggcgcatcatcatactggtgagaaaaaaaaaaaaaaaaaagaggccgggcgcggtggctcacaaaaaaaaaaaaaagaaagaaaaaggaaaaaaagaaatatcagtttgagaaatgatttttttttcttttttcttttctttttttttttttaaacagagtctctctctgtcacccaggctggagcgcagtggcatgatcttggctcattgcaacctctgtctcccgggttcaagcgattcttctgcctcagcctctgaagtagctgggattacaggcacgcgctaatttttgtatttttagtacagacgggatttcaccatattggccaggctggtctcgaactcctgacctcgtgatccaccctccttggcctcccaaagtgctgggattacaggtgtgagccaccacgcccagcctctttttttttttttttttctcaccagtatgatgatgaccattttaagaaagcttgtgtggctctctcctatcattacagacctccagagctggaaaatttgatgcatttactgaactcttcctgaaagtttaatatggagtgggaatcagtttttgtcctaatttattagagaaggcttcctcttctctactccttgtgcaaacccatctctggatagctagaaaaggaacttcagaatggactatatgtgatgaccacctgtatgcactctaggctcttatctgtctctattttatgtggtgactatatctcagaagtactaccccttctgagtagtactattatttcctatgccaattttttttaagtctctgatgctgccctttttaaatttttgtcttattttttagcctctttagtattagggggtgaggtgacattcctagactctacagtagcagtttggcatgttagtgacaggaaattgtgattccctatctccccctcctcctaccttttctgcttttgtgattccattgttcctatctcattgaggctttcccaggcattcgaatttagttagtaggtcatttctaatctctgggccttgtcttttctctctccgttcccctccttccctaccacatattttttgtttattctgaggtggtttgtttctgaaagttaatctaggtcaccttctatatcctgtgctttctagttggctttagacatcttgttctagcaacaatgatggtagcagctctctccctgaccttgccccatgtgctgtccttctgtcaaggccatttgtgtgtgtactgcggcaggtgtgtgtgtggggggatgcgcccagactgttctcacaatgtcctcagtttttcaggttgtctgacagctttatgtacagcgtatttttagaaaaacttaaatatacttctttatttagggttttattctgatgagcaagtttgtgtgtatatgtgtgtatgagcatttgtatgtatatatacttatacagatctatattatatatacagtttttgtactatcatttaaaataaaaatgtttctcaataaaatgtcaaagccgaccatttcagggtgtcattgaatttgttttcatctcctgggcaaaatttgtatctattctcttttttttttttttttttgagacggagtctcgctctgtcgcccaggctggagtgcagtggcgggatctcggctcactgcaagctccgcctcccgggttcacgccattctcctgcgtcagcctcccaagtagctgggactacaggcg

SEQ ID NO: 6614 - DNA, 1187 bp, Homo sapiens
ccaggccccacgagtgcgcctcgccgctgaggctggacgtgccccccgagggcaggtgcgcctctgcccccgcccggcccgcgctctccgcccccgctccccggctgggcgtcggcggaggccggaggttgcctttctccggccaccgggccccccctgccctgctcactcgagtcccctcgggaggtccctccaggtactccgggggtcccgggaagcacctcctgtacctgggccggcccgagggctaccggggccgcgccctgaaaagggtggacgtcgagaagccccagttgtccctgaagcctcccctcgtcgggccctcctcccgccaggccgtcccgaacggcggccgtttcaacttttaaagggagcggcccacggcctccagcgtggggagcgcccgagtcctctcggccacgagctggacgctcttcaggacgtttcaccgccccctcgccccgcacctccagccttcccgactcgcagagtctcccgaggccccttttcgcctcgggtttatttattgactgtctttccccctgtcctcgacagaagagtgggaggtgagaagcccgtctcctcagtgagccagcatttcagggggagctggcggactcccactccccgctcccttccagccaagctgccttaactcgcccctcggggctcccccagagactgtgccccgggcgggccgcgcgcgctgtgtccagagtcctcgggccttctgggtctgggacgtgcctctcctactgtgtaggagcctccgcttcccaatacagccgtgtctgcagccactgcctgacttcactcgggcgggggagggcggcagtcggtcggctcgctctgggcgccctcgctctctgccttcatctgggccctgggctctcccgggtaatgggatggctgcggtcccgccggggggcagtctggaaaggtttcctaaaggagacgagcgaattaacggtgtcgaggtgagccagggccagggggaccccggtaaagtttagttgaggctggggaaggccctcggagctcgtttccagatcgaggtaagagggactttcttaaaggcctagtctatgggatggggcggcggagggaattttttgagaaataaaatgaagctgcagtgtacgttacttgaagttccacatcagaaaatcttgtccttaggagaattt

SEQ ID NO: 6615 - DNA, 1120 bp, Homo sapiens
ccatgttggccaggctagtctcaaactcctgatctcaggtgatctgcccacttcagcctcccaaagtgctggtattacaggcgtgagccgccacgcccggcctgtggatgtttttttgatctgtgttctgttgtgtacagtgtaagccatttgtaggctgatttctttcctagttcttcctcttagtgaaaagtaaagcagtttagatcatgttgaatgataaactgaaatttagaaatgcaaacatagaatacaatgtcagaatatcaccaggtgccattttggttgatattttataaatagggagatatttttctgtttactctccatagggattttgacactttccacccacccctttttccttttgtcaccttggtatattctgccagaaaactgacatcagaatgtcattgcttctgatcgatttatttctgccatgacactcaagcccattgtcagttataattaactagtctaataggtatccagtttctgatattaattgataatgtgtacttacacgttagcgttgaatatcaaaatagtacgttttgcttattaatgtctgtgggcttttttaggttaatttaaaactcttctgattaatacctttgctcaaatatgtgctacctaatagctattaaatattttattagcctgtttttcttggataataaagtggaaactatagcctgtgaagtgaacaacagagataataccaggccagctagcaaactggggagagggaaggtggtaattttatcctttaaattgttctctcctagaatgttatttattatttttttgagacagagtcttgctctgtcgcccaggctacagaccagtgtagtgcagtggtgcgatcttggctcactgcagcccttgcctcccaggttcaagcgattctcctgcctcagcctcctaggtcactaggatcacaggcgtgcgccaccacgcccagataatttttgtatttttagtagaggcggggtttccccatgttggccaggctggccttgaactcctggcctcaagcgatcctcctgccttggcttcccaaagttctgagattacaggcgtgagctactgcccggcctctctcctagaattttggagc

SEQ ID NO: 6616 - DNA, 1235 bp, Homo sapiens
agctttcttcttctttttttttttctgaaaaaaggaaaaagcacacagcacacaatttcaagccattttcagatcagaactccagaagtgttgacaagatgcctattcgtagagttccctcagaagagccatggtgtttatgaagagaagagtagtgattgctctgccagaagcagctcctctttaaactcctcctctcttgatgaatttcttaaggctgaaggaatgaagagagtgggacatggggtaatctttatcccttttgttaaaacaggaggcagccatgggctgggagatcatagcccttcctaggcagaatcctgttcactgccaggctatagtaattattactattttgcaatttgaaatatattctggttgtttttctaaatgtgaagacttaccaaatgaattttagatcattctccagaggagattttttttgctcttctcatcttttccaacagtgttctcctgtttgtggagctaaggtaaagaggggacacttctgtctgtttaacagacagtccatatctgtgaggccagcaaatattttcttaaactcatggggagacagcagattcttgccttggtgaggtcattgctgtgccatatgtcctacccccctgtcttcatgcagggaagttggaaatgggggctacatatgccctctcctccccgtctacaagagttgtggttttccatctgatccttccactcttgtcaggggaagaagggggcctggtatctcaggcagattgttgaattcctgttctatcccttctctatcccaccctgccttgataatatgttagcccataccccaaataactgtctatattagacacccccagccagtttctggctgcctgtctttgctgccatgttttttacaagaaggaaagaattcttgctatttttttttcataatttactatttatgatgtatttaagtgttttattaaggacagagttctgttaggggtgggagggaatatttgagggagggctgggtcttagggaaaggaatggggaagcaacatttttattaagtgttactatttgcctctactttgtattgttcagaaatggcaaatacaatataaaagtgatatatggttttaatgtaataaactttaatgagttatttagacctcttattttttctgattctttttcatataccatctgctcaccctcctactccaccacccaggctcagttttgttcatgtt

SEQ ID NO: 6617 - DNA, 1127 bp, Homo sapiens
tccctttgggtttggccctggagtcctagtagagtggaccctccattcctcctttctgagcccaacactaattaattttatgctcctgctgcagaacccccagtgtgggcctgggggtgggaggatgggacttaggtatgcctgctagacaggttcagggaaggactgatgggggtgtcatggatggacacacctctccacaattccttcaggcatggactggaactttcctcctctaggccgggccctgccctagtgcccacccccgcccccgcccccgcccaaccccaactcactggcactcaagccccctacccctgcagtgcctttcacttctttttttccccagaaatccggggcgggggggtggggggttggtagggatgagtcctgtcaagggggccacaggagaggaggggacaggctctcaggaatcctttattcttgtagtaataataatactaacaaacagttggggaactagggagaaaaccagaccattaaaactgtttgtggtcgaatctccattcaggcctctctttttctgtgacttggacaatgtggagttgaagcgggtgagagaacatggaaggcccgcccttctcagggaagaggtggtagtgaccaagacaggcagggaaaaagcaaacttctatgtagtgccttttgtatcttggacactgaggcatccgttcatacctcatcacccatctccccctgcactcccccagaaaacctggaaatgacacaagtggctaactaaggactttatttcaaacaaaaattaaaaataaaaaattgagagctcttttccctgggtttggggaaggagtcagggtagggaattccacatggctaggccagtaccctcagtacactggagggctgtgggaattcccttccttgcccatgatggggaacctcagcaagtgcagggcccacgcagcgcccgccagcaaggggagcttgggccaggggtcggtccctgggaggggtaggtccctgggaggggtagagctgggcagcagcatggccagtggccaaccacaggatcaagtcctaagtaccgagaacctactcttccccacttcctgggccccagaacggaataagaggatggcctgtgg

SEQ ID NO: 6618 - DNA, 1148 bp, Homo sapiens
ttcaaaggaaatactgaagtttgggacactccttgggacagtgcccagctttgtcccagtctttttgtccactgtagctccctgggccctgtcttcaggacgagcccacagaggcatctaggcctcccttacagcctgtaattgatagtctagagtggtttggcccaagcacatcatctgtacattttggagctcagttgaaatattttgaagacttaaggattctgtcacacaaattctttacataggtgatcataggacaagtatctgccctaaatatagtgttcatagtttcagaggactattggatgaaggctggagctaggagaaaggacagcaggaagaaccttgctaacagagttgagatttgggggttagtggtggaagtaagttgcaaatactgtctcactcttcccccaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggaggtgagagggcttcagggaggtaatgctgggtcacaggagctttctccaggagctttcactatattggaaacaagacagcatatcccaaggcagggtaaggcaagtatcctaatgagtggtgtaggtagtgaggggtaatatggggaaagctctgaacaactctagcctggaatagattcaggtggagttcattttccaggtgaaggattcagatttaaatgtaaagaggagcttctaggccaaggggagtgagggaaatttaatgaaaatatttattgaacacctacataaagttgtcatagaatagcagaggatgagaagtcatacattaattcattcaagaaatttttattgagggccttctatgtgccagacctgagtgctgtatgctagtgaacaagacttggcccctgcctacaagggatttatgacctaactggaaagagaacaaggccagtaagcaagtagttgtagtgtggtgagagtcaagtcatggggga

SEQ ID NO: 6619 - DNA, 1192 bp, Homo sapiens
aaaaagaggaggtgcctgggaaggtgtcatagcaaagggaagatctgaggatggcaccactaaccaatgtgtgtatgtgtctccctttctgttcttttctccctccctcttcctgtagcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggatgtgggtgatgccattaagccctacatagtccaccgttgccgccagagcattaacttttccctccagtgtgccctgttgcttggggcctattcttcagacatgcacatttccactcaacgacactcccgtgggaccaagctacggaagctgatcctctcagatgagctaaagccagctcacaggaagagggagctgccctccttgagcccggcccctgacacagggctgtctccctccaaaaggactcaccagcgctctaagtcagatgccactgccagcataagtctcagcagcaacctgaaacgaacagccagcaaccctaaagtggagaatgaggatgaggtaaaattctggggagggccagagacaaaaggtggtagagggctgcatggagacaggatgcctcctatatacacacagggttacgctgttctttctgtcctccctgtttcatttcactgataaaagcatggaatgtt

SEQ ID NO: 6620 - DNA, 1180 bp, Homo sapiens
agccagtgctaagccagaccgaggcccgcgacttagtagaacgctgcatgcgagtgctgtactaccgagatgcccgttcttacaaccgggtgagggatgtgctgggaacctaattggcgggctctggctacttgcaatccctgggtctctatgctttgaagaacagattgccttacttgtgtgactcctattttcacattggggaagacctccacctgacctttcatttaaggacttaaggcgtgggcattattgaatgctctgctttcttccagtttcaaatcgccactgtcaccgaaaaaggtgttgaaatagagggaccattgtctacagagaccaactgggatattgcccacatgatcaggtgagtaatagggaaaaaattggtgacagacttgggaggtctttggcttacactaagctgggcttttctgggaggctcacccaggaaaattttctgggtggaaagttttggttggacagtacagctatttttaggaattgatccctttatgcttcacaattttattattctgtcttccttttttagtggctttgaatgaaatacagatgcattatccagaactgaagttgccctacttttaactttgaacttggctagttcaaagatagactcttcttttgtaaagtaaataaattcttcaaaatgcttgctgagtggtttttgtctgactgggtcacaccaagtgcaaaactgctgagtactgccatgtgccatctccctccctggtcggagaacccttgtggtcttgcagcacacacagaaattctctctgcacaacacagaaagacacactagcgtcatttggagctgtattagaagcagagcttcctgtagaagccagacttaatttttgtgtgctaactggcttttgtgttcaaattcccctcccaaatcttcctccactgcactggattatcaaatacagatttcttaatgttggctgtgattttcattaaaataccactttaaaaataatctagtagaactattctgcatcaggttgccctcaagtcagctggggcatcagccatccctggaatggttctaaacctgaatattttagagacaaaagtctcattctgttgcccaggctggcgtgcagtggcatgatcatagcctactacagccttgaatttctgagctcaagcaacctcc

SEQ ID NO: 6621 - DNA, 1767 bp, Homo sapiens
gccacggggtaagtaggagagaaggggattagttgagcaaggggaggaaaaaagatacaggttcgtactgtatgcatcaggagcatacctacttggcctcactcattcactgttgagatgtgctggacctaattagaaaccttccgacctgaagtttatataaaactgggaaagctggtcactgcgaacagcgtatttgtatgtagtaagttgaatcccagggcactgtctttggagggcttattttttcactgagctaactatttttgttgtttcattttccataggactcacttggatagctcactcaaggtaacaaaaactcacctcacaatttaatttctggtttgcagtgtgtttactctgttattattattattattatcatattattgtttcaatttcctagttgaactgagatttctcctcttctctttgctcctcacccctttaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctg

SEQ ID NO: 6622 - DNA, 1229 bp, Homo sapiens
gtggtagtccccatacccctccagttcctatatttttgtcttcttcctttcccctctttgccattcctaccttgcatttttcctgtcagtgccttagccaaggcaaggagataaggatgctcttcttgctttttatatctgcacattcatacctctccaaagaccagcttttccccagccagggccctcagccttccctgctgccccagtgattgattgagagagctgttggggtttctctgccaatgacccctgggagagggactttggtagggtcatgataaagtggcgggggtctggtcctgctcagggttttcatccttcctcctctccctcctctgtgactgtggatatggttataaggtggttgcacctgggagccctgacaactggctgcacaaattccaaaagtaaaggtgtcagtccctgtggccttccttggggcttctctgaccacatgtgcccaacttcaataagagaaccaagggaccctcattttctgaggtgcttggctctgattcagggctttgcaaggggttagaagctgactgtaaaaatgggaagaggcaacggaagacatttatttctcctttggattttggggagaaccaagccctggtagggaagaggtaagggggatgattcacctccatatttcctaagcaggttgtatagggagccggtggcaggaggaaggctgttttcacaaatgacttgtaatgtcgtgattaaaaaaattcctatattcttctgcaaatcaaacgttctttcccaatccaatccagccttggttttattttaaattaaatattaaaattacacatttatattgaaatccttggtttgtcttctcattctttttcttggcatatttggaggtccagattttatgaagtcatattaactgtacagcttaggagccgaagctggagttttcttcacctgacttttcagaggccctttagaacagagcagatgggacctacgaaacctggagatgtttatagcagccccattctcttctctcctgaacaaccttctgggaagaacaaggacagtaaatgccttttttttttttttttttttgagacggagtctcactctgtcacccaggctggagtgtaatggcatgatctcagctcactgcaacctctgcctcccgggttcaagcgattctcctgcctcagcctcctgagtagctgggattacaggcgcgtgcctccacaccc

SEQ ID NO: 6623 - DNA, 1215 bp, Homo sapiens
gaggatttcttttgaattaaggagagtaagaattgtttaccttttgctagaagaaaattgggcatcaggctaactttgaaaggaaaaatggatgagactcaggtatccattttttcttttaacaatctcctgattatttcagggttcagaaagaaacttagtatatctcttgatccagtctatatgcctgaccattaataccagagaatatacatcgaaactactgctttcagttgttttctcctctcacttgtgaattctgaatggggaaagggaagcgaatcaaaaatctcatctgtgtttgacctagactgtttcacgcaagtttcctgttttgaaatgtgaacacgttggcttcaacatgtttctttccttcctgcttatcttaaagattaacttctgctgcagccctgaagtcagctttatgacttgtaaatgtattgatttttttcccgttttcattggaactcacttcttctctaccacgttttaggttattgtctagctagcttgttacagggagagtgaagatatactgggccataaattatttctctatgtcttttcccccagaactacaatggtgtgtccgacgtagagctgagagtagcattaccagatggaacaacggttacagtcagggttaaaaagaacagtactacagaccaagtatatcaggtaaattaaatgaacacgtagacttgacattggatggtgtgaagctaaggaagatagattaaataagtcaatacatataaagtgcttagggtgtctggcacataatccgtttattaaatgttagctactattgttattattaatgtgaaagtactttgccctccttaaaagaaaggtacggtaaatatcccaggttgtagtagttgtgattaacgcctcctttttttttggagatggagtgttgctctgtcacccaggctggagtgcagtggcgcaatctccgctcactgcaacctctgcctcctgggttcaagcgattctcctgcctcagcctcctgagtagctgggactacaggtgcccgccaccacacccagctaatttttgtatttttagtagagacacggggtctcaccatgttggccagaatggtcttgatctcctgatctcatgatccacccacctcggcctcccaaagtgctgggattacaggcatgagccaccacgcctggccaacccctcctttttttattgtaaaa

SEQ ID NO: 6624 - DNA, 1862 bp, Homo sapiens
ctgccagttttttaaatcagatcaccctccatgttgttcctgacccacaggggaagctgtcctcagttgtagccgtcttgactggatgagtcctggcagtctttctaggcgaaccaagaatgtttgtgtgagggaaggtgtttgctgttgctttactgctgtctgtatgtgccagtgctggaacagaatttggaagattctgaataattagttacttattctcaaagaaaatctttgaaagaatcaggaggtcaagtcaagaacatgaaaatttatattttagtacagtagaaagaacattgggctctgggaattttatctgggttttctcctggcttttttttccctctgtgtaattttgggtaaatcagcctccctagctttcagttttctcttctgtgaaacaggaagactgaaccacgtaattaatatccaaggtcccttccggctctaaaaggctatgattctagatgagaagttatatcaagaaagatgtggccaatcagattgagtcatccaggcatacctttttagcttctgtttgtggagttgtctccagataagaggagatgtgccttcccaataactctttttttttttcctttcagaacattttccagatggcgaggtcacagcagagagatgtggccacctagcctttccttatccccttcccttcccttcacccccatcctcttactcctttcatgtcccatttcagacagagtaaccattaacaaaaaagaagagaaaaagttaaagtcgttatattcaaaagccctaaactaaatattattaataaccccctctgaatttcatgtctctggaattgaggtggtagtgaacagcagatcggtcagcaccagaagtcaactgagttaaggcaggaaaagaaataagcccaaccaacttgccaaaggtatctttgtcctttcacctgggcctcataccaacagcctctccttgtactatatttttaaaactggaactatgaacttcatccatttgcactgttcagacatatatatgtatgtatgtaaaaattatatatacacaaattagctgcacgtatatacatatatatatttctttttaaatttcatattgatggcagtaccttttttagcttgtgtttttacacacctttcactagaatccatgacctccctcgtgctctctttcttttgaaacaaactttaaaaaggaaaaaaaagcattttacagggaaaaatacctctcctcatgaaggacttgaaaagtttacaacctgcttggatttttgcccctttttttgtattgagtatagattccggctcatgggttgccatagagtctaggaacaaggagtatagtttctttatcttccaagagggtgctggggaggagaaagaggtgtgtttctcaaggttaacaggctgtagttctgcagggagagcctgaagtcctggtatgggctcttgattctgtgacaatttttttgatccatctatttctctcactcctggctttctagccacattctgcacctccttcctgctttcctagagcctcggtatgctttccctcaaccgaccctggctcaggaggttgatgccatgggaacctgaacctgaaacacttcatggtagtaatttcctgttttccttgccttttttttttttttttttttttttttctgagacagggtcttactctgtcgcccagactggaatgtggtggcatgaacatagctcactgttaccttgaattctgggctcaggtgatccttccgcctcaccctcctgagtagctgggactacaggtgtgcaccaccacacctggctaattcttcttaaaatttttttgtagagacagggtctcac

SEQ ID NO: 6625 - DNA, 2869 bp, Homo sapiens
tttgcagcagggatagtactcaggaccagagttaagctgataccttaggcacacaggttggacttacatagaggaaagaaagcaagaaatgccctatgtacatgaggttttacctcctccattcctgaccaataaccacccataactacggcattctctgtgacttccttaaacagcagtgatgggaagggatccaatagtatcttcaaggccttggggaaacttgcagtgggtcagtggtctgtgccaaccaaacgatagccccatccaagccagctgagaacctaggaaggagtagtaggaatatggttgattagattggatctcccaagttttaattgaaaggagactgaacgaaaacctttctgctttctgtccgttaaagagctcctcatctgatcttgcagctagaccctttgagacttaagagctgcatcccaggatcagaagccagggctaattggggtaggacaatattcccagcccctaagctctgtagataatgcataagaagcaccaagtcaggctcagatgcaactaaaacacatctttgagccttttctttttcccttctcccctttctaaacaaaaaccttcctaggatggcatcttttgctctaactgggagacagtcataattggttgtagtcaattctactaagcagtgttggggtggttggaaagtctcttttttgtaatttgtttttgcaaatcattgtgaggccactttttctttctttctttctttctttctttctttctttctttctttcgttctttcgttctttcgttctttctttctttctttctttctctttctttcttttgctttccttctttcatctcttttttgtaatttgttgttgcaaatcattgtgaggccacttttctttccccttccttccttcctttttttctgttttttttttttttttttcccagagtcttgctctgtcgcccaggttggagtgcagtggcacgatctcggctcactgcaccctctgcctcttgggttcaagcgattctcctgcctcagcctcccaagtagctgggattacaggcatacaccaccacgccccactaattttttgtatttttggtagggcggggtttcaccatgatggccaggttggttttgaactcctgacctcaagtaatctgcccacctcggcctcccaaagtgctaggattacaggagtgagccactgcgcctggcccacttttctttctttccttcttattttgttatgctggcagccatttgcccctgcatggtatgggatcaaagaggacagcctttcctccctcaccttctccaaatctaggtgaaatcacagagtacaaaacgtgagaatgctgaatgtgtaaagttgcagagggatccctaatttgaagactttgacacagaactaacttcttttgacttaaatgaatttaaaatgagccaaaggaccctgaaaagaagacatgttgatttcccactcctagatgctaaagagacttggcaccagctttgttcaaactgtaaaaatagcaatttgcccctactcgctcagagtgggacagtagtgaacagagctgggattccatgcgacagcttgaatgctgaccttcagacatgagacatagggatttggaggccccttagaatgggtagatggtgttatgttccctttctggcatagcattcacttggtgctttggagattaggtgagggccctataggtagttggcctgttggcagaatttatttaggaacagcccttttgaaagtgtcccagtaacaacgcacccagctgcagcaaggaggtggggaaggagggcaccccaaaggacagcgccttcttctcttccacccatgcacggccttgggtgatggaggcgggttccctgtggctgcgtggatcccataggatcaagcccttctttgcatgaagcagtgttgtgactcttctctctccccttcctctgcacttcctttctgtaatccctactgttcttcttagtcccagcttctgcccagggaggcttctacccagacttcttttgcaatttgtccctgggaagagggggtctcccagtgcccccagcttcatcccagcagaaccagcaggatcctcctggtctctcactggccttcctccacacttggtttctatcctcaggggtagaagctcagagctttttatggcccaggagaaaatgtagaccctgagaaacctgtccctgcagaaaggttcccttgggccatgctttgggccctctgctctttatatgtttattctattctccatttttccaccccgtccttaccctaggcctaaacacaggtacagatatgtgcatgctcagggcagctcctaggcctggactgagctctcaggggggaattagataaatattccaacatcctcatgcctggcccatttagtttcatcctttagttacccaggccagtagctttgggttatcccttcctgtagctccaaacccagcacttggagcagcaaaatagggcactgacaggagatgaaactctctcctatctcagaatttgccaacttctgggctgggctcctaggaggtagttttcttgaaggggactgcatcctagttgacctgaattttccagaccaggagggactgctgtgctctcccttctcgccatcatactgtttggctagattcattcagcagtagaagctgtttgatctgttgaccccagcatactgctgtttcttcaccagcttcattgtgtcacagtagcttcctttgggaggatgatgtgatagaacactcagagagagggagggagaagagagatagtgggtatgcttctctagctccccatcttccaggtccacctct

SEQ ID NO: 6626 - DNA, 1111 bp, Homo sapiens
atcctgacgcagtcggtggagagtaaggcccgggccgaggcgcttcctctcaggctggtccggtttggcatcagctttttctagcccgtccccctcaactatttgccttgctttttctttgtggaaacaatccaactctatatgtgagaagaggaagccataaaaactattgtgattgtgacactggcctccagcattgaaaattaaaacataaaggcagcaacatcattaacagtgtgtggggagaggagcctgacaatttgtgccacagatactgaaatcctccatgggacgacaactccctctatacaggggatattaaatttatacatcaagttctaaagaaactaattagcagtctcttaaatcttgttcctagtgaatatgaattagcatttcttttaggaaaaataagcactgtgagaaactaagaggtgcttctctttttgacatcttttctttagggactcctagatggttctaattcccctgtctctgttctaattgacagatgttggagtccggggtgacctggtctcagtgaagaaatctttaggccggaatcgactccttcctcagggactggctgtatatgcatcccctgaaaacaagaagctgtttgaagaggagaaattggtgagctcaaaggaaggacagagagacttggggagataaaacttcttttctcttgcagcttccttccctttgacatttaacttaacttgaaaatgaaataggaactagaagaacaggaatgcagaagcccagccaatgtccaacataggaatagtttgatgctatttaacatgggctcatttttcttttactgcttttcatctttaactttcttttctagctgagacaagaaggaaaattagagaagatccagaccaaggcaggtgaggcggtgagtagaaacataaaaagtgtttatttgtcacaagacttaccaacctcaccctgagagtctccctgattcccttgaggtctcctgattgcagacccaagagtgggagaaaggggaagtgttgtggctgccccacaaaacaggtatggagacctcttgggagatccctgatgtgttgggtgaagtgccttaaagtaccaaggg

SEQ ID NO: 6627 - DNA, 1179 bp, Homo sapiens
aattttaataagagaatgtaagtttaaaccataaaatgaggagcttagggtggttcttaggcagaatctaaatatgaaattactgaaatgctcccacaaggcaaaaaaaaaaaaaaatacatttagatgaactccaaaggttgcttatgacctaaaacaagagctcaagtaattgggagatatatacacagttctcagcagtacaaatcaaataagctcctcattgcaacctttgacttctatttcttgcctttgttcttttttttttcagaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttccaaatttgagacagaatgtttgttgttccctcagaaattcttgttccccaagaggcagcttgcccttgggcagccagcacacagcagagcttttcttacacagcagagcttttctcacagaactggcaaaatgagaaaacactcttcattcaggcttggagtctgacttctctaattgttctgcccttgtagctgtgtctatatgaaggactcaaacttgaaggattaggagaaggctctacaggaatagatggtaagtttataattactgggcacagttttgcccagttaaatcagtgcttttctagccagcactttgcatgcctgcaatgtctgaatccaattttcatagcaaagtgtcagcaaacctaaggcagaactaggagaaccaatcaggagagggtgtagcttgacaccttggtaataacatcacattagcatctattaagtcaactcccagatgtcaggaaatatggtaggcatgacttatacacggggcagt

SEQ ID NO: 6628 - DNA, 1235 bp, Homo sapiens
cagctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcggtgagtggcctcctccccaggaccccttttcccacccttgtcctttggaagcaggattaggggagagagaggtgccaggtgcatctgactcacatttacccacattctgaggccctggtccacatgtagaccctgagctgtagacccactctcccagcgggtaggggatgcttccagccggatatccatctctccaaatgaggaccagtaactgagaagtagctgaggagaagcaatgccaaagtgacatgggtccttggtgatgagggagcacagagccacttgcagagaggattgcctgggagggggaaggggaagaatccagggttgtcatcaccactgagtatggatttcacattctaacacattagaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttacccttgcgtcctggcttccgaatgatttctgttcctccttggcttagtgggacaccagccattggaagatttgctcacggtcaacctctgaaaatgactcattgactcgccaggccagaggacccaccctgacaaggctgcctctagcacataaggtgcctttatgtgaatgaggagagatgcccctcttggcaacgccatcctaaggaaaggctcaagtggtttccagtagagagagtcctgggatgagcttggagatggaaatggtccctgggccgggatgtgatggggtttgggggcctggaagtgaggcagagatagtcccagaggctcccagatgtgttttgctctgggtgtggcaagaggggccctggggtggggcaagtcccctttctcatcacagcgcaggggttagatagggcacatctgagatgcctgaggcttggctcagggagtttcctacaccagtg

SEQ ID NO: 6629 - DNA, 1102 bp, Homo sapiens
aaaggcagtttctatctctgacaactttgttcattaagagtgcctttgtttaggcgcggtggctcatgcctgtaatcccagcactttggcaggctgaggcgggcggatcacgaggtcaggagtttgagatcagcctgcccaacatggtgaaaccctgtctctactaaaaatagaaaaattagctgggcgtggtggcgtgtgcctataatcccagctactcaggaggctgaggtaggagaatcacttgaacccgtgaggcgaaggttgcagtgagccaagatcctgccactgcactccagccagggcaacagaggacagagtgaggctccgtttcaaaaaaaagaatgcctttgatcagtgatttcattaagttgactttcgaccactgaaatttacttaatgtctatttttgcctcttctgaggcatatgtgcttctctccttatctctttggctatgataagctaattatttatgtttgcataatatttatgtttgcatgttagtgacatatattttaaaatgtgatacactcctgtaatttatgagagtatgttcattgctgtgagctttgaaggtgctctaatccttcctcatatttggccttagaatgcacctcggatcccccaaggtttaggctttcttcatttgtctttgaaactatatcttctgtctcttgtcatatctgcttattgcgtgtttttcataccttccacctctctaaaagccgttacctgagccctcgttatcacttttggttgaatgtgctgcacttagctgcatttctaagtttctgattcttgcaagtttgtggaaacagaggagtctttaacccacatcagccttgatctaagtgtaccactttacttaaaagttcgtgggatctggagctcctggtctagcaagccatgaaaatgccaataaatgtttgtaataaagcttttatttaaacatccattttgttcgaccttgaagctttactaatatgctgaagaacaaacagccgacgccagtgaatattcgggcttcgatgcagcaacaacagcagctagccagtgccagaaacagaagactggcccagcagatggagaatagaccctctg

SEQ ID NO: 6630 - DNA, 1520 bp, Homo sapiens
tttagagatgatcatgtgatagaggattcattatgtgtgctttccatgtgttgctttctacccattgtgtttcctttttttccagatttctcctctttgccctgcccttcagcttttctcagctaggccccactgctctaaggggcatttactacagcacctattaaacttacttgtaactgtctctttttttttttttttcccctttgggccaggtcggggtatgataggtcggggaagagggggctttggaggccgaggccgaggccgtggacgagggagaggtgcccttgctcgccctgtattgaccaaggagcagctggacaaccaattggatgcatatatgtcgaaaacaaaaggacacctggatgctgagttggatgcctacatggcgcagacagatcccgaaaccaatgattgaagcctgcccatcctcccatgagagactcttgttagtcaacacatctgtaaataaccttgagataacagatgagaagaaatctgattgatgctggatggacctatcacaataggctgtggacttacttgccaccagcttgtgcatttagtgtgttccttttactttttgatactgtgttgtatgaaacccttttgtcctttgatttggttttttgtttttgtttttttaggggggagggggggtttcccctcctttgcccagacttctctttgaacacaaatgcattagccttgtggctagaacaccctcttcctacctctgtctcccctcacttgtcatatgctctgacatgctaacatttcttttgttcatccctgttgcccccacagaaacatcccagaaaaaccggtcagtgttccttcctccctgatccttaggtttctgaaatagggttctgttacatcctcttcgatagcctgtttaaaatgtttagaaggtctggagctcaaaaatgcgttcttccacattgataatttagtaaactgagaacattgacatcactacagggcagcataagaggttgcttacatgtggtagcagctctggtttgattcaagttgctaccatgtacattgacagcacatataccataaccagcgtgttgggttgaattgcactttctacctttgtatgagatttacagactttccttctgggtttgtatcatgaccagaggggtactatagggttggtttatactgcaatatagaggatcagaagccatttgatttggtaggtgtgtcagaagggagaatgatggcagacgaactgctggaagaggtcagaagatagccatgctaaaatgcaattatatcctcatgtttatcccaaactaatcttggacttttccactcattagctttgttttgcccttgtttcccttgaaggtttaagttcaaccatattctgtcaactgttcagtttcagtggaatcttgtatttctggttcattataacaaactgttcgcttaaatccacccaggactctctttatttgaggtgcctcaaaatgccatggctactttaatgatgttttttt

SEQ ID NO: 6631 - DNA, 1469 bp, Homo sapiens
gtgagagtggcaactttagagtacacacagtcatgaccctagaacagcaggtattgggacagatatgaactgagttgttttgccccactcttttgaatactgctgctcagcaggcaaagcggaatatggtctttacgggtcaggaatttggggattctgaaagactttggtcctgagatttaaaaagctgtcttaatctctgttttcagaagggtattactcaaataaggtcctttgattttccttgcttactctcactttgctttccttcaggacatggtctgctatacagctcagactctcgtccgaatcctctcacatggtggctttaggaagatccttggccaggagggtgatgccagctgtgagtgaccactgtgggtcaggggttttgtattgtaatctggtacagagaagctgtacactacttaaatgtctttaatatttccacagtgtaagtaatgacttttatgctgggctactcgtctaaatcacctttttctctttcctagatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtagggctcttggtctttctggttggtgttttttgtttgtttgtttttttgcatgtggcaaccttttttgcttttggctttgtgtactcttttgttgaaaatgataattgagtcatttaattataaatactcagatcacaatttgaagctgtctttgaattaaaggacaaactcctggaacctttccatataccagagtaaactagaatatcattttaagtatttattgaataaaatgattctatcaacactgctactgtattcaagccagtgcaataaaaaagtgggtggacagaggtcattcactttgactttgcctgccccctccaaatccccagtgtaaacaggaaaatgagaagtcacaggtagaggacatgctgtccaggcccatgtaaccaggcatgtaacatacaaaggaagcccctctggttaactagtcct

SEQ ID NO: 6632 - DNA, 1155 bp, Homo sapiens
tgatctcagccgagtactggagggaggaggggtgcagatcctggacacagggtactttcctcccccttctctagatgaggccctgcctaccccacacacctccagacataaactctctacaccacctctttggccaaaggtcagcacaggttggacttctttgctgccagggatgcaaatatttattctaccactgctcccacacagaatcagccaccatggccagtcctctcagctctggctttatctctagtagttccccattcctttctgtacacacatgctttgggaagtatcagagaaaacccacacccctgatggtgtgcacacataaataacaaaacttgggggcttcaagttcttgaagtcttccagcatcatagctgttggatctctgtttaggggtttattttagggcctgtgtctggctgacccagtcaaaccttgagatgtaataaggaaggagagtgggctatgggataaaagctgaggagcccatccaggactcttcccctctctttttccatttagtttccagatgaaaccttgaggagcggagagctgctgaacatgatcgtggctgttattgactctgcacaggtgaacattgagctctgacctccccagaagatctgggaggcagcattagggacatagggcctctgctctccctccaggcctgcagacagggagcccatgcctcccaggcaccctccctcctggctacagtggtgtgcgctttcagccatggggcctgggaaggaaaagtggaacacaagcaaggcaggctgaggttaggccaatcctgcctggagttccccttattctccatattctttgggcactcctgttccacagcaaaagctgagggggttgtgattttagctctcaactggcctttcctttggctcggaatgaaaatggtcagaccatttctacttgacctttttaccatgcataaggtccccaagaggctgtagctttgctcgggtccttctgaggcctgcactgggatcccatttctcctcctctccacttagttctcattcataaaagaggaagcttagcacccaagaatcctccttcctttgtctttaccctgcccaacctacatccagagcccagcctctcagggtcctttcctcctcaggctta

SEQ ID NO: 6633 - DNA, 1252 bp, Homo sapiens
cctgagagactataaatggtacagagtgtcctagaggaagtgggaagcttggaggctgtatggggctgtgacttcacaaccctctcctgcccccttcctccagctggaagccaggttggcccacagctttagcagggtaggggtaggggagcatctgcatgccacatgcttgtgcttctgcctcccaggcccactccctgactgttctaggggaggaggaggagaactgagggtcctccttcccaacacacacacgcacacgccttctcctaccacagcaagtgaagaatctcacttcttctctcctggcttccacagaggatgaaaccaggcattccttggcctaaggagaagagggagagggatgtgagagtagtgggtgggtggggaggccagggcttgggaaataagtgggagagacccagcatgccctgcggccactgtgcaagcagcacccagtgcccccttcctcccccaggcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagaggtgggacacggtccctgtctaccctccaggccatggcggtctgcagtgattgctgtcggtggtggtggtggtggtggtggtggtggtgatgggggtcagtgctgtcccagcctggtttgtgggcgacatctagtggtccgaagccacatggcatgcgagaccaccgtggccctttctccccatcttccagtgcccctgtggccaggatcccctgttctaggcacacctttctcacccaaccccagccctcccaggctgcctatcctgttccccatgtaggctgcctctgtcttaagggggccctggcgggtggagggtgtctcgcactctggaaccctcccacactcagactctggctctggtgattcctgcacagcctgaggagctctagcagcaagctggcccagctgactctggagcagatcctggagcacttggacaatctgcggctcaacctgaccaacaccaagcagaactgtatgccttccaccctcggcgtccagtgtagacggtgctgccctggcccagactatgcctggagccaggctgggggcaggggcaggacacccggggccacaacccacactcgggataaaacaacctgtg

SEQ ID NO: 6634 - DNA, 1428 bp, Homo sapiens
gccagcagctgcccaggctgttaacttcccatttcccctcccatctcttccaggaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgtaaaatcagaccatagtggaagtcctcagccccctggccccttccgcaatctcctcccccagtctcccaaagagccatttcaacagagaagggaaatgacaaaggggcagctggccagataagctaggatgagagcagagactcagtgtgtgggtgtcccttcctgcttccccttcaggtcttggtttgttctgaagggacgttttatagtcactatccacatgccagtgtgaaatgggcatctatgacgtggtcagggtgtccattcctaatcatggggcagatgccacaagcattcagaaaggagtctgaaagggtggccacagccccacgtggtgtgccctggaggcttaggttggtctgaggttggcacctcaatctacaccagagcccagggagtcccagaggcaagtttcacagaattgtcaaatgatcccatttccttgagtctgtttttttttttgtttttttttgttttttttttggcagagataatcgtgtcttaaaagttgtttttaaatgacaataaaacaagccagaatgtcttttgtgctggagtgtctgctggcatttgccccgtgcatgtatagcttggtcttgatttgattggcacccctacttgtaaccgcagaacatccccctttcccttcctgttctgcccccacttttgtctagagcagaagggacttggctttggccactacccatccttcctgctgccactggaggtgggagccaggcactgatctgtctatgcagaaccatcccccgtaggatgaggcctgtccttactcatttctcaagaaacaagatgcttccaaaaggtctgtcatcctccagttgaagtctgtgtgcctaccaagaatggccggaggactcgctgcttgacgggagggatgctccagcttggtctccagggacaactgtacctggagataaagtctggataccagggagggacagagatgctcttccttccacagtgtggccacttgctgggccatgtgaaccagcagaggagagttccttggct

SEQ ID NO: 6635 - DNA, 2125 bp, Homo sapiens
gtattttaaggttggtgtcttactccctggaagcctgaaatgggtggaatagcggtaaggcttgagtaaaactaggggacagaggttcttatttgtcgattttattttataatttgaccacagcatctgaactccctctctccctggaataagtatttttcccacatttttggatatatgtatggtagacaatttttttttaagacacagagataaatgttttcctgctttggttacctttcctttcccctttaaaaggaattagctatagaactgctttgtaaagatgcttcttgatattttacttttgttccttttccctaatcattcccttttctccccactcctccagaaggcataacccttctctccacaccccctacccccacccccgtcctaggctcccatcctttccatcaagaccttcattagcttatgatatttgctgccgagatgttataacaaggactcgttcatgtatataagctatttcttgatccatttaaaaggaattgtacattgtgtagaaaaaaaaaaaaacctgaaaaagagaaaaaaaagccctagccatggatattgtgaaactgtgttatgtcattttgtaatgtgcccgtttgtgtatgatccgtgcaaaagggtttctggggaaggggagggggtagggaggcagggctgtggagggtgggtaggggagtgggccgggcccagcacactgagactggcagctgctccaaccccatccctccttagagatgccacctcccccaccacccacccctaatttgtgccttgcctccccaccctggagtagtccctccgggtcaccagcactgccttggcagagcccactccctaccctaacctgcccaccctccctatcccccagcattaggttgatactgtggggaagtgctgggggctgggaggtagccgaggaatggggcagttcccgggggcatcgaaaccaagtattattatgaattgtaattgtatttgcactgtttttttcctctgattgcatcagcatatatacaatatacctatataacaaaattcagtgtcaagctttcttatgcaagggatttcccccaccccacctcctcaaaaaagaaagaacctagtcttatgggcctttgagggtggattgtcaggggatgatagaaaggattttaataagtcatcctgaggaaatttcacctagtgagagccacatccatctgcacagccttaggctgcgtgaaccgaggtgaggctgagctcctgtgaaagccaagacctcctggtccaggactttgtagagtaaaaagaaccaccaacacaaaaggggttgagggggctacaatctggagacctggggtctcctactaacttgctatatgatctttggtagagttaattttctgagtatcaattttcttatctgtgaagtgaagagggggatcatctggccaccaagtttaaaattctatacttctcacctgccaaaaccaaaaaacaacttgaggtgaggaaagtgttgggcccagaaaccagggaggaactgaaagtgactcgcgttgaagtggttatgtgtatgacaatgctcttggagaactgccagtcctctatggttacccttgatttgggagaggcagcagagtcatgtccagggcatcagaccagtgacatctttgcctttatgcctctagtcatctgagggcggggactaggcctcaagccccatctcacagccaaccacagagcccttaagggtggttgacaattgaatgccccaggttggtgctttagttatttactccctttgtgagctacaggatgtgtaacttttcccccatcttggtgataaaataggagagcgcagacacagcccacattttgtctcctttcctcagatttcatctgaaccccgctaaaggcagctgtttcacagtctgtctccttcaggggcccaatttccccacagcctgggctgagtactcctactctcttctttaggttctgggctgataaagcctggagagggtacagggtgatgggtgaagccctggtgaaggtgaaaggatagattggggttggggggtggggagcagggaggtgggatggggaatggccttccctgaatagg

SEQ ID NO: 6636 - DNA, 2870 bp, Homo sapiens
ctaccatacacggaaagcaaaacagaaaaacagaagacaaaaaatagagatcagcaagaaaacacacgccctgccctgccacctcccctttatttcacactgctgcgatctgttcttctgccgctctgtcttctctcttcagttttctttaacagtgaggtggatctttacctctgatagaggtcagaatgaggtcctggggagaatctaagccctccgatgtgtgtttctaaagttgttttatgctataattattaccatttttaatgatgttgtgtgtcctccctttgttcagtggacggttaaaccttcccccactcaaccaatctttttctttttccttttcttccttttttttttttttttttgtaaacacaaatgacattcagttcaatgatacgagcattgcagattgcagtaggggtcccagctgccaagtaggacatgactaggagtgttaggggcagaagttttgaatgcacttaaccggaggagggcgcagggtggggggtatcaaagaaggacgaatagcaccctacctgtgggtgtttgggggctggacaatttgggtggcagtgtttggtactgaagttgggctctaagaatgaggggaaagagcctggggaggagcttaaaactcaaccactctggaatttacccatagaagacgggaagaaagaggtatgaagatgggctcaattatgagccagggaggattgaaactaggtcctgcctttctgtatcttggggaaataagaccgatctcctgaccccattgggaacacggaagtctattccaggccaaccagcccaaaattatttcatcttgtattctttgtaaaattctccctcaccccaccctgcttttaaaaattctaatctatcccctctaaccatagccccatctataatacagaggaacggctgttccaaggctgtttgctgggtgtcccacaagttgggtggacataaatgagtcaagtgacaacaggaggaaatagacttagacgaaagaaaggatttctcttccaacagttgagattcgcatatttgcctattctttcaccctctgagtgccaggagatgagaggctgggggtacacaatcaggttggagtcctgtccttactctgctgcaccagctgcagaaccaactgctcaaagccaaacagctcatggcaaaaccagcttaggacctctgctgtacaaatagttgcttcccactgccccccgcccgcccccagaatgatattaattttgccttttttttttttttttttttaagcgctactaatgtagagaatgaattgaattgtgcaatgttgctgttctggggactggggagattagcatcccatttgcccacactgtgggaagacggagtggaccaggctgtttttgaagtaagggaagccccttaaaggtacgggtttctgctcttctcatagtgtacacccacctgcctctctggctccagaagctgccagagtgcactggggggaatgttctcagcagagaagaatgaggagaagtttaatattttgcccttgaaagtcacctgaggaagtttccccacttttattttttaaaattaagtaattttttaaagaaggcacttttaaaattaacacacacatgaactgcacaccttccccataaaatttggaggtggggtgggagaaagagctaaaatcaggctcagttcccctactctggcctctactccccacaccccagtgccactgtgggtgactatactggccctacgggccttcctggcttttttctttcctcccttaccccaaattcattgagcacttaaaggagcagagatgcagccagtgtctgggctcccccagtggtgaaatgatctggaagctagatgctagtaacaggtagtgattgggttttttgagtatttttccggggaatgtggtacccctgactgtaagtggtgggagagggaggggggttaatggaactgggtctgggattattttaaaattatatatatatatataaagatatattcttacatcttttctttgccctctgtgctttgaaagcactggataaattgtttggttttgcttttctctcttccacaaaattggaagctttttttaaaaatgttttccccacaagtcatcttgccttgtggcatgtctgtctagcctcttcctccctccctcatgatgaagtgccatttctgttacgtctccctctccccaagctcagaggtgctcagaggtacgagatgcccaagtttgtcagttgagattaaaagtaaggaacagagaatgtgcaataccgtctggctgggggctgtccctgccctgccctgagctgagtcctttccctgggagccaggccaccttagaatggggtttggaagtaagatgtatagagttggggaatcatggagaaggaaagcctatagtcgagtgcctgcttaggtgctgaggtcacaggggagatggtggaatcttccctgtttttatcccctcagggtcagttacatagaagctgcttcttgactagtatagctcggtgaccctttgttcaaccgctgaggtttgatttcttaccctttcttctccccattttcatactcttcccagggattagtgatggaggtgaggtctccctaatcatggtaaagtgttaaccttccacctcctcccttccctcctccttcctcatccttctgtcttcctcaattctccgtctcttttttttcatcactgattgccttgtgtccctccaagtctacttgttactatccatctccaggctctgggccgtgtagacactaaacctcatgccctaaggacaggaggaaagaccctctgtttggagcattattagtag

SEQ ID NO: 6637 - DNA, 1309 bp, Homo sapiens
aaaaatagtgcttcttatcaggctaagcacctgagttcttcattttaaaaagcatcttaaatgtcttcagattttgaatctgctaaccctggtgacatgcagtttacctatataacaaacctgcacatgtacccttgaacataaaataaaagccaaaaaaaaaaaaagattttcaatctgtatccatgtagaattaagggcacgtgtcaacaggccttgcttatgtagatttaagtttacttaaattgctgggttgaatgcccagaaatctcctttaatataaatgttctaggacaatatcaggtaggacatagcttagttaactttgaactttgtgtgtgtgtgtgtgtgtgtgtgtgtgtgtgtgtgtatgtgtgagagagagattcttgttaataacttcaccattccacctttttaaaaatggactatttaagggactttattctgatcttacttgtatttttctttccataggatggatagaatgacagaagatgctcttcgcttgaatctgttgaagcggagcttggacccagcagatgagcgagatgatgtcctggcaaagcgactcaaaatggaggggcatgaggccatggaacgtctgaaaatgttggcattgctcaaaaggaaggatttggcaaatcttgaggtgccacatgagttacccaccaaacaggatggcagtggtgtcaagggctatgaagaaaaacttaacgggaatctcaggcctcatggagacaacaggactgctggaaggccaggcaaagaaaacatcaatgatgagcctgtggatatgagtgctagacggaggtatggctcagttcagctgcctccagggatagggtcgtctcataaagcctgtgaaaatggaatgaattccaatgagaggagggtgtttttcatcctaaagattcttaaaagaagatatatcatcgagtttgaccataaattcattttatttccaaatgaaaccaggtgcctcaaaaactgcttagcctacagagaatcgtagttcttactcttaagagaaaaaatggtcatttctagataaagggggcactagagagctgataggccaaatggaagtgagttaatatataccttcattctaatcttcatggccgtcttaggaggagaaaaatagtctttttgtcagataattccaggagttttaggatgtatttattgtggagtcccagcttttattacatccaaaaacatgggcctagcttttcttgtgtcagaaagcaaattatcttcatgtggtaagtctctgcattcttgctgtatctgtaccacttccccc

SEQ ID NO: 6638 - DNA, 1164 bp, Homo sapiens
tctagggcacctgcccatgctcaagggccagcctctctgcacggggctccaggcagggctgcagcctgtgaagtacagcatcccttctcctccttagagcacagacccttcctcagagaaggtgctacttcttcccacaccactttagggtctgtcctggtggctcatgcctttaatcccagcattttgggaggctgaggcaggcagatcacttgcgcccaggagtttgtgactagcctgggcaatgtggcaaaaccttgtctttacaaaaagtacaaaacaatcagtcgggcttggtggtgcgtcccagctacttgagactgaggtgggagaatcgcttgagcccaggaggccgagtctgcagtgagccaagattgcgccactgcactccagcctgggtgacagagcgagaccgtcataaataaataaataaatagataagtaagaaagacctggcattgtactcaccctgatgtgtcccctgtcctacctaggagatgaaagttgcacagcggatggcacagaagtcagcagctgtgcctgagctgtgggcccggtgcctgctggggcactgctatgggctgtggttcctgtgtctgcctgcctatgtgcggtcggcaccctcccgagtgcaggcactgcacacagcctaccatgtgctgcgccagatggagagcggcaaggtggtgctccctgatgaggtaggcaatctatgtgaccatgctcatacccaggcccagtgagccttgtgcagctggagagggctgtgagagggaaacttggtggagactaaggaaagaagttgcagagccccagagctgggcagattatctataaacattcgtcgagtgaataagcatgttcagggtttagcagtgaagactgtagggtggcagggtcagcagaaagggtgggtggctctgaggtagccccaggacctgccaggggccagtgatgtctgtgagaattggggaggcaggaagagggtgcttgctgagactttggttttggttgagagtgagtctcccattgtcctgtgcctctcctggcccaggtgtgttaccgggtactgatgcagctctgctcacactatgggcagcctgtgctgtctgtgcgggtcatgctggagatgcgtcaggcaggcattgtgcccaacaccatcac

SEQ ID NO: 6639 - DNA, 1153 bp, Homo sapiens
tttgggaggcgcaggttgagggccgaggggcaggaagaaggattttgccgggggagaccgaaacaccggagaggttcggggtgtagaggcgactgggggccgagtacgtgaggtgggagtgggcggagaggggagatgaagtccggcggaggtaggaggtgagtggtccttgtgcatccctgacggagtcccctcgaggacgctactgaagcatgcctggtattggggtatggcctgggaggagggctgcttgtctgtaacctggctcctctgagtttgtgatctcctccaaactggtccctctgccttctgcgctttggtgcccccgggaaagggccccttgagtggtttgaacgagcggtgctgtgtatagtggggcaggaagtcccctcctgcgtcccgtccttttgcttcctttttcaaatacttcttgtggtttcctgacgtgaatgaaggtgaggtccattgcttggtgttttgtcctggcctccttggaggagaggtagggttttgaatccgacaactgggtaaccgtccgaccataagttgtgtggaactctatggtttgctgagctttctagggagttggctgctttgtgggttagtgtgtagggtgccttggagggtcttctatgtgttgagaatattcattcctaggagttcttgaaagaactttcaggcctctgccaggctgcctctgaagcccccctggcttggtttcttgctttccaaggctggaggtcagagggaccaaggggtaggagtccgcctaggtggtatgcagtcttaatttagggacacattcttctaaaacaacagtaggtaaggatattgcaatgattcctcatggcagagagctagaaggaatttaaggattgatggtggaacattactacaacatctctagcctttttctgctggtctgactgtggttgcatttatgactgtgactctggttgtatttttgtgtgtatcccccttgactctgttacttttttttttttctcgtcctttcccctttgagtctctagggactatgtgccctagtttgtgggagtcagaagttaggtggggaggcaaatctgggagggtgtctgtgcacgcatgtgcacacttaaatgcatgtgtgtgcataacccactgtaaccattgt

SEQ ID NO: 6640 - DNA, 1931 bp, Homo sapiens
gtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctagacatctgtacagtatctgattcgtttgttttgggaaaggggtgggcatgtggccagcctgagagggcctgagtcccagatgtttacagctgttttaagattcttggtctcactgttttcactcaggacccgatagtccccttccctgaagatgacctaatttttcctcctttgtgtcttggtacttctttcccggtctccacccctcggcttcccttctcttccctcccctccctcttcctttcttctctcttcaatccctctctcctttccgttcgtagtctcagggctaatttagaactactcttcccagcttgcacctctcagggagtagccgagagggtggagccaagtccccagtttccggagtcagcagggctgctgggaagtggagtccgtttcctcctagtgctgcgtgactggggatgtgaaggagtctcgtaaacaaactacaattcccggcggcccccgcgcgca

SEQ ID NO: 6641 - DNA, 1931 bp, Homo sapiens; identical to SEQ ID NO: 6640

SEQ ID NO: 6642 - DNA, 1156 bp, Homo sapiens
gtctatttttatattgcccttattcctctggagccttagaacaaatttttgcctctcaggagccttccaccgttcccttgaaatttgtcttcactctggaaatttattttcttgcaattccccctaaccagagttaaaatgagcagaaaatgttaagcaccttggaaagatgcaccactggccactttcagaacctaatcttggccaagcgtggtgactcatgctgcaatcccagcatgatgggaggctgtggcaggaggattgcttgaatccaaaattcaagaccagcctgggcaacacagtgagaccccggctctacaaaaaataagagaattagccaggagtgatggtatgtgcctgtagtcccagttactcaggaagctgaggtgggaggatacattgagtctgggaggttgaggctgcaatgagctgagatcatgccactgcactccagcctgggcgacagagtaagaccctgtcttgaaacaaaacaaaaatctttctcacctgaaaatacatgggtttttgcagaccaatggagcaacaggacgaatactctgaaaattatattcttcgagctaccactattgggcaaaccacacttgtggctattgccaaggacaagatgggaagaaaatacacatcaactcctcggcacattgaagtaaggaaattatctcatccaaaatttgtactttttcttgcttaacatcatttgtctttttctgttagtttatacaagttaaaaatcatttgactggctgggcacagtggctcacaccaccatgtgagcactttgggaggctgaggtgggaacatcacttaaacccaggagtatgaaaccaccctgggcaacatagtgagactctgtctctacaaaaataaaaataaaataaaataaattagccagacatggtgtgcctgtagttccagctactcaagaggctaaagtaggaggatcacttgagccctggaggttgaggctgcagtgagctgtgattgtgccattgcactccagcctgagtgacagagagagaccctgtctcaagaaaaaaaatcatttgactgaaaaaaaggatggtgtctaactcttgcacaacatgcagtatttttgggttttgtctctctgtataaaacagttcttatagaaaatttg

SEQ ID NO: 6643 - DNA, 1283 bp, Homo sapiens
tgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaaccctcagacctatttgacttttatttattaaaactaaatgtgctttctccacagaagctatgaggtttgggttaaaaatagcatctttgtgggtggtagcaacaggatttattctttattattattatttttgagatgaagtttcattcttgttgcctgggctggagcgtaatggctcgatctcggctcactgcaacctccgcctcctggttcaagagattctcctgcctcagcctcccgagtagctgggattacaggcacctgccaccatgcccgggtaattttttatattttaagtagagacagggcttcaccatgttggccaggctggtctcgaactcctgaccttcaggtgatccacctgcctcagcttcccaaaatgctgggattacgggcgtgagccaccgcacccagctggagcaacaggatttaatatagagcaaatgtttagttttatcatctgtaaaatggagataagtattgtcagagtaaaca

SEQ ID NO: 6644 - DNA, 1241 bp, Homo sapiens
gagatgaaacttgagggacaaagaagagtctagacttgaacttgtcctttcccaagcaatggaggtcacatgcagcttacataaaaaaggttgtaaggcaggtaaggctgttttcttaggtgattgaatacagtatttaaaattatttctctggagtgtagactaatctccttcctggaaggtttttgtttccagactttactgattatctttccttctgtcaaaggtacttcagatacttgcatctatgtaaaaggcttttgattattagttaaatgtaaagtctgcttatgggggactagtaaccaaactgctgtaacttcttaaaaaaatccatcacttacacatgctttatacatttcttgttacataaaaatggattaacagccatagctccttaaggaatttatcaagctaattatgttgtaagaataaatgaatcttattgatttgttcctttgaagaagtgaaagtgtttggtggtgaaggtgctgatgagagagttaaaaacatattttgcccacatttaatacctaattttcttttaaatctttcagtattctaccttgtaaatactgttatttgtatatactgtaaatgatgacatcggtgggcactaaccgagcccggggaaactgggaacaacctcaaaaccaaaaccagacacagcacaagcagcggccacaggtaaataatccaaggcatacggattcatggatagcgttgcctgctgatactggtttccatgcagtacagcatcattctgtgctttgaactgttggtttaggttccttatttttgttttctagtccttggctctttttttacttaggtcctgataactgttcatgacatgctgtaaggcaagatgcttacttttttgttgtttaatactgtattatgaggcttagcactttattatgggtcctgtgctttttatcttttttttttttgttttgttttaagataggagctccctttgcctaggtcaaagtgcagtggcacagtcaccattcatttgtagcctcaacctctggggcttaagtgatcctcccgcctcagcctcctgagtagctgggactaccagtgcacactaccatgccaggctaattttaaaattcttgtagagatggtagtcttgctgcattgcccaggctggtcttgaactcatgggattataggtgtgagtcactgcccggctctataactcttaagatagcatttcccttctcttacctggg

SEQ ID NO: 6645 - DNA, 1227 bp, Homo sapiens
gcattgggtggttgtctgtctgtccccccccccacccccattcctgctttgtaacaaaaactgaaagtagctatgaaatcataatcttattaaaaccctggtactctgagatatccttttctaaagagtgtttccttacctttgaagcccaagaatttctttttttttgttttgttttttgtttttgtttgttttgagacagtttcactcttgttgcccaggctggagtgcaatgccgcgatctcagctcactgcaacctccacctcccaggttcaagccattcttctgcctcagcctcccgcgtagctgggattacaggcatgtgccaccacgcccagctaattttgtatttttagtagagacagggtttctccatgttggtcaggctggtctcgaactcccgacctcaagtgatccacccacctcggcctctcaaagtattaggattataggtgtgagccaccacacctggccttctgattactaaattttagtcatacttttggctgccaaaaaaattaatacattgatgttttctatacatgctttgtactggcatttaatagtgaagttacttcactatttttctttattctcaggtgcatggaggactgcaacagaggagtgggggactgaagattggaatgaagatgtaggtattcccaggtcattcctcactaatgccttctatccctaagtgttgtttagggatagaaaatgggtatgtttctacccctcaaaattcacccttaagattctgacccaaaacttttacatccaaaatagtgttctgagccagaacatttcacatatgttatatgaaggagactgggcatgaacaggactctgtggaaccacactatggaaagggcaagtgcacttgtgtaagtccaatatctgattgtcggatttatcccaggaagagattggtggttgggtagggcaccagaagtggagttaggcaggtagtgcattgagtaacagctgctggtggtacatgactacttggtgcatttaagtatttgctataaggtcctgtaatggattggcagtggatccaaagcgagtgttgtggtaccaaatcctcaaacttgtaatctggttgactctggaacccttgtatttatttgaagcccaactgtataattgtgattgagatgaatatctgtagaattggctatctgccagcttgacttaacttggaaacctcatagatgggtggcacg

SEQ ID NO: 6646 - DNA, 1185 bp, Homo sapiens
gaaaattgtgggaaaaaatatctctcagactgcccctgttctaaagccatttgaagattccagtgttctggtatatgattttctgttttaggaattggtaatgacaggtattcagtattaaaatcatggataagtacttgtaagttttggctgagttattgagctgccatgttaaaactagcatttgaggccgggtgcggtgcggtggctaacgcctgtaatcccagcactttgggaggccaaggcgggcggatcatgaggtcaggagattgagaccatcctggctaacacgtgaaaccccttctctattaaaaatacaaaaaaaaaaaattagccgggcgtggtggcaggcacctgtagtcccagctacaggctgaggcaggagaatggcgtgaacccaggaggcagagctagcagtgagccaagattgcaccactgcactccagcctgggtgacagagcgagactttctcgaaacaaacaaacaaacaaaaactagcatttgatatttcattaaattaataacttcacttaaaaaattaaccattattattggcaacatcagtggaattcagctatatactgtagtgactcttatgcatcagttattttgggacatttaagcatttcaaggcttttgtgtttgaacccttttagaagaagccccagcaagtggcttcattttgatctaatctgatttgagtgttggggaatgttagcgtgttcagtcattcttcatgaagatcccttcccttccccattagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagtaggaaacgtggtttatcctaatcaaaccttcctgctaatcctagcacacatacacagttccttccaaagacagtcaggtttttggcaggtgaagcatcctctttgtcttcttaagcagacttggttgtagaaatgtttgagttgggtaatagggggtagctctaagagaggacttagttctggacagactgaatattcttataagaataagttaacattatttattgactactcattgtgctga

SEQ ID NO: 6647 - DNA, 1159 bp, Homo sapiens
tggtgctagtgcaggacaatagcatttccttgagattcattagcatctctggcttcatatactgggtttcctcttgcagatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaaggtacttaaacttttaggtagataccattttatggcaaggggtgtggggcttgagaattgagattaaaagggtaagtttggaaatttaaagggaagggttttttttagtctttagtaaggttgtattaaagccattactttctcttctccttcaactttatagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccaggtagaggaaacattaaccataagacctctcttattaacctttactacttttttaatctgtgggagatttctagaactctggagaggccaagcccctctgcatggctgagggggaaagtagtcagtcatagcatttttagtgctttaaaatattgttattagggttatctgtaactaaacaggtagaaatatgccccttaggggctgggtgtgatggctgacacttataatcccagcactttgggtggccaaggcaggaggattgcttgaggccaggagttcaagaccagcctgggcaacataatgagtccctgtctctacaaaaaaaatttttttttaaacacagagtttcactctgttgcttaggctggaatgcagtggtgcgatctcggcttactgcaacctctgccacccgggttcaagcgattctcctgcctcagcctcccgagtagctgggattacaggtgc

SEQ ID NO: 6648 - DNA, 1180 bp, Homo sapiens
ttatgctactactcacagtggcaatctcactgccttgccactccttcttttacctgacctatcattgtcctcattgacttaccgttttccctgatccatcgttgtccttcaagtccagcatggggtattccccatggaggagaagaggggagggaagaagagggaagatgaaagagaacacaagtgggcagagaaattgtgcaggtgccttattccaagagcctcctgccatagcattgcacagttattcaacattagtccttgacttgcagcaactgtgctaagtgtatgctgagcaacaataattggagccactaagaaatgtaattcaaggaattgaactttaatagtctttgaacaggatctcctggaatcatgtgaaatcagaagaggtaattctgtattggtattggggtgaaagaggcaggtacatttagcttctcctgtcacaggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtgagtacctggctttggtcactccttgtggtgaaggatcctagccctggacactatcctagctgcttttaagggtcaatgactttaataatggatgaggaggaacagtttccacctctggcctgtttttggcctgatgcagggtggtgggggaatggggctggaattggtggaattaggatagggattgcctagtcttagaatttgccaaagggagaatatgataccatacagctttgcttcactcagattcattcattccctgctgccattgtccctttttcttcctccaaactaccatttcttgacttcattagtagattctagaacagttagtaaggagctaatttcactaagcaaactgtagtcaacttgcatcaggataggtagccatctgaatggccagtacctggagcaggacaagtgggacagatggtattctgctgccaagtcactgcaaatctggcctttttgctctttaggtggctcctacctcttccaagcagcatg

SEQ ID NO: 6649 - DNA, 1217 bp, Homo sapiens
agcaggatggccaggtaatagcccttccccttctctcctttcccttcctcttccttcctatcccttaaaactgccttccctttccttttcttacccttcctcaccaccaccttcacccaatccctccccagcgccagtcatgggcacacagcacatacagacacaagcgcacataacacgagcggccggcaaaggaaatctcagagaagggccgggttgaaaccttttttgcccaattcctttggtgcccttctcctcctgtgccacagttgtcctcatcccatcagacctgggtcacaccttccctctttcctctcccagccttccctcttccctgacattttagctttcccttctaatggtggagttctattgtcaaagtttgtccctttattttccatatatcctggttctgcctcagctaccatatttgcagatgattctctgttgccagcgccagcaggaggagcaggtaatgaaattgaatgatcatatgcttgaacccactccttttcagtccccatttcaccttcacagcctcagggaacttgaaaagactgcgcggtcacaaatcgggatacacaaacacaaacaccttgctgagctctctggcctccccttcctctctcctcctcccctccccaacaccctctttatctttgtacccttccccagctgtggaaaacattcggttaccagaatggaaaagattcttggggcagcatctggagcctgaggcctcagactgcctctcatacctgcctgaaatgggctcacagatgtgatgtgtggtaggggtggggatctgtggggcgatgcaagtggcctcttgagagctccattataggtggctggagctagaataagggcttccttcctcaaagacagctttccaaattgaggcattaatggggatcaatggaaatgaaattgccttgtgatcacccatctccaagagcaggggagagagggggtagtgtgagaatgtagaattgaaaatgagtagaactcactcactaccttgtctctaaaggtatcttgccctcttcatcttttccctatttaaaagtcaaaaatgccttcctgcttgtaagaaaggggctttagcagctatgcagaccaaattttctatggttctaatagtagtgaggggaatgggagagcaagacagtttgcacatctccacctgaagatgttacaaatttgtaccactaact

SEQ ID NO: 6650 - DNA, 2479 bp, Homo sapiens
cccttccaccagctggggagctagagggagcaggcccaagggcagagcagaggctgaggcacggggagccagccccactcggggaccagaagtggaaccaaaaacaagaaaaaactgtgagagattgtgtctgcccctgccctgcctgggacccacagggagactataatctccttatttttttactcctactccccagaggggccctagtgcctctgttcctgaattacataagaatgtaccatgccgggaagccagagacctgcaggggcctcggcccctcacatcgtgtatgtctctccttgatttgtgttgtgtccagtttggttttgtctttttttatttggcaagtggaggaggcttttatgtgacttttatgttgtggttggtgtcttaactctcctgggaaaaggaggctggcacacactgggatgccgcagcctggccggctgtggggtggtttgggaggatccatgtcggctctgcctgcagtgaccagtgctctgtggggcagaggagctgaccagggagggaggtacccatgagcagagggtagtgggagagtgtaaaggagggtttggtcctgtctgcttcctcaccttgagagtaaagtgctgccctctgcccccaacacacacacatatcaattcctggattccttagtcctgctggccttgggctggagcctaggaaagtggcccccaaatccttagtgagctaaagctgggtctgaaatttggtcagtggggaggggtagttttcttttcttttttctttttctttttttctttttttttttgagatggagtctcactcttgtcacctaggcaagagtgcaatggcacaatctcagctcactgcaacctccacctcctgggttcaagcgattctcctgcctcagcctcctgagtagctgggattacaggcacacaccaccacgcttggttaatttttgtatttttagtagagatgtttcaccatgttggccaggctagtcttgaattcctgacctcctgacctgcccacctcaacctcccaaagtgctgagattacaggcgtgagccaccacacccagctcagggaggcgtagttttctttaattttaaatttaaacccaagtttattggcagactcccttttgacctccctttgcctccccatctggtgctttcttgcatctacaccccagggccctgtggtggggctgcagggggaagctgtgcacctgagatgaggctggaacgggaattggcctctctgctcccttcttcagtaagcaaggagccccgcccctcaggcccagcctctggcaagaggtggtggaatccttgtgccgggtagtagaggaggataagggcaaaaccaggcccaggccagtgcctggcttggtctggatgggacactgtcagagtttggccacagcctgtcctttacttcatccacacctatgaagctattccctaaataaggcatttcccaagttagtcgctacctaatcagccttgagaagaatcctttcctcttctttgatagtgggtcgggggattcttcaggaatggtttggagctgggagtgggtagggggattttaaatgttccatatgggagccccaaaggaactggatgggctgcagtgaggtgggggcgggtgggcagggaatgggagaggggaagtcttggcagggaaatcccttttggccacacagtttacaaacccagtatcatgtctgtctgtgtgtctctcaaggtgagagtctgatttttataccaaagaggaaatgattttttttcatattttgtttgtctatattatataaatatatatatacagttatatatatatatattattttttggttctctctcgttttttagggagggaagaaagtaccaagttgcattgagctgtaattaaggaacattataatttatgacacatttctatacttgcaaaaattatatcattttatggatataagagaaaaatgcctttttataaaatttcaatttctgagaagtgtgtaatttgtctcttttctgatgtttaaccaagactggtggtgaaagtaaagacagaaactgtctcttaaatgtaattgagtgggtagatctgggatatcttggacaaattggaatctgactggtgtgggatagcacctcatccatttgcagacctcccgggatctgagtttcagctgaagatgaagacggggcagtgggtggtactgagcggcatatcgtatggactttggctgggtgcctaggaccttgagctgtttacctttctccaaacgcaggccaacctgtcatccctaacacacgccagatggatgtgtgtgtagggaaagtacctggtaaatattgtaaggttttgttttttaactctgcgcttttccgcatgcctcacatcttcctggcttctcaagtgagtatcaaggaagctaaagtcttatattaaagggagctttcctccagggaag

SEQ ID NO: 6651 - DNA, 1122 bp, Homo sapiens
gttttacccacatgtggtgttaccaaagccgggcagaaccatgctagcggaagatgtgaaatccagatagctcattattgccaagagctaggcagctttgatctccaaattgttattgctttcatttttattgtaatggaattgctttgttttgtttttttgtttttgtattgaagagggttgttttccctttatttttcataagctaatgtaaatgaagaaaaaatgtcttctctgggctgtaggcctggctcagcgtacacaggtatacatcctaagctctctatgttctctaatctgtggtgactgaacatgtgtctcaatgcacggggcatttctacctgtgtttctgcagcacccccactgccttgagtccccagcagtgctgttatttgcctaacacctgtagccatctgccacgcagccagacgtgaaacgctgagacagagaccatttaggttaaatacgacagcttatcctgctgggtggggaaagtaaaaaatatgctggttcaaggcctaaagtaaaatgatcaataatgtttgtagcattaatgaaatattttcaagaaatgtgtccaggggtagcactggctatgttgacgaggcctttggtaactcagagagctcttggccctgatggggacttgcccttacgctttctttatcaggctctgagttcacacggagcctctggcacttccctgctgtcttgggagaaaggaaactggttgccgcggcaggttgtggaatctgttgctggaaccaggctggaagcccacctggtagtgaacagggcccagtggggcaggctgggcatgttgtggtctatgggtttgtttcctggagaatgttcaggaatgtcttcccagctgctttggtgctgagctctattatctcacagcacgtccagaaggctaacccaggtggggaggatgctgacaccagctccaggtggagttggtggtcttaatttggagatgcaggggcaacctgtgaccctttgaggcaagagccctgcacccagctgtcccgtgcagccgtgggcaggggctgcacacggaggggcaggcgggccagttcagggtccgtgccaggccctcctcagtgccctgtgaaggcc

SEQ ID NO: 6652 - DNA, 1834 bp, Homo sapiens
atatctttagtgtaagattttaaaaggttttttcagcatccattcaacaaatatttattatctttatacaaattattcattgtgttaaacttatttttagtttaacattctagaaatgaaacgtttttacttaaccttattctacaaagggaatacagcagttattctaattttaataaatgctaaaagctttatacaatttttctttgtgcactaaatgatttttggcccatacccagcaactgtgatgaatgtataatgaaataacatcttgaaaacaggccagatacattaagtatttattgagcttctgtcatatgcccagtattatgcttcttctatactgtttctctgtgacaagtcatactatattctttatagaattaaaagtagaggagaggcagagtttacatattgtccagttgctttacagttgtacaggaggttataagaagaaatatagtaaattagtgggaagtcagaggtgggggcgttagtgagctattttcttcttgaggttgtgacacaagctgacaaaagccagggagttcacagctgtgtggtggcacaaagttccatatgttctaaaaacaattaggcccagcagggtgtccctaatggcttccttgttaaacctccatggccagctgatctgaagctctgtgacatgttctctgagctctgaatgctctggctttttgtcattttgtcttgagacaagtattttcctgtagtcctcattccttcgagttattccatctcccaggatattctctggtgagaagaatgtctttcagtgaatttgccttgaatttagcatccatagagctgtgtcagtgttcttcttgatcacaccttctttaaaaaaaatacttgcttgcgatgactggacaagttcagttggttagtttcaggcctataagaagagagagtaaaggaccttgctatttactttgataccatagttgtatctcaggatggcctgcaaaccactggccttgtgtgtatttaagctaggaataaaataatggagaagtgttaatatgtatacaaaaaggtaaatattgatatatctactctctgttgggggcagaagtgtcattttaagttattcaaagcactttcttaagcattttagaaagcctttattctttgctgttggaagtctccgtactttgcagaattggtatttgtgtactagcctctgccgcaggatggggaggtgggcaggtagctgataggggcagccaggagtttttgaggcaggtggtgggaaattgtcctaatttgttaattggattatgtaactctgttactagtctgttattggctgttgttactggatgcatcttgatattcagaagaataactgtgaggcattcttcagttgcgggttaagtggggttagtttctgttctgtcagatgccctttttcagtcaaaggttagccccttgtttctccctccttccagggtttagggagtgcagtgatgtcgatttcatttcccttccccgcaccccttgacactcagcaggattgcactgaaacccttcacagatctctcgttcactagttgtctcctatttttccataactagcactagtttggccttatgacctggttagaatcactcttctgtattctcatttccaatttttgtgccccactaacgtggactagagaaacttggcctgctgtgcagtgggccttctgttcaacttaccctccaccgctgaccctgtgtgaagagagatggtgcgttactgccatctaatgggaaaagagaaaactgcagttgggaaaagcagctgtgcatttaagggtagggcttt

SEQ ID NO: 6653 - DNA, 1104 bp, Homo sapiens
cagtggtccccgacccctggcgcctctgcgtgtctgggctgggcttcctcgctcgcctgctccacggccccgacgctcctgggccgagccggccggggccccctcatggcggccaagtggttcaaggagttccccctgaacctgaagaccgtgtcggagcgggccaagcccgggggcggcggcggcaaattgcgcaagaactcggaggcgggcggcgctgggccgggtcctggcaagggccgcaagaactcggcggccgagctggggagcggcagggccggcgtcggccccaaggacagccggctgtcccgcgacagcctgcagggtctgattcaggccgccgcgggcaagggccgcaaaaactcccgggccacggaggaggagccccaccggggtgcaaccaagagctcgggctgcagcacctacatcaacaggctcatcaaggtggacactcaggagaagaacgggaagagcaactaccccagcagcagtagctccagctccagctcctcttcctccgcgtcctcttccccttcctccctggggcccgagctggacaagggcaagattattaagcagcaagagacggtaagaatacagcctcccttggaccacctctcagtcgaaggggagccctgggcgcctgctaagccctaggcttctttagacctaagaggcagtgaggataggtttcctaaggtcctttctccctccaccatttgggaattcctgaccatttaaaattcttagactgttttttaattcttgaaaaactcttattttagaggtggggagttttgcagaaatgtactagccattgaattttgttagcagtttagaagagtcgttgaatgagatattcctgtttggttacatttgacccctttatagatgtggttcattttaattttgatattcaggggaattgcaaagctaggcttgtgtatgacttttatgcttcttgagcataaggaatggtaacctctcaagtgtgtagatatgcatttcaaagcttcaggaaatggtttaaccaacagtcttctccactgatttggaagttccatcattttctgcggttccaccgagtaaagggctcctcggagg

SEQ ID NO: 6654 - DNA, 1247 bp, Homo sapiens
tagcattttaaggggggttgttctatacacctgtgtccttaccccaggctcaggaactgccagggagggaagatgaggtggggagtctgtactgagatggaactgtcagtgctgtgttgtatgtacttgctgttgtaaaagtttgggcatgactttgcatctagcgggtgctgcctgcatctctttgtctgtaagcttgctctgggactcagcctcttaggacctacgatgccagcagctctcattaacagtgaaatgacagaggccaaagatggccaagtgaagacccaagtctcagaaaacccagacttgggacaactgcctgggaactaggatgctagagcagttctgtaatgctttgagacacagcaattttcacattggccattctttcccctcccctaccccttttcttttgagggacttttaatgtttgctgctttaggtggatggagagtccaccagtcccactcaatgctgctctaactctacccacacccacctaattaggggtgctaataaaacatgctgaggttgagataaagacgggacataaggggaaaattcattccatagagctgaaatctggttttcaaggcctctgtggctttcttctgaacttaccaccagccctggctggaatgtagattgtgtttttagtaatgtgtactgtgagctgtcttctgtataatgtattttgtaatgtatttttctcatctaccaaaggatgaaacaaataaaattatttaaatagtttggctctaataaaattatttgaagaaacagtggggttcctgttcacttgacatagagggaaatgcctgcccctgtgagttgcataacaccaactaactctaagagaatcctccatttttcttgccaaacccagcactcccttttatgaccttaagtttagggttctaataaagtacaaagtataaaaaagaaacaaggccatatcatcatgaaacaattttcttctctccacttagaaggcaaggagaaataatgaaactaactcttaggttgttcccctacacttcaaacatgtatctatatcccaggcagggtttgcatggcccagagcccacactggcaggctctaatctcactgcagcagttttagagggcacggcagggcagtggaagggtggctggaaagaagtatcaatcactccaaactcatgaaacatgccaacatttatttgctcattggttaaatattctctacctattctacatggaat

SEQ ID NO: 6655 - DNA, 1139 bp, Homo sapiens
gcagtgcgtgcctctgcatacctgattcatgccttgcatttgtagcgaggagaggagatgtaatgattcaggtttctcctttaggcttggggccctgagaactcccgggtgcaatagtcacctggtgaaacatgagctttgagtcacagggtcaggcccaagtcatttctgctaggaattagggaagagtttctgctgccaagggagttttaggaacagttggagcagggtcagtccaggaaacaagagggctaagtccctgcctcgatctcagctgcagctctgctcgtttccgaagtccttgctgtagcttgagagctgaagatttagactgtggagggaatggggctggaaattgttctaaaaatggaaagcacgttgcgtttataagactgctagatggactgcttcactttaacttttggctcttcgccaaatgggactgggaaggtgatggtcattctctaacctgtgtcggtttttttccttttcttttcactcccaccccacacctcctccaggacacagaagacttagatcactatgaaatgaaagaggaagagccagctgagggcaagaaatctgaagatgatggcattggaaaagaaaacttggccatcctagagaaaattaaaaagaaccagaggcaagattacttaaatgtacgtgccttctagagagaggctggtgaaggggttggtgggaaatggctgggaagtagtaggccatcgcatctcagtatggagagcagactccttttttgtgcctaatcctttcttaaatcctgggcaagctgccagactgcccctaaggtctaacgtgtgtttataaaccacacgaccaaggaatgttcctgtcatccgtccctcacagggtgcagtgtctggctcggtgcaggccactgaccggctgatgaaggagctcagggatatataccgatcacagagtttcaaaggcggtgagtttgccccagagaggggcctgcacaagagtcacccataaagaagggtatggtggcaaggggcccaagaggttctggggtccaggagtgcttatgaacttttcaggccaagaatggagctcctcaagccagtggcttggttgcatgtccatctgtggtgaacctagagctgttgatc

SEQ ID NO: 6656 - DNA, 1193 bp, Homo sapiens
cctcgcgtgcgcctctgtgggggccccttgtcagggacccaggatcactccatccagctttttgctctcgaaggacctgggaggccgaagcccctctcagggctcagttctttctctccaggttacatttgtttctgctgcttgaggttatgcagtgcacccagaatctctaccattgaccccaatagcaagggacaccccgacatatggcgcctagactacccgtttccacgaacccacccacatcccaaggttcatgattttggctctttttggctactcctccacaactttaccttgccacctaggaatgcgtctttcttccccttactcttatttcaaggttttaggcctcggcactgaccctaactgcaaagacctggcctgaaactcactgcacatttcagcgatgcccccttctcagtagtacctctgacttaggaggttgccacctgtgggatccccgcctaggcatccctcatgcagaccctcttgctctctcaacttcaccaagtgatagtttgcaattcattgactcctcttccttctctcctttggattctttttctggtgtaacctctaactctcctctttttgcctcagctggtagcagttctgccactcccctgcctgttccctatggatatgtccatttgccctgggttgttgcttttcctggtaatgatagtgatgtgatgtgcgagggctacccccatttattctaagcagtaacagttgcatttctcccctgtgagcgtcattccatcctaggcatacaccttacatgtctcctgcctggtctaccctcagacatcccttgaacagagaattggcttctgctaatttgggaatgtctggtactgcatgctatagcacttatattggttgatgttacctgctgtgatggtattctctctaccggagcagtagctgaaatgctagcagacagtactttatccaggcaggcagacctaatcggagtagcctggggaaaggcagagttgtgaattctctgctacttgggggcctgaattcaacttactggtgttttctgtccgttttctcaatcaaaccaagttaagatttggtgaggtaaagcctcagtttggattgattggtgccccaccaaaactcatatgtcccatttctcttttcatttcctttcttttttcctgctagaaagttaaaattga

SEQ ID NO: 6657 - DNA, 1680 bp, Homo sapiens
tggtccttgtttccactggctttccatccccatggggcagaaacagtggctcctgggagcagaaaaggaattgaggtgggcaggcagaagagcctggattgctcactgttttgggaaacttacatgttgagatctacagagatccaggaaaccaaagccctgctgagcagagccattttgtggctatttctggaggcccaggagtgtggctgcaagagaaaaggggctggaggaagatccggagggcaggggtgttccctctgctgatgatggatgcccctaacacctgtgcctaacacccctactgaaccccacagctccagccttagtttttggagtcaagtgttaaaggtttctggccagaggaattggggtcttgccatccctgcaatagcccttttatgggctctgggagacagctttagggaataaatggggattttcccctttttctacccactcctttgcttcctccaagacttacccaactccttccccctcagagaaccaaatagcctgaggaagcaggagagttcctggttatggcagtttcttggtgatttggggcttcaagacagtaggtgagagatgctgtcaggacgtatcttcttcataccaaagtcactggtcctttctcagcctctctcgtgcttttctcctaatgaccatatttttgccaaaaattgggatatgttatctgacagaccagaatatttgaagtttgggctgtcctgaaagtctggactttggtggtaccctcctcccccagcccatctgttgcacattatactccgtgtgttcttcaactttcggcgcccttattcccctgccttcctggcttgattgaaggaaagcttgaaaaggcgcagagccctatacctcatttcctccatgataaaaggatccaagtgaggccctgtcacagcctgtgggtaggggatgcggcgggatcctcattgccatggtactcaaaggtagaagagcctggagtttgttgcttctctttgctattctttcatatcctcttgggcctggtgattaattagcaattctcattcctctcagccaaaggcctgcactgggctttatttgtctttttttattttttaagcactgcctgccagagatgggcctggggcctgatgaggaccttagcgctgctcgttctccttttctgttcatgcacacattcctccatggggtggggaaggcaggcatggggtgtggccctcggagaagttaggagtcccccagctcaagatacagtggcaaagacctagtggtcccctacccccacttctctcagttcctggcatgaggagagaagaccctgctctggtggagctgacaacctttgaggctgggaggagagcagcctctgggcatcgttcccagtgtccctcacactaaaacggcgtagatggcaaccccccacccccaccccgctgctcaactcttgtgtttgttgttctgtttgccccatttatctgttgctgtttttgtgttgtcttcccctgctccgcattttgtaaaatggcccctgggggagtgtttttgctggatctgctccctctcgctctctcactccactactttttggaacaaagtgatggcagaatgcggtggtggtgggggtcttttgtactgttggattaataaaatgattttaaaatcccagac

SEQ ID NO: 6658 - DNA, 1242 bp, Homo sapiens
ctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttctacctctgcctcttaacccttctgggaagcctattgtgtacgccgcgggccctcagcggcagacggggaggcgggaggtcgcggccgcccagggaagctgggggtctgcagagtttgggtgcggcagagtggggcgtttcgcgccaccgtccccatggggatgtcgtgtccgcagagggggctggctccgggtgggtcgaggcgggagccgggcctgcccggcgccccagcaccggcccccgggctacctgggcctcccgggtgcgccttcggctcgcgcgcgcccctccgcggcggctccaccgcccgggatggtacggtccggcagccgggccgcgcgctgccgcccctcggtgagctggtgtgggccgccgctagcggagacgaccctttccactcgcgtggtgccgtggtaagcctcgtccctcgcccgccgcctgttttcaggcgtagcgtctcgtccggtccttgctccccctccccgcagcgctcagtggtggtggccgcgac

SEQ ID NO: 6659 - DNA, 1199 bp, Homo sapiens
tgtataaacatagcaaaagaactgatattaacaattctgtacttggcagacagtccagacttctgggtctgcttctaaggccatatgcttaagtctttatttagttataaagatctgagtgggtgatagctggggaggtggtagtggaatacactataggttgtacatagaatggtgtgagcttgtctcttagatttccctcactctttcagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttcctgccgggtgttgtatgtgtggtgacttgcggatttatgtttcagtgtactggaaactttccattttattcaagaaatctgttcatgttaaaagccttgattaaagaggaagtttttataatctagtgctgtaattgtacgggttttttccccctcactcagggtgagcatcatcaatatcatggttctaattatatgcccttcagtttgataatgaagctcagctctttgctgataatgaggtttaacattgagataactggtttttaatctactttaagcagacttgctgtcaaacatctactgaaatatatttcactctaactactagcctgaggtagaggttatatagggacaacttcatctcatccaaacaaatgaactgcttcctacagtcggggtgctgcctttaacatagtcccaatatttgaatggcacacatggataaaaggatgctgtcagtcaggggctgcttgtgtgtcccaattcctaataggaataataggcatatctatgacctattcactgtgccccttggttggggaaggttttcagctgttcttaacttggcttgggcgttggaatca

SEQ ID NO: 6660 - DNA, 1137 bp, Homo sapiens
gcacagggtgggagggcttccagcggaccctgaaggaagtcgcctacatcctcctctgctgctggtgtatcaaggaactgctggattaatggtagcagggaactgcctcctctccccaccagcaccatggctggcatcgctcaggtgggcagggtagagtaaacaggaggcatagctgcagcttctgtggcagagcttgccttagcttctcattctcttctttagcccccagcccaattgccatcaagactcctgaagccagctgtgcttgaccaaggatgggccataaacaatgagtaaacagtaaagtgtggatcctgctttgagctgtgtcatctagcagacctgcctcatctctgagcctccttcattcccaacccctgcctctggtggacctctggtgggcaggagcttggactgctctggctaggaccccagtaagattgtggcaagacctggcactcctccaagcttggcacagtgagcccaccagctcagatggttgatcttaccataccctcatagtaccaagaatggactgccccctaagaaacctgtttgagaatcactgaattataaatataatccataggccttgaggcccaagattataagtgtctaaaggggaatcagaaaaagtcagcactagaacggtctgggagcaagggtgcagaccagggagggaaggagcttgtcctgaatagaaccaagattgaaagccaggttttctgactcactggttcctgagtggggagggtggaagacagttcaggttcctctcaatctgtgggtaaggaggggacccagcttgagtagggtcttcatctgtgaggccaagggtgtgtggaaacccagaggacccagccctttcccaaatagaagacctggtccaggcagcttcctgcctctgaggatcttggggaaagcactgcgctgaggctagtccccagctcatcaaggaagtaggaccccatgagctacaagagctcccagctcacatacaaagttaccagagaaagacacctgtgtggccacacaggtccctcaggcttatcatgacacagccctatcaggacataaacagctagattgagcagaattggctctttacttcctcttggtagccacagctggtat

SEQ ID NO: 6661 - DNA, 1101 bp, Homo sapiens
tgactgaggccagctgccagtaccacccccggtccttcagccaattctttatgaagcctgaaccgggacccaggcatcctatctcccagtccactgctccttccaaagagatggggaatggggcaggtgacatagatggacctccatgaaagggccagaaaggcagggctcctgctgccacagaggcagagtagaatagtatagtggttaggaacaaggaccgggcccactccctgagtttgaacactgttctgcacttaacttggaaaatcacttcacctgtctgaacctcagtttccttgtctgtgaaacagatgatgatcatacttcagagggttctggaagatgaaatgagtgtaaagtactcagaagggtgactggcatgcagtcatccctcaataagtattggctaaagttggtcctctttccccagacccctgtgggctgagcgctcttaatctcccctctacttgactctgcaggagaagatggggagccccgaggatgacctgattgggattccattcccggaccacagcagtgagctcctgagctgcctcaatgagcagcgccagctgggccacctatgtgacctcaccatccggacgcagggccttgaataccgcacccacagggctgtgctagctgcctgtagccactacttcaagaagcttttcactgagggcggtggcggagctgtcatgggggccgggggtagcgggacggccactgggggagcaggggccggtgtgtgtgagctggactttgtagggccagaggcactaggcgccctccttgaatttgcctatacagccacactgaccaccagcagcgccaacatgccagctgtgctccaggctgcccgcctgctggagatcccgtgtgtcatcgctgcttgcatggagattctgcagggcagtgggctagaagctcccagcccggacgaggatgactgtgagcgagcccgccagtatctggaggcctttgccacagccacggcctctggagttcccaatggtgaagacagtcctccacaggtgcccctcccaccacctccgccaccgccacctcggcctgttgcccgccgcagccgcaagcccc

SEQ ID NO: 6662 - DNA, 1715 bp, Homo sapiens
ggggtggcctgattggctcgcctgcccctgggggcagtagaggggccccgcccagctaggggagccgctccgttccactcccctccctagccctccctccccacggccctgggcagggaatgtcttgttcccgccgctccctccccggggccagagggcagggcgggccgggcggcgtcctaccctcttctcctcctccccatctcctccccgcccaggtgcgagccggagccgccgccaccgctgccgcccctgactcacgccgcccccgggctggcgcagcgaagggtgtgggacagggtaaggggttggaagagccttgtggagagcgggcgagccggcgccatctggcggccatgctctgagtgggcgagcgccccccgcggccactggagcgagctgtcttcacgctcctcatccaccccagctggtgagcggcgcccccttgccaaggcagtgggcacagaacttctcgcttggccgcaggggaaggggctgcggacctgtgggaaagtgatccccttcccagatccttgccagccgggcttcctgtcaggcaggggagaataatccccactctgctcttaggattgaatccacccccattctgtacatagcctcttctgttggtcttgttgaaatctagtttcagatttttaactacccaattctgctgggggtgggggacacccccccttcctcgctgggtgctggaccccttttgcagcctgggctctgccttgcactatttccccttcctggcctgacggctcctccccctccttaaaaggggcaggttcaggggcccggtgctcttcctcccttccatgcacccccatgcccatttgcacagctgcccaggtacccctaacagtggggaggggtcacagggagggggtagcgggaccagtccctgttatctatttaaaaagtgatgatgtaatatattggggtggcggggagatcgggttgtcctgggcctcatcttagcatttcaggtgatggggggagcccagggctggggagacctggggcccagccccagaaagtggggacaatgtggcctcccttctccctactttcggctttcccagtcagtgccttagggggagaggcactccccccctcctattcccttccccccaccccaactcccccacctcgggtgtaagcgacaggaagaaataataataatttaagattcacacttgtgtccacttttggtttatttggggggtgggtgggaaggatcaggaagagagggaggtgagagagggactgagggttctgaagctggagtgggggctcctttagtggcggaggatgtctcaggtggtctgtggggctcagggctggtgagaatgctgacaggctgatgggcttcaggtaagggctgctgcccgtgcttcctctgctgaggccccttctcctcatccaggtcactagtgaggagaggaagggggtggccggatcacccaccttctgtcttcacaggtgcatccctgccccctgccctgccccatctgttcagatccagctcctgttctttctgagcaactcctgctctctcaggcccacgaggcgtaccagcccatggctgtagatattttctgattttaggctgatgctggggggtgggcagtgacttgcctgaggccacatggctaggaagggcagaatcactagtgacctcagtagtcacacctgctcaaggc

SEQ ID NO: 6663 - DNA, 1109 bp, Homo sapiens
agtgtaggttgaaggctgaatggggagggcgagagatggggagtgggtctcaaatatagagggggtagcaaggtggaaggggcccttccaccttttgtgggcactcaagttcggacctctgggatcggcgattcccctctggccagggctggttttaatgctctccgtgggcgggcttcggttgagtttggtccgcttttcctttctgctcctcaggggagcattgcttccttctctcgcagtgaccatgacgaaattagcgcagtggctttggggactagcgatcctgggctccacctgggtggccctgaccacgggagccttgggcctggagctgcccttgtcctgccaggaagtcctgtggccactgcccgcctacttgctggtgtccgccggctgctatgccctgggcactgtgggctatcgtgtggccacttttcatgactgcgaggacgccgcacgcgagctgcagagccagatacaggaggcccgagccgacttagcccgcagggggctgcgcttctgacagcctaaccccattcctgtgcggacagcccttcctcccatttcccattaaagagccagtttattttctaacttcgtttagtttgagtatggaaaacgggtattggggattctatgtactaacggtcgagaagtgaatgtgaaagaaccaccttcttgaggccatctcagcctttatctttgcatcttgctggtgttcccatttttgctcccaaggaggcaaagaccccttctcaatatttctcaggatggaaatgacatttcactttcctggtcctttcaaccctgtaggaagtacttctttttttttttttttgagacggagccttgctctgtcgtccaggctggagtgcagtggcgtgatctcggctcactgcaagctccgcctcccgggttcacgccattctcctgcctcagcctcctgagtagctgggactacaggcgcctgccaccacgcctggctaattttttgtatttttagtagagtcggggtttcaccgtgttggccaggatggtctgatctcctgacctcgtaatccgcccgcctcggcctcccaaagtgctgggattacaggtgtgagtca

SEQ ID NO: 6664 - DNA, 1182 bp, Homo sapiens
ctcgacgcattatttcctccctgtcgcaagagggcgctgcgtccaggcactgagaggaagaaagaggagaacgcgaggagtagcaagtccgcggtaagcgctgacgcatgcgcatagctaaccgcacccggttcagctcgcctttcttggccagaggcgccggttggactcacgggcggggcatgatgggtaacaggaccggtggggtccccaggaagtcctagagggggtcggggtttgggtggacaagctttcctcgtcctctcccgacagagctgacgtgtcctgggttccaccgggagcgggcatttccaccggacgggagggttcggggtgtccggggctggggaatacgtaggggttgccgcgcggtgtggggagttggggcgtgtggctgcagtcccgggagttcttggagggggtcggcccaccgagcttccggaccggctgatctgcccgtagcttgccggagggagggcggagcctgactctccgtcccttctcccatcccctccagtggtgggtacgggcacctcgctggcgctctcctccctcctgtccctgctgctctttgctgggatgcagatgtacagccgtcagctggcctccaccgagtggctcaccatccagggcggcctgcttggttcgggtctcttcgtgttctcgctcactgtatcctccctgcagttggagggggcgggccacgtaggcatgtgcccttccccttccccacacagctctgtccccgttgcacaccctactccttaactccctcaaccaggccttcaataatctggagaatcttgtctttggcaaaggattccaagcaaagatcttccctgagagtaagtgaatattggagcttgagtatttgaactttctcctctttaacctcctgaaacatgatattgaatttccagatgcttaggtgaaaggttgttaaggagaaatatatttactgaagctgtctgaagacagatgacgcttttcgattctgcaccttgtatagctcctggagttggagctggaagagaaggcctttgaaagcaagaaactttggtaccttctggccagctcccagggaaggtttgaggggaacaggcaaatttgggctgatgttttgcatctattcgctgggaggcggtccttgttcccaccagaagaagcagcaggaccaagttc

SEQ ID NO: 6665 - DNA, 1135 bp, Homo sapiens
gcagtgatatcggctcactgcgacctccacctccagggttcaagcgattttcctgcctcagcctcccgagtagctgggattacaggcgcgtgctaccaagctcagctaatttttgtgtttttagtagagacagggtttcatcgtgttggccaggctggtctcgaactcctgacctcaggtgatctgcccgccttggcctcccaaagtactgggaatacaggcatgagccactgtgcccaggccatagtatattctaaattccttctatgatttagccttaattctctattgctattcagcaggaatttattcttacagtcatccctccattcctactgccagaccttcacctcacctggctgactgccaggggtctgattgtatggagagcaggctccagagactcccaggcagaagcgaagggaaggacaaggagtacctttaaatcctttatttggtacctgttcttctgattagcgatggggatgggcatcaggacaccaaggacaactgcccacagctgccaaatagctcccagctggactctgataacgatggacttggagatgagtgtgatggggatgatgacaatgatggcatcccagattatgtgcctcctggtcccgataactgccgcctggtacccaatcccaatcagaaggactcagatggtaagcctgcggacccagagcacgttagactggtgttgcctttgcccaggtggaggcagcaagccctgttgggaagtgaggaagggcaaggtggggaaagatgtcaggaatgcaggcccaacagatggtattgttgcctaatggcagtggccagggccttcctgagcacccagcctcactctgcccaggcaatggcgttggtgatgtgtgtgaggatgactttgacaatgatgctgtggtcgaccccctggatgtgtgtcctgaaagtgcagaggtaacgcttacggattttcgggcctatcagaccgtcgtcctggatcctgagggtgatgctcagattgacccaaactgggttgtgctcaaccaggtaactcggggcagtgggctgggcaggtgctatcagacagggctactgggacggggggcctgggagggatagcacacctgcatcacagctttttctt

SEQ ID NO: 6666 - DNA, 1174 bp, Homo sapiens
gtcctgtctggtacccccctcactggcctctgagtgcagtggaggtacagcaaggaacttttcctgccaaggcccccttgcctgggcccagccagtagcctgttgctgttggcgaaaagcctgggccttggagcctcctggccgtgaaggtccagcgcccaatgcagggaaggaaggaaggctccgccgcaaactaggagcagctcccagaatttccatggaaagctggaacaacgcccgctgacggcaactttctaacagtaacttccccgacccagacaccacaaagctagcacaacggagctcagatgcaggctaggactcggtccatgcctcaggaaccagagaaagccatcctcacactccctggatccagggaacccacgcccagggccccccagcttgttccctcagtgcccagctcttggctatttctttcacttcattccatcgctcagacaccattaccacatacacattccacccatacccccaggtctcagcctgccctaccttcccaggctccagtccctgttcctcagcatccccctccacatcctgagtaagctttgtccccagataacctcttcagcatgatccttaaatctccctaagcctcagtttctcccctgtggaatgggggtaagaatctctttctctgaatgcccctgtgttaggaaataatttagaatactttggaaactggaaaagctctgttcacacctaagcaatcagggcagtggcctcggctctgccaggaactttggcttttatctggatcctctctttccaggcctctcaattaattccccaggtcctcaacctttgggaagttagaaatgaggaagagtgtcctacttctgacactgttccctcttggaacctgaccgtcaatgctagaagaacccttggaaaacatgctggcccagccctctagttttacaaataagggagtgcacagccctgagaggttacatggcctgcccgagatcacatagtcaatggcagagtaaagagcatagcctaggcctccccactcctctagtaatgctctttcatcttctccaacctggctctaagccttgtccatcctgagccccatatctagcccaacctagtccctgaaaacaggaagtggcccttagaaatctctctccagtcccaccatcagagg

SEQ ID NO: 6667 - DNA, 1148 bp, Homo sapiens
tgagagagcagggtcagacactcccgagcctctcggtacagctgtaggggcgacacaggtaggcttgcagctgcgggaacagtgccacctccgcacctaagcactcccattcctggccagcatccttggggctcatctcatacaatagcccccggtctcagagctacctccttctccagctcttcctcgtcctcaggcctgtgctccccagtcagcagctgtagccgttccatgtactgccgctgcatgcggccaggcaggaagaagttgaggggaaagggcatagcctctgcataccacttccgggtcacttctacgtagttcttggtgtctatccaaaaagtatgtacctggattgggtgggcaggaagaaacaggcaggtctgagccagtgcacctgtctgattcaaggtgggcttctgacctccatgctctcctgagtctctgtgtgggtctgtgtgttcccgtcccctccccggctggccatggatgctgggaggtctgggcacactcaccagcaccgggatcaacttctcctccaggagagacatgaaggccagggtgtctgccccttgctgagctgacagatcataatcagcattgtacttctgtggaggaaatatccatggcgtggacgctggggagctgcaagggcacttcaccagggaggaaggagtcctgtctggtacccccctcactggcctctgagtgcagtggaggtacagcaaggaacttttcctgccaaggcccccttgcctgggcccagccagtagcctgttgctgttggcaaaaagcctgggccttggagcccgctggccgtcaaggtcctgggcccattgagaagaaggaagaaaggttgggccgcaaactaggagcagctcccagaatttccatggaaagctggaacaatgcctgctgacagcaactttctaacagtaactttcccgacccagacaccacaaagctagcacaacggagctcagatgcaggctaggactcggtccatgcctcaggaaccagggaaagccatcctcacactccctggatccagggaacccacgcccagggccccccagcttgttccctcagtgcccagctcttggctatttctttcacttcattccatcgcccagacaccattaccacat

SEQ ID NO: 6668 - DNA, 1202 bp, Homo sapiens
tgctacgtgcccggtcagccgagaaacggcgccctgtgcccaccttccaaaaagttcccctgccctcgggccctgcacctgcccactccctgggggacctaaagggcagctggccaggtcggggcctggtcactcgtttcctccagatatccaggaaagccccagaccccagtgggactggagctcatggacataagcaggtaggaattcggggagccaggaaagatgtttgggaaagcgtggagcttcagattgagccttattgatgatgccctttcttgtgtccctgtccaggtgccccggagcctgtggggccggcctggccgagagagcctccaccttcgcagctgcggagatctgagctctagctcttccctgcggcgtctcctgtctggccgcaggctggagcgtggtacccgcccccacagcctcagcctcaacgggggcagccgggagactgggctctgacctaggcttcttgtcacactgaacacatccagccacaggcaccagctggttgggaccagcagcccccagcatcctcttgcactggctggcacaaaaagaaacctgctgtataccccccaaagtgtccctttccctcctacctctggggtctcttgctgcttgcctctgctgctctggactgggagagcttctgtcctgtgctgcatgggtatttagactgtgggggagatgccccttcttatagcactggaggaggaaaacaaattcttgtccccctcagaatgagagtggctctttctgatttgcaagggcactatggtcagggcaaaggcatggcccaggtgtttaagtacagggtgacgtgtgcctatgcaatggggtggtaaggcaggcacgaagagtccaaaaaatctaggtggcctctcagctctgccacctctagctgcatgaccttgggcaagctatgtaaccccaattgcctgctccattaaagactgtgaaggtagaatgtttgtaaagctcttaacagtatgtaagccttcaataaatttcagttttccccttgttttcttgatcattctctgtcaccagtgaaatttgttctagtgtctctcatatttaagaaaactctttcaggactgggtatggtggctcacacctataatcctagcactttgggaggccgaagcaagaggatcgcctgagcctaggaattcaagaccagcctgggcaac

SEQ ID NO: 6669 - DNA, 1117 bp, Homo sapiens
ccctcttccaggtaagtgatgggatgtcttacttgactgcctggcattcttctacctggttcctttgttttctgctgaggacctgcctactcagttctccacattgcctgccttcctggcagctgatccttagcatgcccttttcagtcccatgctcagttctgtttttgtttcccagacccatgacaacagagagcatctagccatgatggaaaggatcttgggtcctatcccttcccggatgatccgaaagacaaggtgaaccttgagggggcactagttaactcttttccttttctctccacagaattggtctatttcacatcattttcttttttctttgatacctcctctccccccagttactttcagatggggaaataagggaattgtaacaagggtgaccttctgattcctcaacctccccttcccctctagaaagcagaaatatttttaccggggtcgcctggattgggatgagaacacatcagctgggcgctatgttcgtgagaactgcaaaccgctgcgggtgagctgggctcgggataaatagtgcccaccgtccagaagtcacttccttcttagggtggtttgccccctggaatgctcttcacaagcagagggttaggaaaggaggggaggaaagctgaaagaagacatctttggtcaacagaggaaacataagagggagtggttttgtggagggaaggaggttagacagcctaaccttgagacaaccagagatcaaagcaatgtcctggattctttaggtcagacagaaaagaataaactacctttgaagagcttacattttaatgaggaactaaagaagattcatgaagttgacaaggatatacaagtagaaagaactttcaaagattatggagtaattgtgctagtgggaaggtaggttgagctataatatcagaaacgttggtcctggtgtggtcgtggttaggtagccttcaaattggttgcaagcagagccttggttctccaagaatgaaaggtagggtcttgaagaaggcagggtttgtaaggcatcctgcctcacctttttcctgccctcctccaccagcggtatctgacctcagaggcagaggaacaccaccagctc

SEQ ID NO: 6670 - DNA, 1152 bp, Homo sapiens
ccttttctcagtggtgttgtttatctgggtggtttgagttgctgttgagaattgacctctgttgtccactcccagctctcacggcccctgggttaaaggtggtgggaatcacgcaggggttttcttcccctgtgaccatctgtatctgttccccttccttcatctccaccccaggttgctgtccccttttttcttccaactcagctcattccccaccttctctccctccctctccccgaccctgctctctttcatttcagatgaaatcgttagcaccttaggagaggggaccttcggccgagttgtacaatgtgttgaccatcgcaggtaactgtcagtccctccctactatgtggggctaaagagatggttggggttatatggggcttttttgctaattaacctgaggtagaatttcttagtccccctacagccctgttcattttgagacattcttgagaacccagcaaaagcctctcctgccaacttacaggggtggggctcgagttgccctgaagatcattaagaatgtggagaagtacaaggaagcagctcgacttgagatcaacgtgctagagaaaatcaatgagaaagaccctgacaacaagaagtaagcaagcaaggaagtatgtagggaggctgagagccccaacccctacacgggagagacttctagacctggtttaggcagacaggggagtcctagaccttctcatccattcatcttttgttcatcatcttagagtagtagaacatcagggtaggaaagggggggggcccatgacattccttaatccactccccttgttttcagggaagttagattgctctgtcgtttgaccccagcctagaatggcttctgtagagatataccctggacatagccctaggactgagcatcaacctcatcgaacaatgaattaagcttttataagtagaactatgctgataaggccacagacatttatgcagtaatattttgttcacatacattcacagtccaaaaatagaataaggactttaagccaagatatgaggccagtaggtataaataggagcccagtggtagctagtggtgaatgaatatcaggagttgggctggggttgggatttaggatggacagtttgatgattcaggatctatactgtttg

SEQ ID NO: 6671 - DNA, 1099 bp, Homo sapiens
tcttcccggcgtcagtaccaggagaaggtcagcagggacaggagagggaggtgtggcatggaggggtgttggagactgggtagcctgacttgaggcccattctgatgtgtgcccctgttgcgtctctgtttcctttcctgccctgtgtccatttgttccctgcccctgcatgtaccttttccttgtttgaacctatgcctgtgcttggcccctctgctgtccacgcctgggttttcctatgactgtgctctgtgtcttcccggtatccatcattatccgtattcctctgtggccctgtgtatccatgtctggttccacgtttcacccctttgagtttgacctgtgtctctgaccttccgcacacacaccccactgtgccggccccaaatctctccctctgtcctcttgcccctggcaatgggctggccctccagtacaagcaggtggagcagtacatgtccttccacaagctgccagcagacacgcggcagcgcatccacgagtactatgagcaccgctaccagggcaagatgttcgatgaggaaagcatcctgggcgagctgagcgagccgcttcgcgaggtggggctgggttgggcctggaaggggggctcttcagggacctggagtgctgtctggtggtaggggctattggtcagcaggtgctcctatagggaatgaggcctgcagagggccccgtgggaggccaggtatttgggctttcaggggctagggtctttcttgaaggccctttgagggtgaaggatacatgaggagggactatagggatctctgtttttgggggatggtcctgcaagggctcatgggaaagatctgaaggcaggagcttagggatggtcccaggcccactgatgcctccccatcctttggcagaacatgaccccaggggtggggtttctggaagcggatgagctcggtgggatcatctcaggtcaggggcacagcctgcctgacaggcccctcccctgtccaggagatcattaacttcacctgtcggggcctggtggcccacatgccgctgtttgcccatgccgaccccagcttcgtcactgcagttctcaccaagctgcgctttgagg

SEQ ID NO: 6672 - DNA, 1177 bp, Homo sapiens
catgccacacaaggtgagagctgttggtccttaggagtccttgtcagatttttgtttcatgtccttttccccctaatttctcgggcattctaatgatgttgttccctccccaccccttaaaaaggataaaaagaagggctttgaatatcttgatccagctgatggcctgataacataaaaattcttaagtttcttgggctaggcatggtggctgacgcctgtaatcccagcactttgggaggctgaggtgggcagatcacctgaggccaggaattcgagaccagcctgaccaacatggtgaaccccatctctactaaaaacataaaattagccaggcatggtggcacatgcctgcaatcccagctacttgggaggatgaggcagaagaattgtttgaacctgggaggtggaggttgcagtgagccgagatcacaccattgcactccagtctgggcaacaagagcaaaactctgtctcaaaaagaaaaagaattcttagtttgttattcatgctgccacagactaatggtggttttggctttgttatggcagccagctcaccccagggacacctccaccctctgcccttcatgcatgtaccactggggaagaaatcttggctcagtatttacaacagcagcagcctggagtcatgaggtcagtgtaacggttgctcctgcccttcttgccaaccgcaaccctcccttgacttcttacgcacttaatggctgttctctgcccccacagttcttcccatctgctgctgactccctgcagggtggctcctccttacccccacctcttctcaagctgcagtccaccgggtatggttctggatggttcccccaagggagcaggtatgtaggaggtgaagaaaactgagatttcaagtatgggagaggttttactatctccattcctggattaaaagtgctgaaaaagtccacagttaaacattcctttattcaccctatggctcccaagaaaagcattcttcctctggagtactggtgtactaaggggacaatacaccaaatttgttgagtttacaatcaagtctactaaggttggacttccttatcagtttggcgagtcccagggcagaataatcatccatctacaggtctctgtttcctctccctccacagcagtggagagcatcccagtgtttggggcac

SEQ ID NO: 6673 - DNA, 1692 bp, Homo sapiens
agttgtgtgactttgggcaaaacatttagcctcttgagtttccttatctataatgacatagctctcccaaccttgctgtgaggaataaacaagagatttttcaaatcagtatattgtgcttcataaatgttaacattgttacaaagcatcagtgaggctgggcgcagtggttcattcctgtaatcccaacactttgggaggccgaggtgggtggatcacctgaggtcaggaatttgagaccagcctggccaacatggtgaaaccccatctctactaaaaatataaaaactagtcaggtgtggtggtgggcacctgtaatcccagctactctgaaggctgaggcaggagaattgcttgaacccaggagacggaggttgcagtaagctgacacagtgccactgcactccagtctcagcaacagagagagactccgtctcaaaaacaaaaaaaaaagaccagtgaatacagccctcctcctttcttaggtttcccaccgttttcgagaactcatgcagctcttccacactgcctgtgaagccagctctgaggatgaggatgatgcaaccagtaccagcaatgcagaccagctgtctgaccatggggaccttctgtctgaagaggagctggatgaatgagactctgggaatcatctacacaggaccaaacccaacaggcgccctggcaccggggagggggtagttgtactctgcttgtacagtccttgagcccagtttacagatctggagagcaggaggccaggacaaggacaaaggctggaggatggagtaggacccaggggctctgccatcctaggcatcattcaaggtcttttatgaagactttacagatgtcctctgtaaatagcatcgagagtggagttcagctcctttctctacttttttttggtctgatggcacatatttattgttctgtggtctaatcacagtgtttctaaatgtaaaaagtgcatatgttggtgtagctagtcccgcgacattgagctcctctgcatgaagacactgggctcctgcatccagctgtttttattgcaaactagctcctttctcccacactgggaactttagtccacgaggctgtcaccaccctggtagcactgggccaggctttgtagctcctgcagcagctctgctacgtcatcgtgctccactccagcatccatgaagctggcccagcgccgcaagtcgagtttggtgaggtctctggccaaggcttccagggtctggtgcagggacgaagaggaacacagtgccccaaacactgggatgctctccactgctgtggagggagaggaaacagagacctgtagatggatgattattctgccctgggactcgccaaactgataaggaagtccaaccttagtagacttgattgtaaactcaacaaatttggtgtattgtccccttagtacaccagtactccagaggaagaatgcttttcttgggagccatagggtgaataaaggaatgtttaactgtggactttttcagcacttttaatccaggaatggagatagtaaaacctctcccatacttgaaatctcagttttcttcacctcctacatacctgctcccttgggggaaccatccagaaccatacccggtggactgcagcttgagaagaggtgggggtaaggaggagccaccctgcagggagtcagcagcagatggg

SEQ ID NO: 6674 - DNA, 1165 bp, Homo sapiens
tccatacctttttgcctctggaggctcatgggcttcctggaggagatgaaaaaggcaaggacttttcaggctcacccaaagcataaagcactgggatagggagggattgctacctgaaaccggagcctgtctgatcttcacaggctcaggaatgccatggatgtgctggaagggatgttcagcgaaggaggttctgggacctgggaggggccttacctccttgctctgcttggaatagtgccctagctggagatcagtagggtggagtggagagtggaatcattaggaatcaaatccagtattagtacccttcccctataggcagctaaggaggaagagaaagttttagtattctttgttaccaggcagagtctctgtgtgtttcccagttgactgggaaagcagaacatggaagtatgtgggattgattgggaagggcagcctagagaggctctggagacttcctctttccctctgtgactctcctcagctcaagacacagatgtggcagctcctcaagggccacgaccacctgcaggatgagttttctatcttctttgaccacttgcgcccagcagctagccggatgggtgactttgaagagatcaattggactgaggaaaaggagtatgaggtataggacctaaggctgctgtagccttatgaagggggaaggccacacgtgggagggatattggcctggtgtctgtgctcagcagcaccaactccttctcagtttgatggctttgaagaagtggccctgcctgatgtggaagaagaggaggagcctcccaagatacccacagcctcaaagaacaagaggaaaaaagagatcggggtccaaaatcatgataaggtattttctttgtttatttgtttgtttttgagacagaatctcgctctgtcacccaaactagagtgcagtggcgtaatcttggctcactgcaacctccacctcccagattcaagcgattctcccacctcagcctctcaagtagctggaattacagacaggcgccagccaccacgcccagcaaatttttgtatttttagtagagatggattttcactatgttggccaggctggtctcgaactccttacctcaagtgatccacccgcctcggcctcccaaagtgctgggattacaagtgtgagccactacgc

SEQ ID NO: 6675 - DNA, 1955 bp, Homo sapiens
taggaaatatgactggaaccactgagatcaactcagatcgaagcctagaaaaagacaatttggagttggggagtgaatctcggtacccactgctattgcctaagggtgtagtcctgaaactgaagccagttgccacccgtttccccaggaaggcttggagacagaagcgttcatcagtcctgaagcccctccttatccaacccagcccctctctccagcccagcttcaaccctgggaaaacaccagcccgatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctgtgccccctgaggccaggacaagcttccctctgtctgagtcccagactttgctctcttctgcccctgtgcccaaggtaatgctgccctcccttgccccttctaagtttcgaaagccatatgtgagacggagaccctcaaagagaagaggagtcaaggcctctccctgtatgaaacctgcccctgttatccaccaccctgcatctgttatcttcactgttcctgctaccactgtgaagattgtgagccttggcggtggctgtaacatgatccagcctgtcaatgcggctgtggcccagagtccccagactattcccatcactaccctcttggttaaccctacttccttcccctgtccattgaaccagtcccttgtggcctcctctgtctcacccttaattgtttctggcaattctgtgaatcttcctataccatccacccctgaagataaggcccacgtgaatgtggacattgcttgtgctgtggctgatggggaaaatgcctttcagggcctagaacccaaattagagccccaggaactatctcctctctctgctactgttttcccgaaagtggaacatagcccagggcctccactagcagatgcagagtgccaagaaggattgtcagagaatagtgcctgtcgctggaccgttgtgaaaacagaggaggggaggcaagctctggagccgctccctcagggcatccaggagtctctaaacaaccctacccctggggatttagaggaaattgtcaagatggaacctgaagaagctagagaggaaatcagtggatcccctgagcgtgatatttgtgatgacatcaaagtggaacatgctgtggaattggacactggtgccccaagcgaggagttgagcagtgctggagaagtaacgaaacagacagtcttacagaaggaagaggagaggagtcagccaactaaaaccccttcatcttctcaagagccccctgatgaaggaacctcagggacagatgtgaacaaaggatcatcaaagaatgctttgtcctcaatggatcctgaagtgaggcttagtagccccccagggaagccagaagattcatccagtgttgatggtcagtcagtggggactccagttgggccagaaactggaggagagaagaatgggccagaagaagaggaagaagaggactttgatgacctcacccaagatgaggaagatgaaatgtcatcagcttctgaggaatctgtgctttctgtcccagaactccaggtgagagctggagaatattctcaagtatttcgtggactcagtaatatgtatcacttattgatatgccacctgcttgcttgctgcactatggatagtcctaaaatcatttgtatttgatttgtgaatgcattatgggacatgattgtggagttgaggtgaaatgagatggaaaggatgaaattttacttattatattaaactcgtttacacattaaattgaatcacctgaccatactttaaatgccttaaaaaatagtaataggctgggcttggtggctcactcctgtagtcccagcactttgg

SEQ ID NO: 6676 - DNA, 1153 bp, Homo sapiens
agaggctgaggcaggaggatcgcttgaggccaggagtttaagattagcccaggcaacatagtgagaactggtctctacaaataatggaagaaaaaaattagcccggcatggtggtgaacgtctgtggtcacagatacttgggaggatgaagtacgggaatcgcttgagcccaggcattcaaggctgcagtgcgctgtaatcatgccacccgctctccaacccgggcaacagagcaagaccctgtctgaaaaaaaatgaaaaggtagattgggccacacaccatggctcatgcctgtaatcccagcactttgggaggctgagactggagaattgcttcagcctaggaagtagaggttgcagtgagctgcgatggtgccactgcactccagcctgggtgacagcgtgagaccttgtctcaagaaaaaaatgaaagagtagattgtaaaatgtgttagtctggggagaccctttagaaggaaggactgtgaagtgagatttagtgttattctcctttctcagtttgttagctttaggactgaagcattttgaaggaactgagtttcctaatcctctaatcagcaagtaccttctaacctgcaaaactgcccaccaactgacagtgagaatcaagaacctcaacatgaacagagctcctgacaacatcattaaagtgagtgtttcctgcatgcgccatccgggcacctcaccaatatgtacccattcttttatcttgttattctcaaagaaaagaggaaccttcttttatctaaagctaatttctcccactttacactagattaattcccctattgccttttgggcaatattccgctggcagtattccacttatttgctttttgttgttgttgttgttagacagactcttgctctgtcactcaggcttgagtagagtggcgcaatcttggctcactgcagtctttacctcccaggttcaagcgattctcctgcctcggtgtctcctgcctcagcgtcccaagtagcttggattacaggcatgcaccaccacacctggctaatttttgtattttcagtagagatgaggtttcaccatgttggccaggctggtcttgaacctctgacctcaagtgatccacccgccttggcctcccaaggtgctgggattacaggcatg

SEQ ID NO: 6677 - DNA, 1092 bp, Homo sapiens
gaatctgggagaacttaagtaagaatcaaataaaagtaaaatttggaataccagatttgtgagggagattaaagaagttggaatcttattctggaagaaagaaagcattgttgaaggtctcttatccttcaagtatttaaggggggaaggaggtaaaacatttttgagcatacgctattgttagcaccttattttactaggtgctttttaagtgtttgttttacttagtgaataaagtgttccacataagaaagaatgagtcaacttttattgccattgaatgggactccctttagatataatgttagcttaagaaagactggaaacttttggggggatggtgggcagatgggagggaatcaagttaggtaaggatagctcctacctaaatgcaaaaatgcattcacaggcttttatgaagccctcttttgtcctagaagttgatttatccgagatttattttcttatagcgaatgaatttccctgtttgccaaagcaagtggcttggattctggccacaagcaaggttttcatgtatccagagttacttccagtgtgttccctgaaggcaaagaatccccaggataagatcgtcttcaccaaggctgaggacaagtaagtgtttactctgggggatcaaaacagcagaacatcccaaggagaagatgtagttcctttgaggagtttaggggaagtaagacttgtataataagacacggacacaaaagacaaaaggaaaagcaatatagatgagcagagccctctaggacgtgcttgttctagcagtgccaaatactgctttttgggagatgtcacacacatttttaaagcattttagaccggacatggtggctcacacctgtaatcccagcactttgaaaggccaaggcaggaggttcgcttttattttattttatgttatttatttatttatttagaggcagaatcttactgtgtcacccaggcagtcacagctcactgcagccttgaactcctgacatcaagcgatccttgcacctcagcctccacggagcagctgagaccacaggcgtgtgccaccatacatggctaaatttttttttttttttttgt

SEQ ID NO: 6678 - DNA, 1198 bp, Homo sapiens
gagattacaggcatgagccaccgctcccggcctcaataaatgtttttgaataaatgaatgaaggatagccagtcatggtggctcacacctgtaatcccaccattttgggaggccgagttgggctgatcacttgagctcaggagttcgagaccagcctggtgaaccctcatctctacaaaatatacaaaaattagccaggcatggtggcatgcgtctgtggtcccagctacttggggagctgaggtgggaggagcgattggaccagggaggggatgcggaggttgcagtgagctgagatcgtgccactgcgctccagcctgagtgacatagtgagacccatctcaaaaaaagaaggatagatatgaagaatttgtcatgccttgttgaaaacattatacattgtcttcatggaattcctccttattgtaaaatctaatttataccaacaatatactgtctggctttcttgcagaaaaggaagtaaatgagctgatggaagagctgtttgaaactgtgagtaatgatcctcgagtgagaacacgggattttaagtcagttctccagcaagatgtgtcatttggtctctgtgatgctccctctaggagagggggtctgactgaaccaattctccttttagtctacctgggaaagaatataatgacaagggaattttgctaactactagactcttgattatatacatgtatgttgttcttattaacattttccttgaaacttctttttgtttgagggggttcttgctccatcacccaagccagagtgcagtggtgaaattacagctcacagcagccttgaccttctaggctcaagcagtccttcgtctaagcctcctgagtagctgggacataccaacacacccagctaattattttatttgtagagacagggtcttaccacattgctcaggttgttctggaacttctgggctcaagcaattttcctgccttgggcctcccagtgctggaattataggtgtgagccagcatgcctggcccctggaaaacttttgatgacttcccctactgtcatttggtgtgtccttaaagattgtcaactagttttaaactactttgtgtacaaataattacctttttcataaatttgtttcaaaagatttttcattttaagagattgatcattttgaggctgggtgcagtggctcacgcttgtaatccca

SEQ ID NO: 6679 - DNA, 1116 bp, Homo sapiens
tccgcccgcctccgtctcccaaggtgccgggattacaggcgtgagccaccgcgcctggcccccaaattagctgttaatctaaaccactgaatcttaacctcagttttgagtaggataactccatgggcagagaaagctaagtagtgcctttaaatttttttgccaataactgacgcactaacgttgtggcttcactctgccctaaaatgggatggcgcatagtgttaggcgcatgctccttgatgcactgcggcgcggcgctccgaggctcggggacgcgcacgcaattcgctgttgttggctgacttccggtggtgccaaagccgtttccgtggaatcaggccggctggtgagggtacaggtttgtgtgtggtggggtgggaagaggcaggtgggagctgggacacctggacgaacgatgtccaggttgagaaggtcgggtctgagggtgggcgctgggtgcgtggcggaagttaagggcgtgaagtccagtgtctagttgggaatggggactggagccagccctgggcaccgaggtggaagcgcggttaggaccccttttgaaaatgttttcctaggagagggccgtgccggggctgcctccacattggcattcattcaccctgctggtccgacttgggttcccaaaaaagtggattctgtcgagctactgctgtgtttgaggtgcctggagctgaagtagctgtctttctttccttctttttctttctttctttttctttttttcccctttttttgatctcagtaattatctgtgaaataaaagagctgccctggctactcccattctatttcttataaggtcaccaccatctctcacaggaatcaacgaaatcttcatgttttattgagctttagttactgagttttaattacatcagttgattgaggggatggagaatctcccctaatgtcttggagaaacagaagggaggtttaaaactaactgtaggtcgggcgcggtggctcacgcctctaatcctagcactttgggaggctggggcgggaggatcgcttgaggccaggagtttgagaccagcctgggtaacaaatcgagaccccgtctctacaaaaaaaaaaaaagaaaaaaagtcg

SEQ ID NO: 6680 - DNA, 1620 bp, Homo sapiens
tgtaaatactgtatcataagtagaagaaaataatttttgttttctaaaaatgcattttgagatagtttaatgtaaatctgacaggagcattctgaagccccattaggaaaaaatttaaatggttcctcttcatcgccttaatgtctaaagatcagaaatcgctgagcaaacccgcttttgtttccttcccagaaacaatgcaaaacaacaggtggagatagtctggtctttgccctgctgtgtgtgcctctgtagctcctcctgacaaacgtctgggaaaacagcctcaccccactctcctctctcttccccatttccttgtagctttattccttgcatctttgggtctactgagcagtgggtgctgaggtgacaggggaggaaccagttgttctgtagcctaggaactgcctcagtgtctttgccagaaaaaggcaaagaggcggacagtgcagggctcctccctcctacctcaggcctgatccatcgtgcccttgactttgccgtctcaaagtttcttagctgactttggctttcacatttgttctttccagagctaactgataagagtggaggaggaatgccttctcctaagagtcagttgaaagaaagacaagagagtcacatcttagcttttgcacaaggcattcgtggtcaggaataggttagggaatggtcacttctgattttccaacagttgctccttctctgaagagatcttgattcctttgggaagacaagaatttttcttaataacaaaggtccctttatgagttattccttctttcagttcatctcactggagcacagccaagatggacatgtttatggacagtgctctagatgtgaaaacagatagaactggtttgtgggacaggggcagcttgctcaggagagggaataacgcaggtcccttttcttggaaggcttgtactatggccatgacagtgacattgccctcaccatgatccctctccaaagtggttgtctttctttaccttgtgtcttctcttgtaaaaatgaaactcaaaaataaaataaatgtgtcaaattttgaaaaaaaaagaaaactgaaaaagctaacatgaattgtgtgaaattgcataatgctgtaatgctaatctacaatatgtaatgctatcttgtatgttgaatttgttaatgcaccacacaagtgcaaaataaagactgattcacattacataggcacagtgatgtcagcctgattctctggaaagctggaggactctcagtgaggttaacactcagactccaaaaggatgttctagggtgtgttttccaaactgtggtccccagaccacttgattcagaatcatctgaggcacttgtttaaaaatgcagattccaggctcccatcctagatactctcatttgacaagtgagttggtttgctgcttgctgtagttaggacttctggtctttctgttttcctcttgaaatgtaatttctgagaccatcactaccagagggagagatgatggttcgtagtgctgagaatcaatctgcccctttaattggaaatatttatcccaaaaagcaatcctgagacaggccaattctgttccctcattcattcatttacttttttttttttttttt

SEQ ID NO: 6681 - DNA, 1132 bp, Homo sapiens
cggggatggggttggggttgttttttctctattctagattatccagccaagaagatgaaaactacagagaagggatttggcttggtggcttatgctgcagattcatctgatgaagaggaggaacatggaggtcataaaaatgcaagtagttttccacagggctggagtttgggataccaatatccttcatcacaaccacgagctaaacaacagatgccattctggatggctccctaggaaacagtggaacagagttttgaccctcagtgactcttcttagcaataatgcatgcatttgatttaacaagactctggggcctgtgctgggaaccatctggacctttgcagaagttagagattcagtgcccccctttcttaaaggggttccttaacaaccacaaaaatccttatttctgcagtggcatagaatctgttaaaatttaattagaatcacaaatttatctcagaagctttttaacagttggtgaaatgtgcttgtccaacaaagcatcctaacagggtcgttcccatacacatttgacctggtcagccttttccaggtgaatagccccagttctgacataaagaaagttttatttgtattttactactgtttggtcaattttgatatataactggttacaaacagagccttactatttattagtggggaaatgattttaagaccgtccttttcagtatttaattctgacagatctgcatccctgttttgttttggattatttctgttttggaaaatgctgtctcatttaaaactgttggatatagctggatcctggataggaaaatgaaattattttttcattgtgttttttaattggggtgatccaaagctggcaccttcaggcacattggtctcatagccattactgtttttattgcccttctaagatcctgtcttcagctgggtcagagaaaacttcttgactaaaactggtcagaactcatcacagaaatgaaatacagtggtctctctctcccagaactggttgcagctaaaacagagagatctgactgctggctataggattttggacttaatgactgaaattgcaaattgtcctttttcttggcattacagattttgccaaaataactttttgtatcaaat

SEQ ID NO: 6682 - DNA, 1215 bp, Homo sapiens
ccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactccataaggtactgtcttccataatgtctgccaattctgaggaggatggtagtagagagccgggcagtgacctaagttcctctgaaaggggccttttcctctcaccgcaaggacagcctctgcctcactgaagagagggggcactaacaaaagtaaccactgcaaatcttttttttgtttttttaattcacaaatacaaggataaaaacaaaggggcacacaggttccaatgttgggaattccggtatcaggaaaagtgtgttcatcgtatttgtatgccatgctcagcaatcacctccacctattgcccccatccccagtgtcattcattgtcagatccatcccccactaggcccttgttgatctcc

SEQ ID NO: 6683 - DNA, 1511 bp, Homo sapiens
ggctcatgcctgtaatcccagcactttgggaggccgaggtgggcagatcataaggtcaggagttcaagaccagcctgaccaacatggtgaaacccagtctctactaaagatacaaaaattagccaggtgtggtggcatgcgcctgtaatcccagctactggggaggctgaggcaggaaaatcatttgaaccctggaggcggaggttgcagtgagctgagaatgtgccactgcataccagcctaggtgacagggcgagactccgtctcaaaaaaaaaaactaagactttgtatcaaaaataaataaatttgggctagactgctccctttctcattggactcatattttccctggcttctcctgtgccctaatccagacttctaagcaaggtctttgttttcctttacagctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattgacttgtctgttttcttagcccccgggtgaacacaggtgattattggaactcagtctttgcccagacccctgggcaagcgagctgggttctggccttgctgcaggggttgtgggcgggtcctgttcccatggagatatctgcccttttgaatcttttgcttccatcccttattttcctctgattgttgttctcatcagtcaccacctattgccgtacaccttccttgccaggcagctcctcttcacagctggagaatgtaggatggggaaagatggtctgcagaggaacagctattgtcatccccttagatctcatctgatttattgactcagtatttgttttttttgtgggttttttttttttttttgagatggaatctcgctctgtcacctagtggtgaacaccggtgcctggcacctgagtgttcttgaaaagctatctctcatgcctgacttctagccctttctcgttaagaactagctttttggccaggtgcggtgg

SEQ ID NO: 6684 - DNA, 1180 bp, Homo sapiens
ccatgcctggctaatttttgtatttttagagacaggattttttgtattttagagacggagtttcaccatgttggccaggctggtcttgaactcctgacctcaagagatcagccagcctcagcctcccaaagtgctaggattataggtgtgaaccactgcgcccggactattgctttaatttttttgtttgtttgagacagagtctcgctctgtcccaggctggagtatagtggtgcgatcttggctcactgcaacctccgcctcccagggttcaagcagttctcctgcctcagcctcccgagtagctgggattacaggcgctcaccaccgcgcccagctaatttttgtatttttagtagagacagggtttcaccatgttggccaggctggtctcgaactcctgacctcaggtgatctgcccacctcggcctcccaaaagtgctgggattacaggcgtgagccacggcgcccggcctgctttaattttatatccattacttactaaccctttttgtttcatccattttctagtgctgcattagacgtggaactatctgatgattccttccctccagaagactttggcattgtgtctggaatgctcaatgtcaaatgggaccggattgccccgtatcctcttggcacttggtgatgaagggtcggggggcagggagagccttgcctgcaaagcagcaggggtacttcaaataggctggatatgtgtggctgtcctcctgtcatctctctggataagatggagcaagagaggttggtgtaaattgtgtgagcatgatttagagtagacatgaagaaggaggatactgaagttcagattataagaccctgaaacaagctgggcacggtggctcatgcctgtaatcccagcatttttgggaggccgaggtgggtggatcataaggtcaagagattgagaccatcctggccaacatggtgaaaccctgtctctattaaaaatacaaaaattagctgggcatgatggcgcgcacctatagtctagctacttgggaggctgaggcaggagaatcacttgaacccaggaggcggaggttgcagtgagccgagatcctgccactgcactgtagcctaggcaacagagtgagactctgtgtcaaaaaaaaaaaaaaaaaaaaaaaaaaaaacctgaaacatactatactgg

SEQ ID NO: 6685 - DNA, 1235 bp, Homo sapiens
ccaagaaagggatgtgacaggcgaggacgaatgggatctcaggggctggactggagagtggggtacagggatgtgaggaggaccccgcgagtccgcggtgggatcccaatagagctgtggccaaggaggaggggagcagcgggaaggctgtgggcactcctgtgtgagggaaagctacaggctcctgcaggtccgagatcggccgaaatcaggcaccccaaggaagccctgctctggccacatggtgtcccctcagaagactccaccagccggtgggcatcccggggcttctgacaggaagagggcagtagatatattggtgcttgtaccggtttttcgagggctgcagggtgaagatggtaggagagtctggagaacgggtctgctctggtggcttatggactactctgtggaaggggctgctgttctggtagcatcgaaggagctttctacgggagcgctgtcaagaggattttggtgaatttgacgtacttggtttgataactcactttgcttttttctctaaagatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaaggtaactcgaggccctagagttacagattaagcctatttctggattcttagttttcagatgggaatagggagcatattggtgggtagtggtttctctttgggacacttccagcatcagatatattgagtgaatgaatacacttcgggatctacttttggaaaggaggacattcttacctaagctacaagaaaccatctttcacgtttcgggttggaagaattttagagtagggaagtggcaagaattgtggaaaaactaggagggaaagataaagacacagaaaatacacaatcccttgttacctcaggggtttaaagtgtcatcttccagcctggcatggtagctcacgcctgtaatctcagcactttgggaggctgaggcgggcggattgctggaggtcaggagatcgagaccagcctggccaacatggcaaaaccctgtcactactaaaaatacaaaaattagccaggcgtggtggcggacgcctgtagtcccagctactcgggaggctgaggcaaaagaatcgcttgaacccgggaggcggaagttgca

SEQ ID NO: 6686 - DNA, 2472 bp, Homo sapiens
ttacacagttatttaggacttgggacctaggctcctgggcccccatttgcagctcatcttccctgccctcctgattgactctgaggatattagagaagacctgctggtcttagaaacccttaattcaaatagggcccccaagattggtcctgtgcccacttcacaaggcctgtcccctccaggtgcagacgccagaagtgagatttcagcagcagctggagcagctcaactccatgggcttcatcaatcgtgaggctaacctgcaggccctgattgccacaggaggggacatcaacgcagctatcgagagactgctgggctcccagctctcctaatccctcggcccatgcctcctgcctctcccctccctcgatgtcagcattcggttcttctgtcaatccttaccctctgcagcttgtcctcccttccgtcttctccctcatcctttccaaacagcagggtgactttagaggcatgggctccaaccccttagctctgtctgagaattatggttttactgctacgtctctaacagactcttctctcctggtctccttgagcagtgctacttaaacagttttcacagtttcattgattgactctacctccttgccccacaccacttttgcaatctttaaactttcagtggctgtgcagagtcgagggaggaaccagctctctggtttactggaacatagtcttccatctataccactagggttttgtcttatgtttacttttggtaactctcttccttctttttctccctaccccccaacccctagcccaaccaatgctagaatttcttgctctgaaggaggagcaggtgaaacaggtggtaattttccttctcggcccctattctggttcattcagcactttttggtgggaactgttggaaattccagggtaaggaggaagatgcctgttctccctgtctgaagagggagatgagacagctctctggacaggaattaacaaacgctggagcagcccagaggaaattcgtgtgaaagaggagggaatgagattattcggaggaagggaatgggggagacagcctgagtaaaaggcttggaagttggaattaacagtggggagcagaagcactcatagctcttttaggcagaagaatccaggcccgagctggcagaagagacttagagatgctaatggaatttaaactgaaaaaaggagcccaatgaagctaagcgccacgccccacaaggggtcatattggctttagttcctcaagcatatgtgcttatatgcacacacacacacatttccatggacccaggtcttgcttgtgtccccaggcaccagtagtttgagcccccctcaaaagacatgaagggggttggggtctgtgtgagtagtggggaggtgcatgtgtatccacatgtgtgcatacactcttaagttgggtgggaagtggattccttgttggtttctggttcagagtgctctcccaccaccagagacaagtgggtaaaaaggtcagtccattgcaggaatatatatccgggagagctaggtcccttggggctctggatgctgggtaacccagaggtaatgtgggtaccctttctgaagctgtcagggctgtgactagcacccttatcacccctcactgccttgtgggaatagtagagggtttttttcctccagagcccctggcctttcagttcttaactatttccctccaggccagaaagttttctttgaggaaggagaggagagggtggcaatgatgcctttgatctggaattggacatttctctgtcagagcacagaggaggctcatatcacctcttccctctcctacttggcccagctgcttggaggaccgaccccatggctgagaatatgacggcaagaggaacagagtttgctccaagtgggaaagggtcccaagcagtccagagaagatgtctgtgtggctttccctccctgcctcccccagctcccacactggcctttgtaaataaatggcgtggtctttgttgtgagagtgtgttggcgtttgtttttttgaggaagaagctggctgaaaacaacttcttggttttccagggcaagagttgtgatctagaggaatttgaagtttggttcagttactacagatgttaagaaatattaaaagtggctgagatcatgccattgcactacagcctgggcaacaagagcgaaactgcatctcaaaaaaacaagaaatattaaaaggttttagcctggcaacatagggagaccttgtctctacgaaaaatttaaaaattagccaggcatggtggtgtgggcctgtagtcccagctacatgggaggctgaggcaggaggaccacttgagcccaagaagtcaaggctccagtgagctgtgattgcgccgctgcactccagcctgggagacaaagtgaaaccctgtctcaaaagaaaaaaaaattatatatatatatatatatatatatatatat

SEQ ID NO: 6687 - DNA, 1219 bp, Homo sapiens
gaagcccaatgggtggaaatgaagttggggcagagcttgactctggactcctagttgaggttgtctcctctttcctgccacctcttgatgcctttctctgcttatttcccaccagatgcagaacccagagtcactctccatccttaccaatccccgagccatgcaggcattgctgcagatccagcagggactacagaccttgcagaccgaggcccctgggctggtacccaggtgagggtaggggggcaggagggcagcaaggttctagcaacttctccccttcaactcttctctctgccactctctcagcatcctttgtgtctctgagggtctgttttcctgtttcttccaactgcttttccttctggatctcacattctcatccctttcttggatgccatctcctacctcttggtctctcttgcctacagccttggctcctttgggatatcccggaccccagcaccctcagcaggcagcaacgcagggtctacgcccgaggcccccacttcctcaccagccacgccagccacatcttctccaacaggggcttccagcgcccagcagcaactcatgcagcagatgatccagcttttggctggaagtggaaactcacaggtacatgaggcagtgggggcaggtgctgggagcaccactttgatcctgggaggtttcaagggaagcaatagaatagaggcagtagggcaagcttgggagtcaggtcctgttctgccacttgctagccttgggcaggttactgatgctccctgagttcagtttgtgcagatgtgaaatagagatgagaagagtaatggtacttacccgtgcactacatactgttctaaatgctttagattttggagctcatttacgactcatttaccacattcctcacaatagcctcatgagaaagctattattattatttctgtgttaaagatggggaaaactgaggcccggaaaggttaagtggcttactcacttacatagctagtagataatgaagccaagactcaaacccaggcattccacctccagaatttacactataccatttctgcttatatcaaaggatccttttgataattaaagcagcccccatctctgagactctggggagggggattctgcgaggtaaccaaagccctgggaaagtcaaggccaggggctggcaggaggggcagggatgacctacctcgagtgagcctcttaacctttc

SEQ ID NO: 6688 - DNA, 1125 bp, Homo sapiens
ggggggtgggaagaagggatgtctgtctgtcgtccccctccccctctccactctttacccacaaaggcagaagactgttacactagggggctcagcaaattcaatcccacccttaccaattgagccaaacctagaaacaaacacaaaacacgaatagtgagagacaaaatagaggagagaaagagagcatgagagggagcgagacaggcgaccaacacagaggagagaaaacaaaaatagcaaaaaaaaaaaaaaaaagcagttctttataatttaatattctattttaataaaggcgtttattaccatataaatgtagcaaagaacctgggctaatatgaaaaaaaaagactttttattaggtaatttattatatgaaaaggatattttattttatgataaagtgatccttaaaaaaataaaaaaactttagaaggtttagaatatatgtagggagagaagaagaaaaaaatacatttgtattcagagttaaatcttaaaaaaaaaaagtgtttttaatatatgtttgggtttacgttgcttttttcccccactttttttttggggaggaatgtcatttgcttttcttgggggagcatcccgggggtgaatggtggagagaggagctgggggaacccggtccctcctgggacccttccagtagattggatttcactccatggactcctcctcccctctccccctccccctcaggggagccggcagagccaaacaaagaaagggattaacaagaaaggaagaagctgtaggactaaggactgaggatcctggggtgtcccccaccactttcccctgccctgtcgcaggggcaagtgaggagggggaatccagaattaaggcctagcaggcctataggaaccctcagagatgtgtgagatttaagagatctagatttttttttaaccaaaaacaagagagaaagagaagaaaaagagaaaccgaggggtttaaaagaaaagaatactacaaaataataattattaataataataattcaaatttatttcatataatcctagagagagaaagaaacaattactagttacttagtagacaatattaagatagcttaaagtttagtagcattgagggcccctgggtcca

SEQ ID NO: 6689 - DNA, 1127 bp, Homo sapiens
gcctctggtcaccctgtcctggaaagattgggagggggccagactgaaaattttactagagttacaactctgatacctcaacacacccttaaatctggaagcagctaagagaaacttttgttttgccagaggtggccactaaggcattctgacgccctctgcccacctcccccgctgtgtgtcactccaccccttcttccgaggagggggtgggtaaaagggagagggagaattaccacctgtatctagaggtgctctttgcaatccctaagccctctggtcctgacctccgacctcctaacatgaccctttacctcccaccccacccccatatcctgtttgggaaactgtcaccagtttccagcagtgtaagggagttggagtcctatcagaagttgcatagatcttctaggggttggggagagaagcatgtcaatcgtttctgtggctgaaaggctcagaagccatctgtccccacaaagctgggctagaggaatctggagaggagtcctcctctctgcccctgtcccctgcagtgtttcccttcactctctccgcctatcttcccttcctttgggatcttccctttcctcaactctttcctttccctccagctctttgctttgctttcttttggtggctgtcactcccagctctgtcttgttccttgtctttgtctttcttcccttccccctgcccctgcccctaccagcccagctttggggacaccatccttctggggagaagtagggggaggaatatttggatggtccctccattcctcttcaggcatctggaggccctctcccccactcctccaaagaaacatctcaaattattgatggaatgtatccccattctcagtgaaaatgtgaggaggggactaatactggggtaaagggtcaaacccccaccttcatcactatgggcattatatttagggagtagttcttgggctggattttctggttgtggaagtgggggcgccagagtagtgtgtctgctatttaaaggagcaggaaagggcgtgaggcaggaggagagactggtggagggaagagctgctcctcccatgcagtgcccgactccctgcacccctctcaacctgacctgaacctttattgaat

SEQ ID NO: 6690 - DNA, 1173 bp, Homo sapiens
aaaccttgctgtgtgcgtttctttgtctctctccttccccgccctatcccaggctgcaagattaaggccttgagggccaagaccaacacctacatcaagacaccggtgaggggcgaggaaccagtgttcatggtgacagggcgacgggaggacgtggccacagcccggcgggaaatcatctcagcagcggagcacttctccatgatccgtgcctcccgcaacaagtcaggcgccgcctttggtgtggctcctgctctgcccggccaggtgaccatccgtgtgcgggtgccctaccgcgtggtggggctggtggtgggccccaaaggggcaaccatcaagcgcatccagcagcaaaccaacacatacattatcacaccaagccgtgaccgcgaccccgtgttcgagatcacgggtgccccaggcaacgtggagcgtgcgcgcgaggagatcgagacgcacatcgcggtgcgcactggcaagatcctcgagtacaacaatgaaaacgacttcctggcggggagccccgacgcagcaatcgatagccgctactccgacgcctggcgggtgcaccagcccggctgcaagcccctctccaccttccggcagaacagcctgggctgcatcggcgagtgcggagtggactctggctttgaggccccacgcctgggtgagcagggcggggactttggctacggcgggtacctctttccgggctatggcgtgggcaagcaggatgtgtactacggcgtggccgagactagccccccgctgtgggcgggccaggagaacgccacgcccacctccgtgctcttctcctctgcctcctcctcctcctcctcttccgccaaggcccgcgctgggcccccgggcgcacaccgctcccctgccacttccgcgggacccgagctggccggactcccgaggcgccccccgggagagccgctccagggcttctctaaacttggtgggggcggcctgcggagccccggcggcgggcgggattgcatggtctgctttgagagcgaagtgactgccgcccttgtgccctgcggacacaacctgttctgcatggagtgtgcagtacgcatctgcgagaggacggacccagagtgtcccgtctgccacatcacagccacgcaagccatccgaatattctcctaagccccgtgcccc

SEQ ID NO: 6691 - DNA, 1233 bp, Homo sapiens
atcaagaatgttctggacttctacaagcagtggaaggaaattggttgatactgacccccaggccctgcagtggggctgactccagatctctcctgccctccctggcagccaggaccagcacctgtagtcaccccaccacacgcagactcatgcacgcacacaggagggaggcctagctgctcagaggctgcagggagggcccaggagccggctgggagggtggggtccctttgttgccaagacgttaggaaagcgaggaaagtgcttggattaggagagtcttgtgggcccctggccagccttcctgcctcagctcccctgctgtctccaggggcaggtggtaggcatgggtacctgcatttcactggaatgggttcttggatctctgaggggaaggaacagcaaaagaggcccttcttcctcacccaagatgcagggtggttggggccaggagtttggaccctctaggtcttgggggaagagctgggtaatacctggtgtctgagtgattctctgcagacccttcccctcctcaaggatcacccatcctcctttcagccccctttatggggaccaggcagctctggagccagccacaggggctgttagagaagcaaggcctggagtggcctgcaccgagtagcagggtcagggttcgtgtgctcctcctcctgctgcaggggctgcacatcccattgccccacttctgctttgtgtctccctctgtctagcttccagggcagggagcaggccccacctagggctgcaggcagtctggcctgtgccagcacggtctcctgtgcccaccagccccacaggtgctgtgctttgtgctcttggctgctgtgctgggacagaatgggatgccaggaagagaagaaagggggtgcagtctgaggccaccaccccccttcctatctaagggagggctgaagacaaggggccggcattcagtgggcagcagaaaggagaggctccttgaagctgctcagtcagaggcccccgtccctccttttgccttccgcaggactgaagacctgaaggggctggcttttggagtgttgaggtgaatatctgggagcagagatcatgaatagctcagggcagtgaatggcgcaccaagagcagggctgtgtgtgggaggctgcagccaggattgcctcagctcctccccctcaggctgggaggatagcacaggctaggggctcggggtggagggtctcagctctgctg

SEQ ID NO: 6692 - DNA, 1988 bp, Homo sapiens
tggctatttttttttttttttttttttttgagaaggagtttcattcttgttgcccaggctggagtgcaatggcacagtctcagctcactgcagcctccgcctcctgggttcaagcgattctcctgcctcagcctcccgagtagctgggattataggcacctgccaccatgcctggctaatttttttgtatttttagtagggatggggtttcaccatgttggccaagctggtctccaactcctgacctcaggtgatccgcctaccttggccttccaaagtgctgggattataggcatgaaccaccgtgcccagccagcccagctaatttttgtgttttttgtagagacaaggttttgccttgttgtccaggcttcttttgttaattttaaaatcaaacccccacaggcctctgaacataggccagatccctcagggtggtgctttccttgctcactgctgttctccaccactgtctctagctgaaggcctcctctcccttctctctccccagagctctcaaagtctgtggaaccgcctgtctgtgttgctgaatctgttgcctgctgctggtgaactccaggagtctggtgagtgggtccctggcactaccctcctttctttgctctctcattgtccccactaagcccatctcccctccccataacccagcccttggggtaaggaggttaatgggattcactgccagcctccctagcacacagcagtcattgtgtggtctaggcctctccggtttcccaccacaacactgctgtattgtgggcaggtggcctggtcagcaagggagtgtgctccctagggaatgcaagggcagagtgagagggccctgggagccagacctagctgctgctgttgcactgatgcctgtggtcattgagaattgactttgacctaccaagtttgtttgtctggctcatctcctaccaccttccagctggaaaactccacctgctcctacctgctaagacttgccaagggctattcattcatcctgagcgcctcctctcatttccatcccaatgtaattgtccctgctgtcaggaagccttcctgacctgagccatccttgttcttcctgagcccctctgctctgcctgactggctcttatgtgtccatctctctttacttcactccctccatctctccgcactgtcctagggtatgtcctgcctcatcatctcatcagcctgataattcccaaagggaagggttatgtctctctgactgggagttcccacaggacagatggtcttatgtgtccttcttctgcccaggcctggccttgtgtcctgaggtccaagatcttcttgaaggttgtgaactgcctgacctcccctctagccttctgctcccagaggacatggctcttcgtaacctgcccccgctccgagctgcccacagacgctttaactttgacacggatcggcccctgctcagcaccttagaggaggtaaggatagcatttcttatgccacagctctgtttgtcagtcacaaacagcagcaaatgggttcagatctggggagggagggggcaggatgccctcttccactcagacagggacagtgtccttggggctacaggctgtgcttccttcttcattcagtgagccattttagcttttttcctgccttggcagtccttctaaaggtctgccattggtagtttctactattgtagaacaaccacccccttcctttctctgccttctgtaaagggcagaacaaatagttattagggcttcgaaatctttatcagtctcttttctaactctgggcccagcctgctccgagctgaacatcaaacaatcatagaaagttagagctggaagggaatgtgctgcccgcttagtccagcagctttcacccttaaatctccatcaccacatgggccatctgggggcagcagagggaagtcaagcagacaggccacccagtcctgacatacataaaccacctggctgctccct

SEQ ID NO: 6693 - DNA, 1425 bp, Homo sapiens
gttttaccatgttggccgggctggtctcgaactcctgaccttgtgatccacctgccttgaccaaccaaagtgctaggattacaggtgtgagccaccacacctggctgagaactgcattttacattcaggactgaaaaggccgggcatggtgggtcacgcctgtaatcccagcactttgggaggctaaggcaggtggatcacgtgaggtcaggagttcaagaccagcctgaccaacatgaggaaaccccatctctactaaaaatacaaaattagccaggcatggtggtgcaggcctgtaatcccagctgcttgggaggctgaggtagtagaatcgcttgaacccgggaggcggaggttgcagtgaaccgacatcatgctactgcactctagcctgggtgataagagggaaactgcgtctcaaaaaaaaataaaagactgaaaagatagatttcagacaaaatggcagttccatagtagcatctaggtgatagatctaaaggaaagaaaagtgtcctttccttctctgctgacctctttgcatctgtggtttttctcctagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttgagaaagttgttatgtgtttttcaaccttgggccatctctcttatctcctggcaaataggtggaggcagaaaaccttactggggagggaaaggagacctggaatgagggcatttagactcttttgccttcttgagggagtattcttcagacttctcagtaaattttggttggaaagacccttttggagttcaaaggataatactgtaaagcttacaaagcaccattttgcattcactgcccaaagaacaagaggaacctgtctaaagcatgggtgttccccatatgtggttgtatgtagaggaacacccagtacatcctagggctctggcatgtgtcctaaaggacatataactttttttttttttttggtgtagttttcagaattctccctttaccatgagttatttttctctgccctcttccaatgtttttacaattccagtcttcattttggcttgctgaccttttctcatgccagtatcctgtcacagtcagacctctctgcctttctgctagcagaaacaaaatatt

SEQ ID NO: 6694 - DNA, 2232 bp, Homo sapiens
gtgctgctgtaactgcaatgatggcttcagttttttttgttgttgttttttggggtttttgtgtttgtttttttttagatagggtcccactctgttatctaggctggagtgcagtggcatggtcacagctcactgcatccttgatatcatggtttcaagggatccctcacctcaccctcctgagtagctggagctacaggtatgcatcactgtgcccagctagttttttattttttgtagagacagagtcttgttatgttgcccgggctggtctcaaacttctgggctcaagcaatccttttgcctggcctcccaaagtactgggattacaagtgtgagccactgtgcctggccccctgaaaatctttttcaccggacaggcaagacctcttaagtgatgtttccaacaatccacttttgcccttatccctagctacagaccctagagactagggaaatgggtacaagtatctgaaatcatctgattctccccacctcttccgtccattagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggtgagtcagccttggatgtatgaccagatgaagtagatcactgaacttcttgagagtttcccaaagggcctaaaataattctgtggtccatttatagctatttaatttggacctatagccacaaattccttttctgcttcctttttttaattaaataatttaaaattttaaaaattgtagtaagcataaaatttaccatcttaatcattttaattgtacagttcagtaatgttaagtatattcatgttattgtgcaagagatcttcagaactttttcatcttgcagaactgagactctgtacccatcaaacaagatatctcatctcctactccctagcaacaactgttttcttattttttacgttgaagttataaatattacttttttttcctcattgaggctaagtaactttcccaaaggcacatagctagtaagtaggagagtgtacaacaccatgcaacctcctaaaagatacaactaggaaggggtggaataggttatggctcttatctatcaagatacatgctgtttatttccatataactggcaagggatgaaataggttattgctcttaatctagcataatggacaaagacctaactttatggttgggtgacacccccaaaccctttgcagataccactccccgccatcctatattatagtcgtgtgttatatattctcaggtaaataatctgccctgcccagtaggggttccaaggaccttttctagttgccctccttggtggtttactaactttggcagttaggaagtccttttggtgcctccgattttatgagtcatcaagctttggcttcatactgtctgtttgcttctccaaggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggtgagttcctctccaagcttttctcttgatggagcagggaaagctgtgtttgccctgaggggaagattcttatctggctatccaaattctctttatagtctattccttgaaatctttctctccttttagtctttgacttgtttgctgtcattgccatttttccctgtcccttccatactggtccattgttttttacttcatttcttacctgatgtttcctgttaacttattttcccctttacttcttgcttcaattgcaggccaagcacacccaggagaactgtgagacctggggtgtaaatggtgagacgggtactttggtggacatgaaggaactgggcatatgggagccattggctgtgaagctgcagacttataagacagcagtggaggtaaggcaccctaagatatgtacacgctgttttaattaatttatttatttatctatt

SEQ ID NO: 6695 - DNA, 1111 bp, Homo sapiens
ctgttcaaatgaatgatttgataaaactcttaaagttggctagttatgggataaagtttcataaaaaaaaatgtgtcttgacctgagttgtaaaagttgaaaagtttacttggttgaagcagaagataaggaacaaattattttactataatctttgtatgtaagtgtaaagggttgctcagggaattaaggcaccgtctacagatgagttgtaatcttgctgaaaggcagaggaatggacaaaggttacctcctaatgtccttttagtttcctccaaaggaacaaatccccttgttctgcctcttggtccattattatagtcactgaggtatagataaggcacatctctacatatctaacatgccttcttcacatatcgtctggttttcttttctctagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaaggtaaactttcaaagtgtatacattgggtcaaattatatgttagcatgagtcatctcacttgtgaggaaatagtctgtttttcatgccgttgttttgttttgtttttgagacagagtctcaccttgttgcctaggctggagtatagtggcacagtcacagcccactgcagcctcaaactcctggcctcaagcaaatcctctgatttgctaggactacaggcacatgccactgtgcccagcaaattttttttctttttgtagagatgagggtctcatgttgcccaggctggtcttgaactcctggcctcaagtgatcttcccacctcaggctctcaaagtgctgggattataggcataagccatcataccctacttgaatgaaatagttttaaatcagagcaaggtatgttttttgtttgtttgtttttttgagatggagtcttgctctgtcgcgcagaggctagagtgcagtggtgcgatctcggctcactgtagcctccacctcccgggttcgagtgatctcct

SEQ ID NO: 6696 - DNA, 1356 bp, Homo sapiens
cttcccttctcaggctattcccaccattagtctgcccacctttctaggctgggcttggccaccattaaacacggggtgggggtgagggcccctgcaattcacggtgcaatattcaccagttttgccctctgcctcataaaggcaaacctggcttttgattaccatgtgtggatgtttcagtgtcctttcttctctgtccctggggatggggtggtctgtgaatatgtgacatttctgcagttcagtatccgaaggtttctcttgggggtaggggctcctgggcggccagatgaatgggtccctgggaacccagacctcagatgaggacttaatgtcttcttcctctcaagccaaattcgcctccacccactccctctgaagaactgggcatttgccaaagtaaccactggagtcatctaatggccctccccctccccaggtttcccacagctttcagggacagtgggcaagaggacacccccccccaccacctcagtggaacacaccattctccccccctcaacagcacactcagtgcagcaagactgacccctgaccccctcccagccctccctaccttggacaggaaggaagtaatgcaccttctcttgctgattatttatttgtttggagagacagaaatgtaaaagtgtatctagaaatatctatatctctatatatttttaactgactctttggaatcccctggggtggggtgaggggtaagtttaggctttcgcggaggggaggagacatggagcctgggaactccttgttctcccctctgctgcctctccccaccccttaaagcagttggtagaaggaatggtatttgtatggggggagggaggctggaatggagaatctggattctctcctcttccccattctccagagggagggaggtggtgaggaagaggaagggaggggcaggatgggccatggaggtgccccacccccacacctgacaatcacccacactcctggggctcttcctgggtcctggggcagggcgagtccaagtgtgaggctgttgatttgttttcaatatttcttttcgtgctgtatggtgatgctttcttagtattctacacaataagaaaagacaaagtcctcgagattcttatgagttttgtttgaaaactctttcactatatttgttgtaaagaggtttactattaaaagaaaaagaatacacgtttctgatacttcggcgtgggttttggtttctttggtgccgcgaggatgggaaggaaggactggtgtggccccatcagggtgagaggcagtgcttcatctcagcagggaagaatggggggcggccttcagggcggggcacttccacatgtctcaggt

SEQ ID NO: 6697 - DNA, 1439 bp, Homo sapiens
gggggtgcatacccaaagcctgggccaccccctcacacccccttctccatctcctctcttcacagacattaaagtgacgattcccactcccctcctctcagcctccctgatgaagagttgacaatctcaccgcccgcccttccctgccccgggctcctcccgctcgacccccacttcctttcttgtgcttcgtgtcctgttgacggttacatttgtgtataattattatattattattattattattatattttttttaatttggattctcgctttggagagggggatgctctcatcccctctttctgtaccccccaccattttcactggctggggggctctctttttcgcgggaaggggggacactttgcacgttgtacacatatgctgcaggaagggggtggggggcccaataaggcctttgggaaaggacaggtgccgagccctgcatgtggagccctcccaccccacccccagatagagggaaataaccaaaaaactaccaaacaacagaaacccacactctagactgaaaccccaaagtgggcttgatgggtgggtttgtgtttcaaggggaaagtgaggcagaggttctgaaaagggtctctgtttttgtgttcatgtagccataggcacatggagcagaatacttaagcctggcccccaaatgcccctgcacacacacgtgccacacctgcgctgattcttgtgtgtgctgcacccccaaggtgtgtgggtgctggctgagctttgggccgggaaggcagcctgggaatctgaggctggagacaggggtttgaggtgggggcctctctggaagcacatttggagggaaagacaagagagccatgaggagagggctgaggagggcagaagggctaggcagggggcaaattgagcccctcccttccccagtttttctctaagatatacagtgcaatagctccccacccctcagttgacgccagccctgtaaagctggccacagtgtgcagggagaatggggagagggtcttcagtgaggtggctggggcgagagtcggcctggacttccctggggtgctccaggccagagctctttcattggggcgagtgtggtgaggggacgtccttggtcttgcacgcacactacctgggggagtcaacactgggatggtctgtggggtgggagggcctacggatgggtccgtagaggtcccacctccctcattcctccttggcccctctccctagcttctcctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgata

SEQ ID NO: 6698 - DNA, 2076 bp, Homo sapiens
atacaaaaattagcctggcgtggtggcacctgcctgtaatcccagctactcaggaggctgaagcaggaaaatcgcttgaacctgggaggcggagattgcagcgatccgagatcgcgccactgcactgtagcctgggagaccgagtgagactccgtctcaaaaaaataaataaataaaataagaaaaacaatttcaagccctggttctgcttgagttgacatttgatcaagtcactgtacctctcttgcctcagtttcctcatttgtgaagtgggatttcaatgccctacttcagtggccagtgccactggtgactgcagaaggccccatgatgtgagtgttttgtacaccatctgactggaccacattcagaagcccttaaactcccctccctgcctcttccctcctaggatctcctgcagctccagtatgagggtgtggctgtcatgaaactcttcaacaaggccaaagtcaatgtcaaccttctcatcttcctcctcaacaagaagtttttgcggaagtgacagaggcaaagggtgctacccaagcccctcttacctctctggatgctttctttaacactaactcaccactgtgcttccctgcagacacctagagctcaggactgggcaaggcccagggattctcaccccttccccagctgggaggagcttgcctgcctggccacagacagtgtatcttctaattggctaaagtgggccttgcccagagtccagctgtgtggcttttatcatgcatgacaaacccctggctttcctgccagatggtaggacatggaccttgacctgggaaagccattactcttgtgtctgctactgccctcccacagtcaccccaatattacaagcactgccccagcggcttgatttcccctctgccttccttctctctgcactcccacaaagccagggccaggctccccatccctacctcccactgcatcagcagtgggtgttcctgcccttcctgagtctaggcagctctgctgctgtgatctgcacaccctccaacctgggcagggactggggggatgcagtgtgtgttagtgcccatgtggcattgtggcactgttgccccccatggcggcatgggcaagatgaccttccattagcttcaagtcttgttctcttgtctgtggtctgtttaatatgtgggtcactagggtatttattctttctcccatccttacactctggatcattgtgcagacttaatcagggttttaacgctttcatttttttttttttttttttttttttgagctcaaagagagttctcattttccctattcaaactaatacccatgccgtgttttttaccttggatttaaagtcaccttaggttggggcaacagattctcactcatgtttaagatcttgttatttcagcttcataagatcaaagaggagtctttcccttttctcttttaccctcaggattctcatcccttacagctgactcttccaggcaatttccatagatctgcagtcctgcctctgccacagtctctctgttgtccccacatctacccaacttcctgtactgttgcccttctgatgttaataaaagcagctgttactcccacatctgttgttaacccttatttcattttctgtagagccggcctttaagttctggaacacagctccctgagagaactggggaatccttcctgcagcctcccccagccctctgcctgcctccggtgtggtcctactctgcctgcctgagatcgtaaaagcttaatgagatgtggcatttattctctcttccttcccccgggggacagagaggaggaaggaatgcttaggtttctattctgtttttatcggccactctgaagactaaagctgagaagagaagccactctaatttctaccccacccgttttacacacagttcctgcaggttcttttcctgagccttgggtggtgatatcaaaggtgcttaagccataactccttaggtattgtagattctacactctgatcaaaatctcctttctgaagggaaagctccctcctttcctccttgctttcagaaagtagggagggaa

SEQ ID NO: 6699 - DNA, 1239 bp, Homo sapiens
atgtatggcctgtgtgggtgaaggggaagggcaggcagggtaccagagataggaaagtagcagggtagggccttcagtttgtaactgggtataaaggaatcagaacaggacctattgagagcaacacaggcaagacacttagtatggatggtgtaggctctttggtcctacttacagccagccatcagcaaccagttggctaaatcacagcaagtgaccgaccggttccttgtgtttaccatgccatctctttctgaccacttcccatgtccctttgtgcccctgtgccttagctcagcaggtatctgcttgctgcgcccttcctgtcctctctctccattgagtgacctgctactgcaatgtggccttctctgtgaagccttcctaatcccctcagacccccaacaccatcttatttaccttctgcagcactttccttgggctgatttatggtcatatttctttatgtgggttggggatgacttgagggcaggtgctgagtggtcttcatctctaggtccccatagtatccccttcaaacccatcgtgggcagagtgtcaaaatgaataggccccagtgccttccaatgccttccgttttttcctagtctcttcctcttccggctgggattggcccctcagatacatgatctatacgggaaagtgaaattcacaggtaagcccagctccttccctgaccaccacagcctgggcagggtcttgggggttctgggcctgatgaagggcacctgtggcatcattgcagctgaggaactcagcaacatggcgtccgaactggccaaatatggcctccagctgcctgccttcagcaagatcgggggcatcttggccaatgagctctcggtggatgaggctgcaggtaaggactaggctctgccctgccaggagtaggctcaatgcgtatgggagggctccaagcctcacagccattggatgggttctggccagctctcatccacagatagggccatcaggctacctggtttgtctggcccttgagggtgggaaaaaggatgacattagagtgggctgctactggttgcgctccaatctgggattcactctggcctcctgaccttgtttccatgccctctcccagtccatgcagctgttcttgccatcaatgaagcagtggagcgaggggtggtggaggacaccctggctgccttgcagaatcccagtgctcttctggagaatctccgagagcctctggcagcc

SEQ ID NO: 6700 - DNA, 1149 bp, Homo sapiens
ttcaagggcgatgttcgggaaccgttccacagcatcctgagtgtcctgaagggactcactgtgcccattgccagcatcgacattccctcaggtgctgggatccagaaggtggggtgggggagattggggccctaccctcctgactcttgcccacaccaggtctaaaataattttagtctagaggggcagaacacagctttctggacccccatcagggctggggaacagtgttcagaagtcccctttacatgttggccccatgaagagaccacggcccaagggtacgtggagctcgttggacgagagttcctcaggtgggaactgaggggacttcccactcctctgggactagggtaaactaaggtgtagaaggggacgagacatctggcctcttcctgaacaccaccctcttttcaggatgggacgtggagaagggaaatgctggagggatccagccagacttgctcatatccctcacagcccccaaaaaatctgcaacccagtttaccggtcgctaccattacctggggggtcgttttgtgccacctgctctggagaagaagtaccagctgaacctgccaccctaccctgacaccgagtgtgtctatcgtctgcagtgagggaaggtgggtgggtattcttcccaataaagacttagagcccctctcttccagaactgtggattcctgggagctcctctggcaataaaagtcagtgaatggtggaagtcagagaccaaccctggggattgggtgccatctctctaggggtaacacaaagggcaagaggttgctatggtatttggaaacaatgaaaatggactgttagatgccaagtgagttgtgctgtcctttacacaattcttattcatttgggacacagacagggagctacttctacttatcagtgtagcaagactacaaagaggttaaccgaaggaatttcttcaaaggcctccaaggaatatcttctaatttgtattcaggaccttcccaggctgggaacagagatgccagtcaggatttatctctaggctaggagcgcaagctcatgtttattcattcatttggtagcgctagaaactggcaactgtgggctaaatctagcccatagacctaaatttatgtttttcttaaccttcacaatatt

SEQ ID NO: 6701 - DNA, 1409 bp, Homo sapiens
aatctggtggcctggccactcagaatcaccaagttcctcacagccctccttctcctgaggggaggagtgaggggccgtgaatgaatggctaccagccccctcccatgtcatggcttctcggctccctggagcacattccagaggcccataacagctgctccttctcacagggcacagatgtgaccagcagctgagaaaacagcttcttgcctgggccacacagaggtgccatggccacctccccatccctcctctcagaggagacagaatccagaacatgtgggaaatgggggtggggcgggggtgagagcctgctgtgaggagcaggagacagttgtgggagatgggaccaacgggggacgggggctgtttgccttccagtcctgcaggctccaggcatcttgattaatcgtttttccttctgctttcgcttttttttccccctcttctctctccataacccatctcgtctcctccctcacctccccttcctgtgggagctgtgttctgagcaacatgtgctaccatttaatcagcatcctcagaggaggagcaggccatgggagagagctgagagtgctgacaggggccctgggctcatcttggctgatccagagggggctctctgggcagggaatagggtaggggaggcgggggtctgctacacagataagtcagccagggagcaggaggtgcttcccgggcagcggcagcgggcaggaggcaggttggttcacagaagggaccccagcccctccactgactgcctctcgcctgccctgcagctggctgtggaggccctggagcaggagaaacagggcctacagagccagatcgctcaggtcctggaaggtcggcagcagctggcgcacctcaagatgtccctcagcctggaggtggccacgtacaggtacgagacgagccctgtccacccaggcacacagaggcacacacacatgctggggcagactacgtggctgaaggggaccagaggtgtaggtgatggcaactctgctgccactgggttctgtgactctaggctggtcacttccacaccggaacatgtcctgcctgaaaccgtctgctcccccataggctggagacctgagcaatgtcctgtgcccaggaaatccccccaggagagatgatattgccgagcgggacagcctctggagaggggctgggcccgtgtggggcaactgcatccagacccttcccccaaggggcaaagctccaactctatgtgtgcccgcacccagggggtcatgtcctttggcagccacggaaaggaggcattgcaggcatggggtggctgcactgacttgccacctgacctgggcctcagcctcgtctaggggctgagggctgggctgggggacttccaaggcctcttctagcctggatgtcat

SEQ ID NO: 6702 - DNA, 2159 bp, Homo sapiens
agatgctgaggccccaggcatcagagatcatgagaggtgagtgagccccctgaccccttggcagctggactaggggggaccggccactctcggagaagaggatgaaaagggcctgcagtggtcagcctctcgggaggcagggtgggctctcctaggagaccggcactggctggggcaaggccaggccaaggccacaccattaacccttctcccctccaaccctccctcacagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattactatattggattctgactgattctttgggggtgtattggttaactgaagacagaaagtggggtaatggaatgcaaatgatttccaggtcatctcagatttaggtagagggtgtcaacctcctccatttttaggcatttggaaatccaaacttcttgtgggcagagtcgtagaataaaccacaccattcattctactcctgcccagccactgtttaacgcacctgggaaagttttttttaaaaaagggtttgcacaagaagtggggtgtgggaggatgcgagtatcggccacagcccaagatggccatgaagtgggagtttggaggctggttgtataaacaatttgaccccaaagtgcaagtcaaataataggataaccctttctccttgctaatgctaggggtacctgccacccttagctggtgatggggtggtagggggagggggttggtagggtgaaattccgccagtactccctgagttaagtggaatgactggtttagatcatttctgtttccttccagatctgacattttgtaactagatcggctactagcattggaagggcccacgtttcatccctt

SEQ ID NO: 6703 - DNA, 1176 bp, Homo sapiens
ttggtctcccaaagtgctgggattacaggcgtgagccaccactgcccagccgggaagggacttttgcaacagtatgaatgtttcttttagacagaaccttgttcttgattttgggtagcattccaaaggaaggagagggttcttgtgttaagaggtcccttcaggacacggagagaggttgagtgatgagctggagagacctgggcttttggggaggaaggacgatgtgaggttaagagcatcgtatttgttgaagacacagagttgaggaaggctcgctctgtggaagagggcagtggagctgggttgggatggaagagaagaggaatgatacctcaccttgggagaagcagcccgcagaaaggcctgaagtagcaggagtcaagcccagattaggtggtctgagtggacggaggtaaggaagaaacaagggctggtaagattttaggctagagaacttatctgtaactgttgtttttggtgttgctagtacataaaatctcacttgtcatctttctttcctcctatcccacacctgggctcaccagggatccagtgaggggactggtttgtctgccttgcttccccaacctaaaaacctgactgtgaaagagactaacaggttgctcctgccccatgccttctcccgcaaaccctcggatggctcccctgatactaagccctccagactggcttctaagaccaagacttcctctcttgcccctgttgtgggcaccacaaccaccactccgtcgccctctgctatcaaggctgctgccaagagtgctgccctgcaggtgacaaagcagatcacgcaggaagaagacgacagtgatgaggaagtagcccccgaaaactttttctccctccctgaaaaggctgagccacctggagttgagccatacccttaccccatccccactgtccctgaagagctgcctccaggcacggaaccagagccggctttccaggacgatgcagccaatgccccccttgaattcaagatggcagcaggttcaagtggggccccttggatgcctaagcctggggacgactacagctacaatcagttttccacatatggcgatgccaatgccgctggtgcttattatcaggtgggtaggaggcacagagggcaggcgagggaatgttggaacatggtggtcaaggagagct

SEQ ID NO: 6704 - DNA, 1167 bp, Homo sapiens
gtgagtgtgtttggggtataaatgaaggcctggctgtgaggcttgtgagtgtgagtgtgtgtgggagcgtgtgtcgggctggtgctggggtagtttcagaggcggcagctgctaattggtggctggattgtagtcaagcattaagtgggtctgggaggtctgggctctgtgggggtggagggggagttctttggtgcccatggggccaggggtgggacaggagccagcacagggagaggcggtggtgcccccttccccctgcctgctgtctcgctccctagcttctcagtctctcccctgcaagttacaaggtgggggtgaccaggcatcctgcaggcaagggtgggcagggccaaggtgtgggcaaacccctccatgcggctgtgtctcctctctaggcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgaggggctatgctgggtcaagggcagggacgagtgtgtgtgtgtgtgtgtgtgtgtgtgtgtgtgtgtagaagcccctaggcctgaacgatccctccctttctcccacccctccccagccctattccagccataggccctgtcatattcttctcaggctgagtccagcctggctcttagctgcatcccctgcccagagtcacagctagcccaaaccatgtcctctcggggcaggtgcagccccacactatgacatggggcttgctgaaggggtgcaggttgaattttagcccccatgcagtccctcgtctgggcagccttgtgcagcacacagccctgccaagacagtccccgctacaaccccagccctcccaagactggggctaccgtctgaccctgcaagccccctcaggtgttcaccacatcaagcgccgggacatcgtgctcaagtgggagctgggggagggcgcctttgggaaggtcttccttgctgagtgccacaacctcctgcctgagcaggacaagatgctggtggctgtcaaggtgagaccctgccccggggggtactgctggcctgggtcccacccccaggagctccatcacatcaggacagagtggggg

SEQ ID NO: 6705 - DNA, 1167 bp, Homo sapiens
aaggaggaggcttctgtgtaaatgcactttcttcctcccctctttctccataagaccccaggcagaggtgggtgcctcccctcccctctttgtcactttggtttcctataaatatgtatgtatcgtatgtgcatctttgctattgtaaataactttgaccttttttgttcctgttcctgaagtgctggaggcagttatggaaggagctgcttagggaagaggggtttcacttgtatctccttagttaacaacccagttccaggatcgagcctaaagcgggagccaggcctgagtgttcctgtccctgtgagtgggaaggtcttctggctccccatcccacctggctccagagcctgccctccacagcttgctgccaagctactccctccctccctggacttctcatcttcacaagatggggatcatgggggtttcttaccccacctatgtccccctcttccccaccctgtccctgtagaaaaccagtgaagcaggtacggagctgaggactgggccccaggaggtggggacaggggtctgaatgccgagtccctgaattcacccaggaccatccaaggggccaccgcagcattggccccatcaccacgtcctcacccaactctccctgatgaatagaatatacacactgtgctaggtgtatatatacatatatatatatataaatatatatataatatataaaatatagatatggaaatgactgttctgctgttaagataatgtatactcttttattttcttcctttcatggttaagattttttttttaagaaaagttaaatatccttcagtggtggtgtgtgtgtttcttggaatcgctgtgataaaaggtacggtgtttgttccctgtaagactggttaggattggatagtgggaaccagagggagccctctcacccccagacccagatcttgcctgttccctcccagagcttcagctgtgcactcactgaactagggactgggcaaacttaagttgtacaacccccatggagaaaacatgacaagacactgaactcagttacacacacacagatatatatatagatacatatatatacacacatatatagatatacacacacacacacatatatatacacatatatgtgtatataaaggagcagtggacccagagtcaagaggt

SEQ ID NO: 6706 - DNA, 1149 bp, Homo sapiens
ttataaatatgaatctattgaaatttccttaatcaagagcttcttcgtgtaaagtttgcttttttagctatagaaaaagaaaacagtaaatatctcttaatggcatccagccttgctgagctcaccttttttcctgaagaatgggtaggagtgaaatatttaatgtaaacatttcaccaagtccctttaccctaattttgaagctgcattaaacccaactcactaacacagggaatgattgcaccctagtcctctgtgggccaagaaactttcagaagcattaaaaaaatagttgaagtatatcacttctcaccaagtgggtagagtcagttggctgtttgtcccttgttttttatttattccataattatgtttgtgctttttgttttgtaaacagtaatggaacgtacatttttattttgtttagaagacaactttgattcaatctttcaagaactgttccattcttggtttcttcttagggggataaaaagttaccagttaatttgttttgagatatttaagcattctttgagttatagaattgtgatgcagggatttgtgaatgagacatttacatgtgaaaggtgacttcactagttacctgcttgagcagagtaaagtgtgtatatgtacataaaatgtaagtaatcttaactccattgtgcagtgccttttagatgttccgctttctataaagtcttcaaatttttgcatatatattatatatatatgatgtaatgttatagaaatatatgtataatatacatattttttccaggggtatctgatagctctgtattttgttatggaagttgaaagaaaaaagtattttacctcagaaattaaataaaaaaatacttttaagtaatgtttgctgagagttggttttgttgttcatcatacactgtgctggggtggtcatgccagagaatttgccaagtccgtcctcgctcccccaccctcatgcattgttattcctattgtacaggtaccaacatagtaaggaaataggtctcttaacagttctggagattttccattttcttgagtgaatggctgctaccagttaaaactaactgaagccagagacgcaagttaggtggaaatttctatctcaagattattgtgaagattctttaagagtac

SEQ ID NO: 6707 - DNA, 1165 bp, Homo sapiens
ccaaggattatgatttccaggaacaaaggcagtttatataaagcacacttcccccaaatcgaatctcccaacctcttgtgtccagttccgtactctccaccccccactcccacccaacagagctgatttctaaattaactttgtccttgtaatcagcttagctgagttttttttattattattatttttcctcctccttcctgaattctcccaggaacagcccggggccttgctcgctccattacccagcattgtcaagccatgagttgcttttaactgcttcttcccattcgattcgcttaactgggaggttattaaaaggaaaggagcagagatgggcaggcagggcagaggaggagagaacatagtagagagagaaggcatttcaaaggagcagaaacccaaggctaggcaggctggcagaatgaagcctctgagagaagttgaagttttcatctctactcctgagtcatccagaaggacatttcatcgagacagtgggactcctgggttttaatccaaaaccttgaggaattgacttgctcctctttgtctcagtcctccccaccactccccactctccctggaaatctaccagcttgacactgtgggatgggatgggggactcccagaggtcccacactccccttgatgcctgaccctcccacacacacacactcgtggctggctgtgctgccagcgccagaaccctccagcattcacccccggggcagctacattgtggttgatgttggatcccagactgacgtgcctatcacacagcacacatctgggaagtctcccttcaccaggcagtgggcgaagtgagaatgcaaactcattttaatgtcagtttgagccaaatataattagaaaggaaaatctctgactttgaaaaaaaaaaaaaatctaatgcatttcaaagccaagttgaaatgacttctggattatctgcaccgctgccactctccatttatgcagaaaatcgagaggggagcctgtaaagtctgtgcctgagggatttagtttgcacacattgcctttggtttcatgccagggtcatgttttaagactggcctttttcaacacaacccggttcctggaattgggaagcacctagagtgacctcctcaccagggggcctgtggcagagtcagcctctttc

SEQ ID NO: 6708 - DNA, 1187 bp, Homo sapiens
gttgttaagctcctgcactagactataatgctacttgtggatagggactatgatttgtttatatctgtaacttccgtctcttgcctcttttccccagcatagagcagaatgactgccatacagtaaatcaaaaaaaaaaaaaaaaaaaaaagccgttgagtgaatatcccagttatttgagtgtggattatccacttggtagatccctataattaatgtttaactcaaagtctagtttctcttccagctcagctcctggtactatcacgtaatatgtgctcagagaatgcaaacagtttttaaatattatcttcagtacgacataattaggtgctgctaaaaattcattatcatgctttccaaagccaaaaagaaataacttttgtattatccactccactgctcttcctcagtggtgtggataactgagacataaacgttttcatcataattgatgatgggaccaccttacagggccgctggatttattgggtgccaggaggaagaagcagtggcccatatcttctgtaattctttcttctccagttgctaagctccttggatttgcacagagcacttagagttgatggtcccaccctcagcagcaacctaaaaatggccaatgtgggctggcattgaggaagtatctcgaccaaaacctcaaaaattcacagtaaaaaatgccgtatcctagggctcttaatttttttcttggtggaatcataaaatccttttggttgttcttcagacctatttgtccctcttttgttatcagaattattttctggtgacccggagagattctttcactgcactatattgcagattctccaccaaaaaagcagaactcagctggctgcatgatgccaaaatgactccttgctttggctaattcagtcagctggtgaaagtatcgtggtattatggaaggagccctgtttgaggcattaccctcatcttagtttcattcctgattctgctactaataagctgtgtgactttgaacaggttgcttaacctctctgggctttggtaatcataatccctaacatgtggaagttgggctaggtaaaagcagaggctctttttagctataactctatgtgtaagtctgtaattgaggttaagaagaaatgtgcatatacatgacttttgactgaatactatttactttctataacaggtta

SEQ ID NO: 6709 - DNA, 1177 bp, Homo sapiens
gaagacagagaaggctggaagcaggattcctgagctcttcctcagctctgggaagcagaggaaaccaaggaaaactgttggagccctgagtagataggtgaacattcggcagtcacagtggtattatggatggcacagtggtgaaagatgtcggaacacgggtggcagattggagagtttggagacagctgacctcaaagaagagcgaggggccaagcatcatagtcaggtgggctgaaggacagggatcgacagacaaccaagaccaggggcaaactcctgccccagctgcagggatgagacatgaccatgatctccattctgatggagctggagcacagaccaaaatccaaccacaatgcagaccttcctctctaatccaaccttgacttaaacctaacactgtccccaggctcagtcaaaacttagccctgtacacaagccaaggttgcctctgtggctgtggcctagcctttagccagcactgagcttagctcccagtataactccagcctcacccctccacctttccttccccatcgaaagaggtgttacctgtgggcatcatagctggggccaccatcggcgcgagcatcctgctcatcttcttcttcatcgccttggtattcttcctctaccggcgccgcaaaggcagtgagtatgggccctgtgcagcccacagccttcccctggctcttccagggccatgacaggcagtgcttggggtggatgggaggttggcccttgagctccagcccagagggagccagaagcagccgctgcagagaccagcaggaagcacttgttccaggctgcctctcccgtcccaggtcgcaaagacgtgaccctgaggaagctggatatcaaggtggagacagtgaaccgagagccacttacgatgcattctgaccgggaggatgacaccgccagcgtctccacagcaacccgggtcatgaaggccatctactcggtgagggtcctgctcctctctggcctcctgccttctccaccctctgaggaccagctccatcccagatctctaataaccgcggtcattctctccttcctcagtcggtcttccctggtcctgccacacacactctcccacactcacacacattctctcacacacgccccaggctagtttcctccagcagaggataggcagctgggattg

SEQ ID NO: 6710 - DNA, 1090 bp, Homo sapiens
agggctggagagctggctgggggggttctctcctgttcaaagaagctttcaccatgggcttcattatcttgtcagaagtgaattagtttccaccagggacccctttatcccaaacagcaacacaaaatacaccctaaacctcagagtaaaattgatgtggggctatcctttggctatcgggtcatctgtgctgctccccactcatttctgatgggtttgcaaaggtgccttttgccagggcaggacatagtatgcacatagggatattgttatgtgcctaggtttcaggcactccttctgtaggggaaaatgggaggagccttcctccaccctgatccttaggaacattcctctggcccagggacagcttgttcttctcaccaaacaggtgaagcctgcagtccaaggtgcctggagccagaggtcggggagtaagcacagctgcccctgcctgagaaggagcagcttgcaaggggagccggtggagggaaaggggtacaacagctttggaatacattctggatcttgaggaggatcttgtgattttggctgagccacggtcacttccctcgtgaaggacccgccctatatcctaaattctggatccctcaaagtccagccacagagtttgcatgaagcaaaaagcctagtaagtgagaaaggaaaggggccagggatgggagcagtgctgtgctgttatcactgtcttgcttggaatgaaaacatctgagcaccctgtcttcaagcggtacgctctccccttattccagcagggctactttcctcttcactctgatgaggggagctttatctgctttcaaaatggagcacgtcgcactggagtttcgtgccctctcgttaacctgtcaggagccacagggctccataaaacggaatcagtgtctcaatatacatgacctatgttcatagcaatgttcagccatttgggtttgaagaaaaccacattaaagccaagacccgtttggagcgaactgccttgttctttgctgtgtggaaggttctgtccctactgctgaactccagttcctccccaagcaccctggcctcagaaatcctggcttccccaagt

SEQ ID NO: 6711 - DNA, 1221 bp, Homo sapiens
tgccggggtctgggcttgggaattggctggcacccagcggaaagggacgtgagctgagcggcgggggagaagagtgcgcaggtcagagggcggcgcgcagcggcgctccgcgaggtccccacgccgggcgatatggggtgcctgctgtttctgctgctctgggcgctcctccaggcttggggaagcgctgaaggtgggtggaacgagggcgcttgagtgcactcgcgggagggcggagagagggagctgggtagggacggggagggcaacgcctgatggggactggtgagacccgggacgcactggcgcgatctaggtagaaaactcgctgctccctggctccggggagaggcagcgcggcacagagttcgctggcatcagccgcctcctgaagctcatctcctcttgtttctttcttccttctctttatgctggctgctctcccggccacttgctacacgcctccaatcttcattctctcccagtcccgcaaaggcttttccccctccgctgcctccagatctcgtccttcgccaatagcagctggacgcgcaccgacggcttggcgtggctgggggagctgcagacgcacagctggagcaacgactcggacaccgtccgctctctgaagccttggtcccagggcacgttcagcgaccagcagtgggagacgctgcagcatatatttcgggtttatcgaagcagcttcaccagggacgtgaaggaattcgccaaaatgctacgcttatcctgtgagctgagggataggatcctgggccggtacccaaggggagagaatggccacagaaactcaactgggagactgtggcaccacctgatgagattctctgctctgtccaccctcttctgatttcccttctacctggagatgtcccaggctttgactcctcaaagtgtccctcgttcctgcctactccaggtcacttactttcctttccctgaagtctgggtccccattataacctgcacatcaatttcttctctttcatctctcccagtcttttaaacccttctttgatctttctccattcctctccacagatcccttggagctccaggtgtccgctggctgtgaggtgcaccctgggaacgcctcaaataacttcttccatgtagcatttcaaggaaaagatatcctgagtttccaaggaacttcttgggagccaacccaagaggccccactttgggtaaacttggcca

SEQ ID NO: 6712 - DNA, 1263 bp, Homo sapiens
ggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaatggactctggctgtgtctggggccactgtgccactgtggggaagggaggaatactgggcaaagtgcagtgagtgatacaggaaggagggcagagatgagaggttgcagtgctaacccctgtcttgagtttcctccccatcctcattctcacttgctttggggggtggtgtaggttggaattgagaggggacaggacctcacagctgaatgcagactatgtaggcagtgtccacagggaagtaaggccctttctagtcaatggaattggctaatcctgcctgctgcctttggctgggtctgcctctacagttggaacagcttctcagtcactgagagggtggggctggctgctggcacagccatcagtcctggcaagtgaagctgtctccaggtgagaggtccctcaggcgggcttggggtgaggtggtctgtgttggagtggtgagggtgggggttgcagtggtgaggaaacgtggagagctggggaatgagcagga

SEQ ID NO: 6713 - DNA, 1192 bp, Homo sapiens
ttttcttctagaatttaagtcaaccaagtgttatctatgttgtaaaaatggataatagtagattttaggtgataaaacaacttgttagtaagacatttcctagcttaaaaaaaaaaatcaaaaattccatgatagaaatgcagacctgtgagggaaactcctgaaaagcataagaagcatcccagagagccatgggttttctagaccagagaatttagagggagattgtggaactgaggcttaggtggtcagatcgtttcccttatcactgtaatatttctgggggaaaaatgctttctgagttgtttaaacaagcatccttacatttttttttttaattaaacagcctgtctaggcttgggattccctaatactacagtagcagtatatgaatatgattttgtgattgtgttttttaaaagataagtaatttgatgaactgttcttttgcagtcagaaaacactcacaaaaagacaaaaaaagttccacagtattatatttcatgtcagttcaggcctaaaatcctttgcaaataagatgtttataggctggtcacaattaacaatgttattattggcagcacttcttggatggataccttttgggacctttcattagaaagagggaaagaatggggtggttttgtatgggctcctgtttggggtaaaaatagcagagtcagttgctgaggacaatgaccttccttataacatttagtttcatacccatattaggtcttgtcttgaggaccctttatatgtgcttgtttactagtggccttccagccatagcattcttacctttttttcctattctaagaattaaaaaaaaaaattatagagccagcaagggaggaggcaggaaacagaaatcgaatttcatcattccagtatagttgtccctttttttgtatttctgacttggttttataattatatttacttactaattattgttttttaacattctttattgtggcttactcttcatacttagaattgaaattgttggacatcacatgtatattcacattataaatacatcattcttccactgttagacctttagattgcttccagtttttaatattctaaataagactttcaacattttctgtgttttagctcattctcttaggacattcttagaagttagaaacatttctgctgggatcgttggagggaacttcaa

SEQ ID NO: 6714 - DNA, 1113 bp, Homo sapiens
tccaggaccggaccctgcacgtgaggtatacggacatcgactaccaggtcttcaccgacgccgcgcgcttcgtcacggaggggcgctcgccttacctgagagccacgtaccgttacaccccgctgctgggttggctcctcactcccaacatctacctcagcgagctctttggaaagtttctcttcatcagctgcgacctcctcaccgctttcctcttataccgcctgctgctgctgaaggggctggggcgccgccaggcttgtggctactgtgtcttttggcttcttaaccccctgcctatggcagtatccagccgcggtaatgcggactctattgtcgcctccctggtcctgatggtcctctacttgataaagaaaagactcgtcgcgtgtgcagctgtattctatggtttcgcggtgcatatgaagatatatccagtgacttacatccttcccataaccctccacctgcttccagatcgcgacaatgacaaaagcctccgtcaattccggtacactttccaggcttgtttgtacgagctcctgaaaaggctgtgtaatcgggctgtgctgctgtttgtagcagttgctggactcacgttttttgccctgagctttggtttttactatgagtacggctgggaatttttggaacacacctacttttatcacctgactaggcgggatatccgtcacaacttttctccgtacttctacatgctgtatttgactgcagagagcaagtggagtttttccctgggaattgctgcattcctgccacagctcatcttgctttcagctgtgtctttcgcctattacagagacctcgttttttgttgttttcttcatacgtccatttttgtgacttttaacaaagtctgcacctcccagtactttctttggtacctctgcttactgcctcttgtgatgccactagtcagaatgccttggaaaagagctgtagttctcctaatgttatggtttatagggcaggccatgtggctggctcctgcctatgttctagagtttcaaggaaagaacacctttctgtttatttggttagctggtttgttctttcttcttatcaattgttccatcctgattcaaattattt

SEQ ID NO: 6715 - DNA, 2500 bp, Homo sapiens
tgcagccatacccattctgtgtattgtctgtggcggccttcacgctacaatgagttgaatagttgcaataaagaccatatagaccacaagtctaaagtatttactctctggccctttaagaaaaattctgctgatctctggcctaaagcatctaaattctggctaagacctaacaggcttgtccttgttccatccagggaagttactaacaagcctttcccatccacagcgctggcgagaacctggggttggggccacagacgcggactctgatgagtctcccagctcctcagacacatcggacgaggaggagggccctgaccgggtgcagtgcatgccatcttgaggcctcatacctaggtggggcaggctggggctgccaacctgatcctgcctgggcaaccctttcctgtcccaggccctacattcagcagaaacgcactttggactttttgctttagataaaagaaagacatcccaggagaaggacaaaccagaggagtgaaccaacaaagagtacctaggaatgggagttgagccctggaatggggctctatggagaggtgcataggactcggcagaaatggcctctccccaaagcctctttttgagaggagagggaagcctattttgttaactggtttgggatagggaatggggtttctttttctttaatctcccttgtttcttgggctgggggaggggtggggggaacaactggctattcagtaccaaggggccagagtggagggtaggagtgccactctctctttggtttaggtttttgaccttttcttcctttgttttttaaaagtttatgacagttggctccccccccacccccagcaaccccatcccagaatcctattttcctgggaagtccttaaagcccctaaccatcccacactcttcactttcctttccaccttattcattctctgtacttaccacagtattttgcacttgattacatatccttcactctcttctcttcatcccatcaccccctaaataggtcaggtgagggaggctgggaagaggtgggaggaggggcagaagtgaaggaagaataggaaggatattacctcttctgttatttttttaagaaacattgtttggtggcagcaatctccctgtccctatcactgttagaggcctaattttatatctataaatatattaaaaagcaagtcaaacttggatgtatcaaggtaaaattattgtcaaagtttaaatacctatatattctctgaatgcaataaagggacttaagagtgaacaagagtaatggtgtggaagtgacacctggggtcagtttacctctgtgtatggtcactagagattgggacttaccctttaggttttaggaggcttgagaatggaaggatcctcatttctgcccttcctggttccctgctttggtgtaggggttgggaaaaacaggaaattcctctcagctctgcctcagatctcctacctctccttaagtcttgtagggggttccaaggatggctcttctaaccagaggctggcctgtctttaaaacttaactactttagggtggtgccaccactgcagactattgtggtactttgtgacagaagacatgtacacacacaccacacacatacatacacactctctcactctgtctctcttacctttagctgcttgatcattaagccatccaacttcatgccagttcccttctttatagaagagtgaagggaaagacttcctgggtttgacttaaaccttgtccacctcttgatattttaggattgaggaataagtcattaatctaaggactgattacagtggctggagcttgggcacttgtcttatcactggtcactgagtctgaaagtcccagctgaattcttgcccttaagtgcttttgctgctatttttttgcccccagttccacaagatccaaccaagaattctgtatcctgggacagtcagattcttctaaatcaggccaggaaggaggggaaaagagtgagagaatggtattcccagatacttcttcctcctgccccttttcccagcagctctgagaccagatgttggctgctgtacttactccctgaggtagggaatgtgtggtgatcgagtggtctgtgttcctattgctggtggggtgatagggtgggctaaaaaccatgcactctggaatttgttgtattttctcccagtaaagcttttcttctcccgactgctgctctgtgtggtatgtggtccatttattcacaatggatggtttttgttcctactaatgtaggtacctagccttcccctctcattctgcacatgatacagtgttagaaagtccattttgggagacccgtatttccagtgcttgggctccaattggagactgttggaagtaggatacactccatttagctcagtgatacttaggagattgggtggggtgagggtatacacttggggtattttcccagcccttattctgggccataaatattgttccccc

SEQ ID NO: 6716 - DNA, 1183 bp, Homo sapiens
tacaggcatgagccaccatacctggccataagttacattttaatggaatctgagcaatagtctctgaccttaaggtcttttttagcctactgtttctgggattcttcttccacgtctctccttgttcccaggtgatagggaagatatatttataaataaagggtaggaaggtatctgtagtattgtctgattaataactggctgttactgtgttggactgcagctaaactgaggcttcctaaagaatggtacattcatatacctttagtttatacttcttaaggaacactagaaagtgacttcactacatatttttttccccaatccccaaagtcccatataataaatgtatgtgcttttttcctgttgttacgtacaaaacaaacagagaaaacacaacaattctttctttccaaatgagaatctctttggtttcttattagccatgtgactctcttggctctcctttgccatgaccatttggatcttttggagtatataactttctgtgcttttctactcttaaaggaaactggtggtgacaaaagagaaagagaagaaagtggggctgtatacgatctatgtgaatcctgccaatacccaccagtttgcagtgggtggacgagatcagtttgtaaggtgagtttgtggctcttttgtgtctttgacagtttgtaagactgatgcattgtatactaccaggtgctcctttatggagagttacgaattttataggaatccattaactattatcttgaattttttaccgttttccaaaaatcttacacgcctttggagatgttctgttctctaatgtaacagtctctgaggggtgactttacatattttagagattatcaagttttaaagaagttagatgatggtcaggtgtagtggctcacacctgtaatctcgacactttgggaggtgaggcgggtggatcacctaaggacaggagtttgggaccagcctggccaacatggcaaaactctgtctctaaaaaaaaaaatacaaaaattagccaggcatggtggtacatgcgtgtagtcccagctgctcaagaggctgaggcaggaggatcacttgagctcaggagtcagaggttgcaatgagccaagattgtgccactgcactccagcctgaatgacagagcgagactctgtctcaaaaaagaaaagaaaag

SEQ ID NO: 6717 - DNA, 1222 bp, Homo sapiens
caatgttttgcctcttgagaacttaatataatcttagattgtcctgagattctttgcttttgttgaagtattttatgtgtgtggatttgatcttaatcttttcaatttcttgtcctttacaagatttcccctcagagggtactctctgtaattatttgtaatgaaaacacttggaccaaagttcattttttggtcttttgatgtgaagatttcttagactaaggtggtcactatcctgttttcttatttttccctctcctctactccttcctcactaacatgcaggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggtgaggcaagggagcataatagcaactgagagaatcaggcatgagttagagaaatctgaactgcagcatggattgggagctgatagtgagttattgtaggaattacatatcgggacatggccctactttggctcccctaatgacctaaatacactgaaagactcttggcaaccctagattccttgagcatgtggactgttggaagcctcataggtagggtgcatgcagcttattaaatgtgtgctggtaggaggcagtgtagt

SEQ ID NO: 6718 - DNA, 1607 bp, Homo sapiens
cttattttctagctacaagatttaggccatcctccaaaagagctggctggagagatggtgagtatgtcttatttttccagattttaatttgagtccccaatttccagaattctttaacctctcaggattccacctaaggtgaaaattgtggctactggggatggatcttcacgtctgtcctaaaaaatgagcaactatctgagtcccttcatctcttccccagcctcctggcctcaactttgacctggatgccctcaatctttcgggcccaccaggtgccagtggtgaacagtgtctgatcatgtgaaacacaacacgttttcctctctgagtcccagctatggggaacatctggagtcagcagaaccattgggacctgaggcaggagtgtcacctgcgggagaagtctgcccgctgccctctgtcatcccattcaagattgtgccataccagctgaggtttttcctctgtctctctaggaatagggtctgtttcacaggccatttctgtgaaccctactccattgtggtttctgccactatcaaagttccagctacctgcaaggtgaaggaaggcatcccttttggggcatgcactttctttcctttctcaaaataatgttatatgtggccacactgatgttcacctttacgtccagggtctttgtgccttgtctctactccctctcttggatctggggaggaggggcagagacctgggactctgtatttctatagttctcctggcagagcctttgagaatggggagaaacagcctgggctggggctacaggtctgtcactatgctctcttgccttcagacagaccattctgaattctctaaagggaaagggcttttgcatctaatcacaatagagttgaaagagaggccttaggattctcctctctctaggtgctgagccctcacctccctgttccaggctgagaactcaaatggttaccctgcttcttcctacaatgctgtgtgatatgggtgaacccagcccctgaccttcctctatcccctgcccatcctcccttttacctcctctcttttttaaacacctgtttatcccaacctttttgagctcaagctgtgataaagaagggcccatcctatttcccctcatctagtccatttacgattctcactgactccccgtcttcctggcagacacaaataaacccagtgtcaggtctaggaaattaatggctattcttccccagatacattctggcttatttgagatacatgattctcttagaatcctgtcccttggttcaggaaagtagcttggaaaaggagtaggggtatagcttgggtcccttttcctgcaaggccccatggggcagaatataataaatattctgagtgaggagtgtggtctttttctgatcttcctcagcttccgtaagttgcagagtgaggtatattaggagactagttctacacaatattgtaatgctgggttccatcaacacccaccttccacaactcagtctgcacctcagttggcaaaggagactggatggccatctttcctcatgttcccttgagtatttcaatgtagaaagcccttcaagtggtattatattttaaccttttac

SEQ ID NO: 6719 - DNA, 1178 bp, Homo sapiens
ttaagagccagtttttggtagcaggaaggccagttccttccatctgtcttctattccctccctctgtgaaagctactgcaagttagcataacatatataccacaaaaataaataatacacaaaaataaatagtaagtaggcagaagcttggcacctgtttttgaaaggatttaacctgcctacagaaaaggccgtatctcagacttgctggactataaccagttccgttctgttccttccctctgtagggaagggaggagcactggctgctgacattgacattgacactgttggtacagagggctggggagaggatgcagagctgcagttggatgaaggtaaaagtgctgttttaagactgttctggggtgatggacaccttggattgggactgggttgtgggtagctctgcagacttccaggccatgaaacgaactaggattgattttacttcctttggctaagattatgccactgcccaaatctgttttgagcttgaattttccttacagatgggtttgtggaggctacagaaggtttgggggatgatgctcttggcaagggacaggaagaaggaggtggctgggatgtagaagaagatctggagctccctcctgagctggtatgtggaatttgtacccttagaaggttctctccgtatctccctgtggaagccagaggccttattgtcccctaccactatcctcaggtctcctatcctatcccctaccactatcctaaggtcagcccttctgggaaggggactagaccctcctagtctgatgcttatctcccatttgaaagaaggaagatggctgggcacggtgactcatgcctgtaatcccagcactttgggaggctaaggcaggacaattgcttgagcccaggagttcaagaccagcctgggcaccatagcaagaccctgtctctattttaaaaagtaaaagaagcaggaagaacgagagagtcaaagttagtggccttgtcacttccatctatcctgatatgctccaagaggagaggatgtaggacttatctctaatctgatgcttaactcccatttgaaagaaagaagaatgaggtaatcagcgttctgccagcagcagcttatgagaaggtagcaagctgtttcatctgaattggagtttttgatatgtcattttgtcactggtgaggtg

SEQ ID NO: 6720 - DNA, 1173 bp, Homo sapiens
aaagtcaaactctcaaaagtcaaggacaaagaaaggatcctaaaatacacaacagaaaagaagcaaagaacacacaaaggagctccaatttgtctggcaatagatgtttcaatgcaaaccatacaggccaagagagagaggaatgacattttccaagtgctcaaagaaaaaacctgacatctaagaatactgtacccagcaagattattttattttccaaatatgaaggatagtatttcccatacaaacaaaaggtgagaatttaccaccaccagatccatcttacagtaagtgttaaaagtagttcttcgatctgaaagaaaaaaacactaatgtggtagcggaagttactgcagctgcggtgttgtgctgtggggaagggagaaggatttgtaaaccccggagtgaggttctgcttacccgaggccgctgctgtgcggagacccccgggtgaagccactgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggcgttccaatgaattcattcaggtttctctttgagggtcagagaattgctgataatcatactccaaaagaactgggaatggaggaagaagatgtgattgaagtttatcaggaacaaatggggggtcattcaacagtttagatattctttttattttttttcttttccctcaatcctttctcatttttaaaaatagttcttttgtaatgtggtgttaaaaacggaattgaaaactggcaccccatctctttgaaacatctggtaatctgaattctagtgctcattattcattattgtttattttcattgtgctgatttttggtgatcaagcctcagtccccttcatattaccctctcctttttaaaaattacgtgtgcacagagagcccacctttttcaggacattgcattttcaggcttgtggtgataaataagattgaccaatgcaagcgttcataataacttgcgaattggccctgatgttctagcatgtgattacttcactcctggactgtgactttcagtgggagatggaagtgtt

SEQ ID NO: 6721 - DNA, 1150 bp, Homo sapiens
ctgattccaagtaacttaattgtatcctagagcaaagcccaagaatatgtaaaggaatatgacaaaaatctagtaccaaacataaaattcacgatgtctggcatccagtaaaaaatcatcaagcatgtcgaatgaatgaacctaggattaaccttgatgtttctttttcttatcagaattgacagaaggtgacatcatggggcttagttagctcattgtatcattttctatttttttcagggctcagctttcaccccaaaagaccttggatcctgactagtttacataatggggtcatccagttatgggactatcggatgtgcactctcattgacaagtttgatgaacatgatggtgagatatttctaggaggaagttaaaggagtataagtatttataatatcctggggtattttaagccttgtttgacatggattcctctatgattaaagaatgtggaaatgatagaactgaaaaatcctgaataggaatcaccttagagattagaaaggatagctctgtctaacatacattgcctgccttctccaccaggtccagtgcgaggcattgacttccataagcagcagccactgttcgtctctggaggagatgactataagattaaggtacagagggtctgtcataactgagaataaaggaaagaggatgtgggaaggtttgggaatcatgaaaggaactgaaagacaggaaatttcattcatacagagctcaggcctttgacaacattatccggagaacttactcagcaaacatttattgaatgcttactgtgtaccagacactgttttctttttagggaattcaaaaataaataagaaatggcttctgttttcaaggagcttttattctaatacagaagataaacatatatccaagtaatagcatgtacagtttggtaagcaatataatagagagatattcacagtgaaataggaaagagcagtataggtgcaaagacaaaaagcatgacacagctagatacagggcagctgttattggttttgtatggagaaaacctggagaaatggtgagagaaggggcagaagatgagaggggccagatcatggagtacctgtttgtggcgctcaggagtttagatgttatcatgcagataactaggagccatttg

SEQ ID NO: 6722 - DNA, 1602 bp, Homo sapiens
acagatagtttgagtaggtgttcattctggagagcccctgtggatcccagaactctttcacagcttcaactcccggctggcattccccatctggcacagctgggatgagtcagtctaatgtaccgagctcctgtcacaagtcagtaatgtaagtgccgcaagggaaccaaagccatgggccctcctttcaaaatgcctaaaatctaagtaatacaagatggaagcaagaacagagatgctttacttctcttttcaaatggggagacaaagtctgtaggctggagagatgttgcccatgattattccatagttggtgcttagagccagcatccgaattcccatggctccaaaccccaaacagttatccaaaaaactgcactgagttctgagaatgcctttgtcctttcctgccctccctccccctgcagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatcccacacgacttgtactgctagttattcttcccaggccaccttgttcagcgagcctagactggaagtcatgaagttatcttttatgctatcatcttgggctccagaggacccaaggagtaaggctctgtcaaaaacagttgaagtcctttcaaattgcagagccctggttctcctcttgtaagaacaatgttaacatagtttcttctcactttgtaatgaacgggcatttttttttttttttttttttttttttttttttgagatggagtcttgctctgtcacccaggctggagtgcagtggcgcgatctcggctcactgcaagctccacctcccgggttcacgccattctcttgcctcagcttcccaagtagctggga

SEQ ID NO: 6723 - DNA, 3411 bp, Homo sapiens
taccccatgtgaacctggagagaccatcctgctgtcaacagtacctgggaaggactcccacctcaccaacaacttttgtattactctaggccctgcaggaatcagtgcctctctccctcttctttccctagtcttttcccagattacagtctctcctgaaagggcacagggccctgctgattgtactttcccctcctgagccccgactcacaaatccaagttcttaaaacatttctcttcagtggcccaacagggtttctctggggcacatggacatgactccagagagccacagtgccaaactcctccagggcagcaactggccctcctgtccctcaccccagccacaacaaaccctgggttctagggcagggatactcctgccacacagcccgagttagaaatctccttgctaggagcatttgcttccacatatatttagagcaaagaaggatcccatccttttcccagaaatctccacctaatgtttttggtttgtatggtcacgtgaccataggcaaccacgtggaaaccctctgtgaccacttttccagggacttaggggaaggtacctttcttccaatgtgtcttcctaggcagcccctgaggaggagggctgaatagatccctgaggttttggagagacccccatcactgactcctgctccctaaccctaccctcactttcgtccccgctcttcccagtgaaggatggtatgtagactcctgtacagacatagtggcttgcagaccctgacccagcccctgtggtcttagacaaatgtttttatttttgtcaccagccacccctgtcctgccgccttctctcgactccagagacctgttgcctcatctcttttggggaagagccggcagctcctcctcatcccctgccttaagtccagttctttgcctcaggggtctcgtttccttggccttccagggtccccaccccttttctccctgcctgattctctgagctctgggctccgtctgtattgggttgaggggcaaggattactgccttttgtaggtacttcacccctcaccccattttagcttccatagtctttgcaccaaatccaaattcttgataatttagatctcattttgagcaaaatttgctggccctctaataaatattttcaatataaatctgagcctttgactcagacatttttgccaaggagagtagaattaggaagtacccatatacatccagccaggatccacatggaggacctttctgatggctgcaatgactaggccattcctctgagtaactcacagtgtccttttgtaggcccttcttttccctgaaagactggttggtacttaccttgcagagcacatcctgggataagatccccagtgtctcccctgggaggctccccctctgtgtagcaccagccctgggaatgatggagcctagtgatcggggtttctcctgctgtcctttctgcaaaagttcacttgtttacccaccgcatgctagagaggagctcattggccaatgcttaccttgtccccaaaggggtgggttgtggagctcacttaggcagggcctctggctggggccagggttatgagataggcctgtatgaaatatgtcctgttctgggggtctgtctcttttcttctcttcaaaaactttgtgtcagagagtcccttctgagtcacataaatacctcactatcctggaaaacagggcctggatggtgactggggtcattgcctttgtggacaggatggagtgtggtgtggtctgaggagcaggttggggtgggggagagggaaaggatttgggatcttagttgctgccctaggttaggggctggggagtgtttattttaagatcctgccatgtttttaatcactgtgatttttttttcattcccctttcctaaaaaaaattttttgcctccaactctctaagcactaagggctgtgcctgagaatggtagcattttggtcttttgcttcagaactgtggtatctttgtcttttttcattattattattattattattattattattactattgttttttaaaatgtcaggatgaattgtcagacatatggccatgtgtttgtcctctgcttctcccctgtgggaagttgtctccatgctgtgaactgctgtggggtgtgcagctgactcagtccctctgagcagtttccccactgtgtctgtcccatcatgcgctggatctgctcattctcctgctgtgggggtatgcccacctcttacccccttgacaccatagggctgctgtggctgggcctcaccagcactgtcttttgtgtgactcatggcatcctcgttcatccccaccgtgcctagcaggccttccttttcaccacctcggaacgcttgcctttcctccctccacaacaggacgctgtgcctcagtccttcacctacctcgccactctgccactgtccccattggtcctttctcctaaactggtctttgtgctctctttgttttttcttatttccctcttgtctctcattttttcttcccattcccctcccatttcagcccttaacttttctctttcccatctccactcagtattccaatggcaaaccctgatgatgtaacacctgcgatgagacatcggactctccggaactttctcatctgacacgtctttttcccagggttcgtacttctcctccattggtcccaggctaactcccctgttcctctgtggtgtctgtcagtccgtctgtcttctctttcctctgcccttcccacagggcagtatctgctgatggattcagtcctggtgtgtgattgttgtgatttgttcttccgtgcgcaaaaggaagagggctttttgagtcccttccaagtgagattgtaaatgtagaattttccactgttggatctagattttttttccttttttttgggggggtggggttacagagctgagaccttgtgcatgcatgtagaaaattgtaaaatgtaaattttttttaatatataaaaagcttgtttctacagtttgcagtggatctaaacattacggcaattttaggatttttttcttaaacataggaactaaaactgtacaaattttttttatataaaataaagacatttgacttttgtgggggcattctgttgcttttctttctttacaggaatgggagcaaatgagggccagggaataatgaatatattccttgttagggagggaatgggcaggagggggcagtgtgagctcatcattgctctgcaggccttcagggtgtgttggagagaaatgggaaaatgaaaaaggaaattgcttattctgaatcctgattctaaagagagagaaacaacaatgtgagggcttaaccacttcctggtgtagttgtcaggatagagaaagaaagattacttcctgggtc

SEQ ID NO: 6724 - DNA, 1694 bp, Homo sapiens
gccacctggggctggagtgaggagatttctagcccatgtttatgtgttttggggattatcagctaaagaagactattgagagttgactggatgttttatttctgcagggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactaaaaatacaaagttagccaggcatagtggtgcatgcctgtaatcccagctgctcaggagcctggcaacaagagcaaaactccagctcaaaaaaaaaaagaaagaaaagaaagctggagctggtggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgaatgttgctggaaataaaaccttggtttgtcaaggctcttttttgtgggaagtaagtaggggaaaaggtctttgagggttcctaggctcctttgtacaacaggaaaatgcctcaaagccttgcttcccagcaacctggggctggttcccagtgcctggtcctgccccttcctggttcttatctcaaggcagagcttctgaatttcaggccttcattccagagccctcttgtggccaggccttcctttgctggaggaaggtacacagggtgaagctgatgctgtacttgggggatctccttggcctgttccaccaagtgagagaaggtacttactcttgtacctcctgttcagccaggtgcattaacagacctccctacagctgtaggaactactgtcccagagctgaggca

SEQ ID NO: 6725 - DNA, 1236 bp, Homo sapiens
tgggagatattataccaccttccttagatgaaaatgaggtccaaagtgtgaacctacttttggaaagcaagctgggtatctgaaatcctagttctcattttgttgaccttatcttgcagagtaaaggtgggattctatccaaagcttgtgattatatccaggagcttcggcagagtaaccaccgcttgtctgaagaactgcagggacttgaccaactgcagctggacaatgacgtgcttcgacaacaggtcagactcctacccccagtgcagcccttctcagttctgctagccactgacccagtttgacaccctctactttgttctccatggagaaggcttcatcttttccccctcaccagtggatgtctgaatacattcaggggcttggaagtgccagctttactacccattccctttactgcctccttcccatgtcaggtggaagatcttaaaaacaagaatctgctgcttcgagctcagttgcggcaccacggattagaggtcgtcatcaagaatgacagcaactaactatggggattcaggggctttgggcccaagaactgcagatagcccaggagcaacagcctaatcccgtgcccctttccttcactgccccacttctggcatgggacagggggaagttcagaaggtgtgtccttgaactgaggccctgtgatatggcggcctgcagtggtgtgaaacacacaatgtggacgtgcactgacagccttgcccacccccaccatgcagcccctgggcccttgtgctcctctcgcacaatgcatgtgctgtctccatgctggatactggacacactaaactctggggcttgtcctgtgcttgcttagagtgcccagcagaggtttgctgacaggtgatgctctggcttgccccaggactctggcacttccattggttcttcctttccctggagctgaggtttagatgtgcaacctgtggctcaggggagcaagcttacacaagaagtgagggaaggatgtttagcagtggctggtgcccatgaagaggagattggccagtgagaagctgaggcctatgcagacatctctggagccagagagaacaacaggcaggggcccacttggggccttcccccttgtgggggtcgttttttttttttcttttcttttttttttttttttttttttttttttaagataaaattgttcaaagccacagttgtctgtttttcttccttttgtgggccacgggc

SEQ ID NO: 6726 - DNA, 1206 bp, Homo sapiens
tgcagaagggtctggatcccggagtcgtcttagtctgccccccagagaaccccaggttcctgaccccctgttgtcctctcagcgcaggtcatatgcatttgaaacacaggctaaccctgggaaaggtgaaggactgtgattaggaccacagccctgggcaaaggggaccagcaagttgtcttgaatctccagggttcctgactagctgtctcctctgcagcatgagcagctgtagtgcccaactctataggctttggccctccagcttctctctttgactgtgggaggcactgccttggttggtttacctgaacttgtctccgacacaaagcacttatctcttaggagattcccaagaaagtcaacaagatcttgttcccagggagtgggtcattggccaaagggaacataaggtaggcagaaaacttaaaagagtttgttaaagtgaagactggagaaattcctcccttcctctgagctgtgaatctctcttcatgaaagccaaaggtagagacagggaggacagggccaggttagggccttccacacacaaacacttctagagttgcccattcctgttatgttcttggaccctaagatacctcctgtcccttttaaatccagattaagagaaacgtccaggaagagctctttgaagccctcaatatttgttggagggactggactcctctccagctccccaccctctgcctccagtcaccatgtgcaagagaggtcctgtacagatctctctgggctctcctttctcctttggaataacttgttcctatttcaggaaagggaaatggtgtcactcaggccctgggactgcttctccagccaggctggggccacaggtcccactctagtgaaggtcaatgtctcagaataaaagctgtatttttacacatagtgtggagtctcattattcttattaaagtctttggtgataggtattatatcttcacatatttggcaaaacattctttttcttcttcttgtttgggtgctcttcctcagttgttgtcatggagactagtggccagaaactagagctaggttcatggtggtcaggaaataaggaagagaaacttatatttacataatgcgttcattatgtgccaggaactggactaagtatcctgtgctcacaaaatctatgtccttgattttatttaatccacacaattctggaaggttggtgct

SEQ ID NO: 6727 - DNA, 1214 bp, Homo sapiens
[281 bp omitted]tggacgccaccatgagaagagagcaagttatggccacagcatggtggtagacccctggggaacagtggtggcccgctgctctgaggggccaggcctctgccttgcccgaatagacctcaactatctgcgacagttgcgccgacacctgcctgtgttccagcaccgcaggcctgacctctatggcaatctgggtcacccactgtcttaagacttgacttctgtgagtttagacctgcccctcccacccccaccctgccactatgagctagtgctcatgtgacttggaggcaggatccaggcacagctcccctcacttggagaaccttgactctcttgatggaacacagatgggctgcttgggaaagaaactttcacctgagcttcacctgaggtcagactgcagtttcagaaaggtggaattttatatagtcattgtttatttcatggaaactgaagttctgctgagggctgagcagcactggcattgaaaaatataataatcataaagtctgtgtctggacatcgcctttgggaactagaaggggagttggtattgtaccagctggactaagctccagttctagacctcctggctcattcaacatgcctccctacctaaataaaagtgcaacactcagtgcatgtcccagccccattctcccaagcatgggagtgggcgtaggagtggaggagggggaaggaaaaaggaattacttcacttacacctatgatgccctttgcccaagccagaagaaagcaaaggggaaaagggctgcagggtacattatttattttcacttgaacatggaaagaaagtgtcacactcccccttcccctttatagggggagtgtattttaatcagcaacctcttctccatccaccctgtgtatgtgtgtacacatataccaccacagttgggaggcatgactagg

SEQ ID NO: 6728 - DNA, 2125 bp, Homo sapiens
ccgtttaagggaacctcctgcattcaggcaaggatttcagagatacatagaaatagtcctggggaagaggtagagaagctgtcaggtgatattccctacttttttattctgttgtgcttttcagttttcaagcttggcttgtaaactcatcccttactgtaacctcttctgctctgtatcttctgtttccaacagacatcagactgcgggttcgggctgaatactgccagcatgagactgctctgcagggcaatgtcttctctaacaagcaggacccacttgagcgccagtttgagcgctttaaccaggccaacaccatcctcaagtcccgggacctgggctccatcatctgtgacatcaagttctctgagctcacctacctcgatgcattctggcgtgactacatcaatggctctttattagaggcacttaaaggtgtcttcatcacagactccctcaagcaagctgtgggccatgaagccatcaagctgctggtaaatgtagacgaggaggactatgagctgggccgacagaaactcctgaggaacttgatgctgcaagcattgccctgacctattccctcttctcactttggggactgttcccatcacccacctctggagcttacactgttctggggtttgttctctacccttccaaccaatcacacccctgcctttttttttttttttttaaagaaaaagacaaaagaaagtggaagtggtattccccacccctccctgcacccatgtgcctgggcttcccctttatttcccttttccatttaccccgtaatgtgtctctacagctaccttaccactgagccgtaagacaaatgtataggaagaagcaaagtctacagcacatagtctttgtaagggattgatgtgaacacttttttttggatgcactaaggagttatcaatacttctggctttatgagagctcttaaattttgtctaaaaaaccaaagggctgtgagtaagggagctatgtggaaagtgggactctgaagtgtattttgaaaattaatcgccaccctcttccaaattatagaattttttaaaaacaagctgtggccctttccactctctcctggcctctggtgctgctcctctctgccgcctttcctccattccatggcttgaaacctctgcctgatgtggctccttcctttttcccatttgtcaaaccctcttcaaaggaggaacagataagactgggtcagcctagtcatgcctcccaactgtggtggtatatgtgtacacacatacacagggtggatggagaagaggttgctgattaaaatacactccccctataaaggggaagggggagtgtgacactttctttccatgttcaagtgaaaataaataatgtaccctgcagcccttttcccctttgctttcttctggcttgggcaaagggcatcataggtgtaagtgaagtaattcctttttccttccccctcctccactcctacgcccactcccatgcttgggagaatggggctgggacatgcactgagtgttgcacttttatttaggtagggaggcatgttgaatgagccaggaggtctagaactggagcttagtccagctggtacaataccaactccccttctagttcccaaaggcgatgtccagacacagactttatgattattatatttttcaatgccagtgctgctcagccctcagcagaacttcagtttccatgaaataaacaatgactatataaaattccacctttctgaaactgcagtctgacctcaggtgaagctcaggtgaaagtttctttcccaagcagcccatctgtgttccatcaagagagtcaaggttctccaagtgaggggagctgtgcctggatcctgcctccaagtcacatgagcactagctcatagtggcagggtgggggtgggaggggcaggtctaaactcacagaagtcaagtcttaagacagtgggtgacccagattgccatagaggtcaggcctgcggtgctggaacacaggcaggtgtcggcgcaactgtcgcagatagttgaggtctattcgggcaaggcagaggcctggcccctcagagcagcgggccaccactgttccccaggggtctaccaccatgctg

SEQ ID NO: 6729 - DNA, 1477 bp, Homo sapiens
ctgaacttaaaagatgtaaggaaaaaaaaaaaaaggaagaactttggaggcagagattttcccagggtctgctggcctagtggggtgccaggccctcctttgctgagcctaagcaaagtacttagctgaacttgttctcaattctgatcactagtagtcttcctatgcccccaagaggctgctgtgctttatggtaaactttgcatgtcaacaccttcttcatgtccctctcataggggtggcaaaatatgcctgacggatcatttcaaacctttgtgggccaggaatgtgcccaaatttggactagctcatctcatggctctgggggtaagttttgtgtatttggcataaaaggagaaagagggacttaggccctgagcagtacaagaaaagcagctaagaataaaaggaataacagtgatgtcccttaagcatgttcccccagaatctgtctccaggaaggagcttctaatggaacaagaagcattgactggtagtaatctcacaggattttccttgtattgcagctgggtccatggctggcagtggaaatccctgatctgattcagaagggcgtcatccaacacaaagagaaatgcaaccaatgaagaatcaagccactgaggcagggcagagggacctttgataggctacgatactattttcctgtgcatcacacttaactcatctaactgcttccccggacaccctccacctctagttgttactaagtagctgcagtaggcattgctggggaagaaacaaacacacaccaaacagtactgctacttagtttctaaggctgcacagggaagggaaagactgggctttggacaatctagaggtaatttatatccgcccccaggtggagcaacatgcgattctggaggcacgggggtaactgaaagtgagtacatatagtctttctggtttctggagataacccatcaataaaagctgcttcctctggtagcctgtggttctcattgggagctgttaacagagggcaagtgggctgaaacctgaggcacatgaacagctacgccgggttgggttgggaaagagtcggaaataggggatgctctggtcaggagtgggaatgaaatgttgactgttccccctgctgctcagatctacctttgtcctttagtggtgagccatgctttgccctaccgtgttagcctgcaagaagtggttttgccggaccagcacttcccgccctccagggatcttcccagccctctgtgaagtgctagatgcttctccactggtctgcgggctggacccaggcctgcagtttgccatacttgcgcccctgctgtttgggaaggatctgtgctgtaagcctcgcggccatactacgactgtcagatctccatccctatgggctataggatggggcgacggcaccctatacctcagggacttgctttggagtcatggattaaagacctctctgggcagcgttgagaaccag

SEQ ID NO: 6730 - DNA, 1176 bp, Homo sapiens
tccccaaccacttgcaggtccatctgccactggtggtggcccccaacccttaaatctggcagttgtatctacttttcccagtgcctactttcctaaaggttattttctaccctctgagccaccttttgcttgcctcttccagacattaacctttgtttgccttccccactcccatcccaacagcctttgcagatgtgattggtgccctctggcaccctgactcctgcgaagctgtgaatcctactcgattccgagctgtcttccagaaatatgttccctccttctctggatacaggtgggagagctggaggctatgggatttctctctggccatgtctgggggtagggccaagcaagggccctggcagcattgttctgagccttgagatgttcttcatccaggaagtggggaccaatatctgggcagggaatagtgtctgtggactaggagaggagtcagttgcccatactctttgtctggctgtagccagcaggatgcccaagagttcctgaagctcctcatggagcggctacaccttgaaatcaaccgccgaggccgccgggctccaccgatacttgccaatggtccagttccctctccaccccgccgaggaggggctctgctagaagaacctgagttaaggtaagggtcgttccctctacctcctttccccgtagtttatcagcatcattcacacttcatagaactaaactagtaaagattgaagatgtagggtccagggaaaccctttagtatagaaaatagtatgagaagcaacatagaagtagaaggaaggaaggaagagggggagtctaagggagcagatggaggcagaagatcatgctagggatgtcaccaaattgaagaaggggataattcatttacaggtagaggaagacagcatattcttcccttatgtacattcctttcttttcctctcacctcggatttccctagaaagttcattgaggcattattcttttgacttttccttgaaatttagggaaggagcaggggtgtggatggggagtagggctctgtaggttgtttcagtgggtgttgggggtgcccagtgttcctgctgtctcatgggtgctccccacttcctttgatctgtggtagtgatgatgaccgagccaacctaatgtggaaacgttacctggagcgagaggaca

SEQ ID NO: 6731 - DNA, 1213 bp, Homo sapiens
ggggtgtcagaaaagccaattgaggttaggagcatattaacctaacactgtttgccatttattcaggtgtgtgaccgatgtcggcagaaaactcgaagtaccaaaaagttgacagtacaaagattccctcgaatcctcgtgctccatatcctaatcttcagattcttacttctcttaggatacctcccatacattctctttcctccatgtttccagagaattgaattttccttaggaaaagtctgccacccacttttccacaagatgctcccagtgtgtcgggagtggggagaggacagctttcaggatagaagaagttcccctcagaggcccactgcctcccaaatgctccttaaccagggcttagatctgaatcgattttctgcctcccgaggctccatcaaaaaaagttcagtaggtgtagactttccactgcagcgactgagcctaggggactttgccagtgacaaagccggtgagtctggtggggaaagtcctaaggagccaaaggagtgggggcacagctctgattatagaacttgatcatctccaaccccgcaggaagtcctgtataccagctgtatgccctttgcaaccactcaggcagcgtccactatggccactacacagccctgtgccggtgccagactggttggcatgtctacaatgactctcggtgagaatagcctcctatttacatcctgccccattcccactcagccctgacaccctccccttctatgaagctccaggagagcagagtgccaggtgaaaggagaggtggaggtcttgcctgatcatttcctggatgctctgaggttcggtcttgtagggagaagggagtaaacaggaatgaccacaaccctttcccgatctccttttttcctagtgtctcccctgtcagtgaaaaccaggtggcatccagcgagggctacgtgctgttctaccaactgatgcaggagccaccccggtgcctgtgacacctctaagctctggcacctgtgaagccctttaaacacccttaagccccaggctccccgtttacctcagagacgtctatttttgtgtctttttaatcggggaggggggagggggtggttgtagctccattattttttttattaaaaaatacccttccacctggaggctcccttgtctcccagccccatgtacaaagctcaccaagcccctgcccatgtacagcccccagacc

SEQ ID NO: 6732 - DNA, 1290 bp, Homo sapiens
ggaaggactgcctgggaattgttactggatcctcagggttctgtacccctagccaggaaaatcctaaaggtccctagatttctggctgttcctttctgggtcttagtctccaacctctaaccctcagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgcatctgctcctgctttctgcatcccaggcacactttgcctctttgctgccccgcattcttatgcctataggtgatagaacagccagaccaagccaagctccagcaatttttattttcatgaatgagagttggggatcagctgttaggttctgtgcccaggacactgactgctgcctggcgcccactctctatacagtcattaacagcaactccctcataggaggctccagccagagtcaggggcaacctgtgagcagtcaggaattgcctagctgactctggaaggaaaggatgaaaggaatgttttagctgggggtctgatgtccttggccctcctcagcccagctgttttcccaacttacctagtttttgccagtgacctagt

SEQ ID NO: 6733 - DNA, 1198 bp, Homo sapiens
gagaagccagacccctgggcacctctcccaagcccaaggactaagttttctccatttcctttaacggtcctcagcccttctgaaaactttgcctctgaccttggcaggagtccaagcccccaggctacagagaggagctttccaaagctagggtgtggaggacttggtgccctagacggcctcagtccctcccagctgcagtaccagtgccatgtcccagacaggctcgcatcccgggaggggcttggcagggcgctggctgtggggagcccaaccctgcctcctgctccccattgtgccgctctcctggctggtgtggctgcttctgctactgctggcctctctcctgccctcagcccggctggccagccccctcccccgggaggaggagatcgtgtttccagagaagctcaacggcagcgtcctgcctggctcgggcgcccctgccaggctgttgtgccgcttgcaggcctttggggagacgctgctactagagctggagcaggactccggtgtgcaggtcgaggggctgacagtgcagtacctgggccaggcgcctgagctgctgggtggagcagagcctggcacctacctgactggcaccatcaatggagatccggagtcggtggcatctctgcactgggatgggggagccctgttaggcgtgttacaatatcggggggctgaactccacctccagcccctggagggaggcacccctaactctgctgggggacctggggctcacatcctacgccggaagagtcctgccagcggtcaaggtcccatgtgcaacgtcaaggctcctcttggaagccccagccccagaccccgaagagccaaggtaggcatctctggagtctgtgtcctgcggtgtcctcccgccatgtctgtcctactgacccctattcaccctctctccacccacttacacttctggccgttctgcttccctcccttctgcctgcctttcctttctccatgagcctcctttcttggtaaggctcaggcctctccccttcacccttctcctagccagacccaccgagggttctcagaggtgggtcacagactctgggctgggaataactgctccctctccccaccccaccccttcctggccatggcatctcctactgacacagtccccagcagtaaaggtctcctaacagccccttggccttggctcttttctctg

SEQ ID NO: 6734 - DNA, 1262 bp, Homo sapiens
tttgttggcagagaaaaatactcttcatgttaatacagacacccaaccttcttccttgaacagggagagtttggggtgtacctggtgtctgatggcagcagccgcccttatcgatgcaagatcaaggctcctggttttgcccatctggtaagaatcaatcccagtaactataactccaatgaattaaacctgaccttggttgaggtttttatgaactcttctttctcctcccaccttgcaagtcttaactaacattgttgccatctcaatctccctaggctggtttggacaagatgtctaagggacacatgttggcagatgtcgttgccatcataggtacgaggcctattgtgtagtagaggtatcctagacaaaggagttcgggacgcccactggggacagaaggagaacacttcctgttcaccataggccatggcatggactcgggtcctcaatcttttgagcacagtaatgggttctggatcttgggtaacaccactttttttgtttgttttgcctcacaacaggaagataagtaacatcacttttttcctccatcctctcacctaggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtatgttcatgtacacttggctgtcaggctttctgtgcatgtactaaaaaaggagaaattataataaattagccgtcttgcggcccctaggcctaaacttctggtatcttagtgtctcagtatcttagtgtccttcactcggactgtaaacctaagaatgttcattaaccctccattcctgttagattcagtcaggtcttagcaatttttcctgctcgtctccacccccttctctgactcttgtcctttccacttctctattccccatttcctctttcgcctcagttccctccttgcccaaaccttctcagtgcccacataacttggtaaaccactcaaatcaagacctggggtaaagttgggagggaaagggctatagtggggtctgagggaatgttgacgggcagtttcacacagataaatctctgaaccagccgggcgcagtgcctcacgcctgtaatcccagcactttgggaggccgaggcggatggatcacctgagatcaggagttcaagaccagcctgatcaacatggagaaaccccatctct

SEQ ID NO: 6735 - DNA, 1243 bp, Homo sapiens
ggatgttgaaaggaggaataacatactaaaacatatggcacatttagtttatgatgagatcccaagtagtctgtctcccatcataaacttgaacatgagtttaaatcttctccttttcaaggccgggtgcagtggctcacacctgtaatctcagcactttgggaggcaaaggtgggcagatcacttgaggtcaggagttcgagaccagcctggccaacttggtgaaaccctgtctctactaaaaatacaaaaattagctgggcgttgtggtgggcacctgtcatccccactactcaggaggctgaagcaggagactcgcttgaacttgggaggtggaggttgcagtgagccaagattgcaccactatactccagcctgggtgacagaatgagactctgtctcaagaaaaaaagaaaacaaaaatcttctccatttcaaaatggtttagaattgtatgaggtgccaggggtcccagttttatgtatcatattagttgtaacttatgagcagctgtgacaagctacttggttttctcctcaggggtctctctttttggcatgtcggccctgttactccctgggaactttgagtcttatttggaacttgtgaagtccctgtgtctggggccagcactgatccacacagctaagtttgcacttgtcttccctctcatgtatcatacctggaatgggatccgacacttggtaagttaattcgggatttgcacattttctctgtgaagggagtggggagactgggaggattctttccttcattactgggtttagtgctgttcttttttttttttcccaagagtggagtctcgctctattgcccaggctggagtgcagtggtgcgatctcagctcactgcaacttctgcctcctgggttcaagagattcctgtgcctcagcctcttaagtagttggcgttatagacgcatgccaccactcctggtttttgtatttttagtagagatggggtttcaccatgttggccaggctggtctcaaactcctggccttaagtgatccgcctgcctaagcttcccaaagtgctaggattataggcgtgagccaccgcgcccagctagtgctgttcttaaggttagttgtgactcagagtcctcttggggaaagccagacaagttcacaagttcccctgtgtgttacctggcagtcctgctggtggtgtagctgagcaatggtataggcctcacagatacttgcagggtctcattggga

SEQ ID NO: 6736 - DNA, 1777 bp, Homo sapiens
ttagaaagtcttgcagttaaatgtttatgaactttgtatgaccacagaacttttttttttttggcccatacaatggctttcaacattctgagagcaagtgtttggaagaatacaccttgagaaacattaatctagatgtgtggtcctgaggaaaagttgtatctattcattctggaagcttttgtataccgtatggggcctgtggcattctagagaacattcctcctaccatcaccacacaatagaacctgattttctgtcattggaataagtggataataggttccatactgtgggttttgagaagggtaaaggtggggcataagggtagaagcgcttttctctagaatcatgctgagaggagatatctattcctttaggtagaattactttctgagacaggaactgttaatgtcctatttactgaaattccttttttttttttttgctttgtccacagatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagttttccccttgtttctaaagatgaggtggctgcaaaaactccccttttttgcccacagcttgcctactctcggcctagaagcagttattctctctccatattgggctttgatttgtgctgagggtcagcttttggctccttcttcctgagacagtggaaacaatgccagctctgtggcttctgccctggggatgggccgggttggggggtgggttggtgaggctttgggtgccactgcctgtgggttgctggcttaaaggacaattctcttcattggtgagagcccaggccattaacacctacacagtgttattgaaagaagagaggtgggggtggaggggaattagtctgtcccagctagagggagataaagagggctagttagttcttggagcagctgcttttgaggagaaaatatatagctttggacacgaggaagatctagaaaattatcattgaacatattaatggttatttctttttcttggatttccagaaaagcctcttaattttatgctttctcatcgaagtaatgtaccctttttttctgaaactgaattaaatactcattttatctttgactctccttgaaatctagagaaaccaagaaaatggctgttgggaaggaaccaatttcctcctcttccctcgggtctcaggcatttacatcctccctctccccgcaatctgacctttaccaggagggaaacagttctcctacatctcatcattggaaaagttttcagggaatcagatagaacttagccagagatttaaatatcacagaaaagcctcagagaaggaaggagaaaaagaaaagaagtgacgcatgtagagtgcttttgggttataggcaccaaaatcccattaaggactgattataagcttcatggtacagttcagcaaattatgattcattgaggggcacagaggaccagtgttggtgacagctaggggatgatgacctgaggttataggcttggggtgaatgaagcatagagtttttttttaaaaaagaagggattgttgaaa

SEQ ID NO: 6737 - DNA, 1500 bp, Homo sapiens
tctgtggcattattaaccctggcagttgctttagccgttgtttagtcaatggaggttgtttgggagctagaattgggagagaacaggtgatcctggcacccagcccacttgtagctctgcttactgactgagagtccctctgcaccccttgaaagtttactgacagttcacacccttaaagcacatttctgtatttctggggctgaagcttatggcagagatgcacattctgttgaatatttattctttgtgtatattcctgtctgcagagaatgtgatcaatgggcaggactacgaagtgatgatgcagattgactgtcaggtgatggacaccaggatcctccatatcaaaagttcgtcagttcctccttacctccgagatcagcagaggaatcaaaccaacaccttctttggctcccctcccgcagccacagaggcaacccacgttgtcagcaccatccctgagtcattacaatagcaccctgcagctatgctggaaaactgagcgtgggaccctgccagactgaagagcaggtgagcaaaatgctgctttctgccttggtggcaggcagagaactgtctcgtactagaattcaaggaggaaagaagaagaaataaaagaagctgctccatttttcatcatctacccatctatttggaaagcactggaattcagatgcaagagaacaatgtttcttcagtggcaaatgtagccctgcatcctccagtgttacctggtgtagatttttttttctgtacctttctaaacctctcttccctctgtgatggttttgtgtttaaacagtcatcttcttttaaataatatccacctctcctttttgccatttcacttattgattcataaagtgaattttatttaaagctatgccacacatgcatgttcaaatggtttccactgattcgatttttcattcatttaatgcaaacccattctggatattgtgcttatttgagaaaacacatttcaaaaccagaaaagccaaaaacactccaaaaacaagcaaaacaatttggagctttagataaaaggaaaaactcccagttggtaaagtttatctttacttaggatttgtggctcacacctaaacaaagggggtcagggagtgggtacaaatttgagaaaatagaagggtaagggaagggccagtggtggggtttggagagaggagatagctccattaatacacatgtttaaaagatggaaagttcacgcctgtaatcccagcactttgggaggccgaggcgggtggatcacgaggtcaggagatcaagaccatcccggctaaaacggtgaaaccccgtctctactaaaaatacaaaaaattagccgggcgtagtgacgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaa

SEQ ID NO: 6738 - DNA, 2356 bp, Homo sapiens
gactgcagtatgagattaaagccacaactattgtttattttggggactctaggccaccaagtattagcacacatacttatgttttctctactaatctggtccaggtcctcatggaccacaggacaaagctttcattttcattcattcttctattgaaattataccaaattcagctgaggaatatggaagtaactttagacttaaacaagacaaaagttttttcactgaagaattgacaagtatttgctccttaaaacaacgcagattagtgaacgtggattcctgctgagggagtgcatcccataatatggcaataattttcagtttctccaacgaaaagatagtgaaggaattaaatcttttgtcctcccatggttaaaaaaaaaaaaaaagctgtgttcatttttactgtactatgcctcttttttcaccatagtagacaattatgtttcatttgatgaattcatagaactggatctcatacagcgatgtcctctctaatgttctacctttcagtttctaaagtgagtcttcctccctctcctacaaaacttttcaattttttgatgtaactcatctacaaatactgtttcttaccccagttgacttgcctttgtcagatttcttcttgttccacactatagcaatcaatttctcttcttccttacaagaaagggaacgagaaattgtagcaacctctcaaggattatatgcagctagttagttttctgcctgtgaaattaggtctggctcctaaataattttaaagaaccatcagcacttctaactctctggacaggtgcctctttgtccaagctagttaaatgctttccaaggaaatcagttcaacttttgtgagcggggaaaagcagggctttattgttgtgttacctgggagtctggagtttgaaaagtgctaattaaccttcctctttttccacattacaaacctttttaagcagcgcagcactccccttagatttggctatcctgggtgattttcagacaagaaccattttctctggggaccattcttctgctgggtgccaaggaatataaggcaaatgcccagaagaccttcaggtgactgggcagtcttatcatgggatatttcttctggccctgccccttcccattctgtaatgtgaattagccacaccagaggctgtgaccatggctagtagacagtggcaacatagtcatccccaagatgctaatcttctgctggaactgtcatacgttatcatggtcaatgtaaacctggtttgtgtggggtgattataaatagagtttccctcctctctgtgacagaatcacaggagaaggacccatctcgtggccttcttgttcttagcgcttcacttttacttcatccctcgattcccagctttttctatcatcattttgccaactcctcagatgcaagactttggttatgtcatactcaccaacgttagtccctctcttccaggtgaaaaggtgggtagcggttgggagggagtctccactgaagagcaggaaggtggtagcagggccggcagctctgccacagagctaggggtgcctgtaaggtgccgcctagagcagcctgggagctttgccttcttttgtctctcactagcccttctactctttgtcattgcctgttcttgagtggatctttgaaatgaggggacaggattctcctaagggtagagtttcaggaaatgagtgaaaggcaattgacaaatgcaaagaagtagtcactttttaaattgctggcaaagctataattaatccctaggcacaattgtagtttttattttaatgtttgtatgcacaaggccctttaggaaatgagaagttgccatgccagattaatttttttttttttttttggtgggattgccttttgggggttgcagccagaaattgtgggtaatgtgtgtatttttttatttattaaattttaaacaggattgtgcaagcttatgagacaattagataaactcatggaggaggcaggtcctcctgttattagatgattttgtgctcttggggctgacaataatacactcttgggaagtgatggtagagactgatgggaatagtctttctgcctggttgcaagtcccaaatttttaagggttaatggaagtaagtggatgtttcctcatgttaactactgaatcagatgttaggagcttgtccctttggggttgacttatgcccagcagtacagggacacagcttcattagagtgttagtgtaaactaactccaaagttaggagttaatgtgaaaggatcatccttgaaacaaatctgctgtttgccatgcttgtagtacagaaacttcacatggagttttgggtggga

SEQ ID NO: 6739 - DNA, 1232 bp, Homo sapiens
tgaaaacgattcttcttttagaggtggtaaaaccaaggcacagggaagttgagtaacctgccctgagttacacagctaggaagccggctagctggctttcaaatgcaggctgtggggttttataatctgtgttcttatttgtcatgctgtgctagataaacaacaattctacagccattgccagtctgttctctggtactgctaaagacagaggaaggaaaaagctagttcttgcctgcagatgcatccagtctgttgggaagacggacctggaaaccagcatttggggtaaatgctgcagcgattatgcaaaaacaattcagtgagaatgtaaagaaacattatgtgaagcttcttgagaaagtccaagcaggcttcacagaggctgtgatccttgaactcagatccagaagggtggatgagtggggagggaaatcctggacctagaggtgagagagcacagggagggctggagagagatggacttgacagtggatttctcaggcaataagatcatgaaggcgctgacttgcctgctaaaaagctttgacctcatcctgctggtagtagtgacctattggtagatttttagcagagaataaatatggtgaggtttgcagattactaagctctctctagaggtgatgcagaggatggattgggaggagaaaaggccggacaccatttattagtgctggctgctggcaagaatgtaggggcctaaactggagccatgacagtgggaatggagagcctggatctgagaggtgaggaccagcattatgcaggtgttcattatctggatttctgaatgatatgttacctaggaaagcaacagtgatcataacatccaaatattcaccaatgaagccatcacttacagaaacaatccctgtggcaaatgcacccggtgacctccaatgtgccaggcccttgtgtagcctcctccatgatgtgttattttatttttatttatttattttatttatttattttttgagacagagtgtcgctctgtcgcccaggctggagtgcagtggcgctatctctgctgactgcaagctccgcctcccgggttcacgccgttcttctgcctcagccttctgagtagctgggaccacaggcgcccgccaccacggccagctaattttttgtatttttagtagaggcgcgctttcaccgtgttagccaggatggtctcgatctcctgaccttgtgatccgcctgcctca

SEQ ID NO: 6740 - DNA, 6958 bp, Homo sapiens
atccacctgccttggcctcccaaagtgctcagattacaggagtgagcccctgcacccagccaaattgtacttcctaataggtgcaatttccagcagcttttgaccaatattttttcctttttcactgctaaaagtacagattatcatccaggtaccattgaaatgcagttgctgtctgagctattcagccgtatctttggcagatgtctagtgttattcatcactcctgtaacgaccttagcaaaagattgtacatgattcacacaacttgtccttgagagatttttcaaagttgagctgagttgtgaggaagtattctaaaccttgctgtcctgaagtatagttcatagaccagcagcattggcatcacctggaagtttgtttagaacagaaactcaggcgacatctcagacctaaggaagcaaaatctgcattttaataacatctccagttgatgtatatatattaaaggtggtaaagcactggtctaaaacaatcttggtggaaatgaaatgtttttttctctgtcttctttcaggtctttgttgagtatgcaaatgctggtgattccaaagctgcgcagaaattactgactggaaggatgtttgatgggaagtttgttgtggctacattctacccgctgagtgcctacaagaggggatatctgtatcaaaccttgctttaatcagtaacctaaggactgtttcctttttctcctcttccatttcttgggttattccacatatgaatgcaggactacccccttaccattttaagaaggtactttatacatttatttaatcctactaatgtgcagccattgcccaagcagtgactgcgttgcatacatttggcactgagtaggacaagacctctcagctatacattgaggggttttagagcatccatgtgggcaacccttttttgtgcgggagagcaggtgttgctcttcagtatgtagcctaaaaaaatcttaattatttcatggatcatgaagcaaggatgaataatatcatgtcttggtaaatactaacaaatttgttaggtttggtgacatcatttacagattatttctttatgttgtccagtggttcttccttattgttgatatccataagctggcactggatgctctcagtaatgttaagtaattgtcaagcagcagttacctactgtgttcttaacactgagttgtgaattttttcttaaagcagtactgtagtactgaatattcctttaaaggaactgcagtgagcctatctaagtttttttaaattaaggcttttaaaatagaaagctgatgcttgatcttgcacaatttttatgtctagtatgtatgcttgagtgaatgtgcgagtatgaatgattagagaaaatttgagtcagtgtactttatagtgtgaatcctgtgagctaatacagtctatacttatttcttccctacctgtttcacatccgtaagatttaagatatacattttttgagaggtagtctgtctgatacaatgtaaatgacaaaacataattcctgagaggcccagaacaaactggagtctagcctggagttaaattgagacttctaaaatgattggaacaaagactaagttgtgccagatgtaaatcaacccctcttttagtttactttagactttgtattagctcatcttttttgtagtaaatctatagttttaaggtttctcaagatgtggctctacctactatgatgaaaattgaagtgggtcaaaagaattagatgtacagtgaagggaaaagaaaaaaaatgggcgaagagagggtggaaaataaaaggattcttttttcttcctttctgtttctcgtatccctgctccctttttcctccccttccctcattctttgcctctatccttagctgaagacaaactagaggagcagcatcccaggtagtttggcttttgactgcaaggtagttaagaaaggtgtagatataatgaggtagaagtagaaaggaagaaaaactcaaagaattcttaaaaggattcatagcaacataatgtgtccctgagtagaggatgctgctatgcgtgagttcatggacacaagttgattacatggtttttagaattataattatggattcttcttatttcatggtaggttgtctttaaagatataaaaattaggatgcctttatgaagcactgattataccaaaaaaaaaagacaagttatatacaggttattaatttttttatttatttattttttcctaaggaaaaagtcttctatctttccctgctggaagcctcctcatatttccttatgtttgccatgcaggttgctgagagtccagttagaatttgcattttacagaatgaaatactttaccccattcaaacaattattgtttgacattttagttatttataattgtcaaattcaggactctcctttaatgtttattatgaaaccaaatttggcataaggaggctgatttatgaattaccaaagggtcttgtggcatgttccccaatacatgcccttagaaggaagaactattattttttattttggccctttcaggagttgattataaattggtttgttttcaagtcagaattcaagtgggcagaacccgtattgtgaagacctaaactttcctaaatgttcatatgggtagcagattttgtggtgattagaaacatcaggtccttaaatacgatgaacatgggatacaaaggaattctttataagggcaagtatcctaagttagcacatttacttttctctcccctccgcccccaaaagaaaaatccttacaaataaactgcaggtaggcttctaagcctagtcctgcagtatgctgctaacatcttgatgccaatcttcacagcattctttgattgtcatcttattgctgatacattcatacatatatttagtgcttgacactgtagaattttgttacagaagatggttactagattttaagggagctgagggaataattgatgagccttgaattaaccatgcatttaattagattttttgttgttgttgttgttgttttgagatgatgtcttgctctgttgcccaggctggagtgcagtggctcaatctcggctcactgcaacctctgcctcgcaggtttgagcgattctcctgtctcagcctccccagtagctgggtttacaggcgcttgccaccacacctggctagatgttttatattaaagccagagaattgaaaaagaaatgcctcctgtgattgaaattattttatagctcttagcccgttctaccaaagatcacattagcagattacccctccctcctgtgatattatctttcttaaacctgaaccaaatatcaaaagatacaagtttcatgattaggatgaaatatatacatagggattttggtttattgaagttattgaaagacctagaaattttctttttgagagaaagggtaaagaggtgagggttcatgtcacttaacccctacccttttgggcaaattttgtctcaggtagtgtttcattccctaaattaatacctgtgcttccttgcctctcaccttcccagttacttctttggggtattactgtggcacattgtacacccagaaaaggcacatacagtgattattttgtgggaaatacttgattcttttgaaatatatttggagggggtagctagctagccactgtcaaaactaatgctgtatttacaggacaaaaacaagtagagttggacacctcagtaagagacagcattaactaaaagtactgactgccttttaaaggaatttttaaaactattctcttgcaataagagatccgcatttattaccactggatgtcttccttttttgtggccaccaatatagcagctctctttagagggattccctttctgctatgccttgagccaaactggctgcttttagaacaaaaaccataagtatggttttactcgaacttctctttgtttttattgagagaaatattgccttctttttggtactccagctgctaaagagtgctgagatatgttaaattattttttaaaagaaaatctccaaatacttatttaacttgtcttctagattcatgttgcttatattttaactattgagcaagtttattataaggaatgctgccatatagagaaagctgaagagaaaccatgggcagaaggcttttttctgtcttattacactggaccttcactctggtaagggcatcagttacttttctggaataaaaggcggagttagagcacttatcagatgctgtttcatggcttgttttagttaatttatcatgcagataactaacatttgggtatctttttgttttaggtcttattttctgactgttaggcctatcttacacataagttctactatcagtatacttggcagcatgacttttttttttttttacagttaatttaatgaaaatcagcaccattgtaaatgatagtaattgtaacaacatagttactgggtgaaggagtaggggagacactcagtaaccatctatttacctagacacttatgcaggggtacatgctaggtggctttattcagattcgggtacattggaatcacatcatgactttgagtctgatggctgtgtagataaagatttaagcaagtgccttgtgtttgctggaaaatattaaaactcatttgggtgaaagcttcccagatgatgataattaatagcacttctgcctttttcctggagtaacttttagattgagtcacatatgatagtataaaagtccaaaattttctgggtttacctttgttttatttttcatatatatattcactgtctgcctggaaatagccttggtttaccttatttttttgtatatgtaaaactattcatatttgattttattccaatattatatatgatggaaaagccagaattgtctggcagaatttaattcttccttggatctctagttctgtttttaatatcaggttccttcatcaaattttactactgtagctctgtgatataatttcatttcttgtcaattatggtcacatatagacaagtacttggtcacaattagctcaaaagaatccccatttcttaaggtgctcagtcaatcacctttattttgagatggtagtttttcaagttagtattacttactagctttcttgatgaatataaaaatgttgtctccatcatacagagctgagcctcttgtggtatattaagataagtcccattcttaatcacagaagaacatggatattttagtttttggagtacccagaattgtaaagattttgtttcattttgttttaggatagcttctctgcctaatactataggatatgtcatgttcgttattgtagccacctccctcagatgtttttcactatttttaaattatataatgaccagtagattcacagtagcatgtacttgacaagtgccatggatatttaagaagaaggtaaataattttaatattttttgctgtaattttataggagcagtggactgtaagagaaatatctataaatcagagagtatttaggaaactttgtattttataggtggtcattaaagtgatcttcaggatataagatagtttacacaaactttattctcctgataggaaatttttattcattttcctaccactcagcacttttgttctgccttgtactgcttatgaggattaatgttttaaatttgctttatttgtgcttttcagagagttgtcataattgtggcagttgtgtttgtggcactgtaaatgctgaaattcatgggaaacttaccaaatgactgcttgagtgttatttcccattaaattgggtagctgtcacaataaccagaagaaatcttgtggcccttttgaagaaagccatgtatgttttgttacctaggttcatagtattttaatttaaaggcaaagagaagcattctacttatttgtcttataaaccattaatcgttttttgtgcagaagagagcttattttgttatactgctttgtataatggaaataagtcacattctgggggaaaaaaactggaattgtttgtattttgtttttttggggggggatctttatgtgaaaaatcagagctacttgttaccataagcccttactatcaacaagataattatttgtaatcacttttttatcccaggttggaattgctttccccttctaagttatcttcccttaataatatttatgataccaggacagtgagggtataagagcaaatgtagtgaggtattcaaaaatcctgcatatatggactcaaaagttctttagttatttgaattatatatagctatattattttattagcttgggttgtcagaagattgccaattttaagagtaaagaggagagagataagtaataaaaatagaggaggggaagaaaatggctcccttactggtcttagtaatcttctatatagttaatgagctaaaaaatgatacttaaagttccaggtttggtaccgctagcatagaaacattgcctttcctacacattcctcatcattgtttcctcagaaaattattttaagagtttgtgaaaccagattaaatatctatattcagtttggcctaatttttaaaaataaatatttatactccagcttttgtgtatttggtgtacatcaccacttatgcaaatcaaggatcagaaaactggaggttagccatctccattatttccttttgcacattgggtacagtgggtggcattagtatgcactagctgcaaagtcacagcaccttatggaaataagtatgtttattataataaaaaaaagttaagctgcatctctgtagattatttactttgcagactgtaaagctgccctatcttttccagcagaatttactcttccattcttaattcttttttgaaatatcttaaataatttaacattcctttataacttcttaacagtgtca

SEQ ID NO: 6741 - DNA, 1215 bp, Homo sapiens
acagagccactgtcaagaaggaatctgctcagagcagattctgagttttcacactccacaaatcctcagatttagtgggaagctggaaaaaggaactcttaattccaattgaggagaaacaagaaaacattacaaatcagtttcccaagctgagaaggattagccttgaccccttgggtctgcctctgttgccctcaccagtttaccttctacaacagtttctcaggaacatgtgtatttccccattcagctttcagcattgctccacgccacagcataagcatagatcccaagtccacaggctccattttgcaggtcatcttctgatcctagcaaatgtcctttccccatagttgtcctatgcctttgggctttagtctatcccaggactaactgtggagaaatcattggtttgagagtcaagagagcattggtttgggagctttaatcctctttctgcttcacactaagtgtgtcatcttggctaaatcacttggtctttctgcattttgttttcttatttataggatgaggaaattagattaaatggttttgaggtcctttcttgttctgatatgtccagtactcactggaaaattggatctataactgatgggtttagtaatctggtcatttcttgctctgaaaattgtagtcagcaaaagagatcatggaagaaatcactgtaatggtagtaatagtaacacatgccatttgtattgtgccttaggtttaccaggtgtttccaaatacattagcatatttgatatgtgcaggactagataccttgggacctgccacactccactttcaagatatgtattagcttcattagaattaaagggacttgaactcaggacctgcagcctattcttctttatccacatgtctctggtagggctacatccagatcacaccatgacttcttatagagcaagagaaaataatattattatatcttcctttgcctaaaatctctccacttattcttttttatgattctgcaccagttcactgggttattctatgattccatattttttttaaaaaaaatcatatttaaaatgaacttacaatgtctgaattttcctggccttgagtcacagaagtaatatgtttcagatggctgcccaatatgtattatcatgtaatacatatctgtgtccttttctgggatgaggaaggcttcaacttctggcactgagaactttgtat

SEQ ID NO: 6742 - DNA, 1267 bp, Homo sapiens
aaacatcaaaacaatacgcataagttagacaagattaaatcttgtctgatatctgcacaaacagatatgcaccatgttggaaacatgtgttttcctagtcccatccaggcttcccacaagaaagccatgatgtgggtctaaaccatatgttttgagtaaaggagaatagaagaaggggagtgtccgcaaaatggaaagagatgaagatgttccaaggaagtatgctgaaacagaacagtgaatgttttgcccaaaactacaaaaataaaagaaaaaaagaaaattgcaatacatggctactaagtctttgatcataagtcgaatttatagacctggaatttgccatcctagtctttcctttttagtaagacttctgtcctctggcagtgcatatggtaggtctctaatgtttcttcatctccaggaagatgcagatccttatttttgctgggaaatccttctaaatagaaatgtaacatttttataaaaacagattaatgtgtttttcacttagtaaatgttttcaagagctgaattgagaaggaaagagactggagtggttaatggtgatttgatttctggcattctgagttttctgctacaattagctgcattacttggtgccaaagagcagtggggaattgttgagttgctgtatcctttaaaaaaaaacaaaaaacttgttattttgaaagaacttaaggctcacaagatgttacaaaaatagtagagtggccttaccctagatccagttttccccatttataacatttcacttagtccattttcggaaccagaaaattaacattggcataatgctattaactaaactacagaccttttttcaatttcgccagtttttccacacatattcatttagttgctggatacttttaattcttgctgatttgtaaactggccttgcttggatacaacaggaaagatactatctggataaagttctacagttttagagagactattaacacattaatgtgttcctttgtcatgagcaataccctgcctacactgcttctaaattttctgatttgtttggctgtttggcatctgaaacaatccaagacaaacttagaaagattaggcaacacaaaacacagtaagacctgttcatagcttgttgtctagaaaaccaggtagcaggatattctagatgcttcctgctgcttctacgtgagtaggattagcactggggacaaaataaggagtttagagtaaaccagtatttcagtcaagagttagttggcac

SEQ ID NO: 6743 - DNA, 1231 bp, Homo sapiens
ttcatagccaaccctaccagttataaagatggcagctctatcacttgattaagtgggaggtggtcaaatattttggtgcctcattttcttcatctgtgagatgggaactgttatgcctggcttactaagagtcttgtgagagactgagaagttgattttgttcatatccaatctgtaaatgcgaagtcaggggaagtaatgtccctgaaataaacgggttcatgccatctagggacaataaatggttttcttgttgtaacttctggttaatatcagtaccttgatgtcatcaccgtgatgacaaagagaagagttattgttgatcttcttggttttggtctgtctcttttcttaggataaagaaaaacttccaaactagaaaaacaggccctggttcccttagtttgcacttgaacccaatatgttgccttgtacatacttggtccctgtcacattgactgcttgggaggcttccagggagaagtatgagaccctgaggggtgagaatgggcagctagcaagaacatggaaattctgcttggcactacagtcataaatagaaaacactgtgtgtgctcaggggagcaggggatgccactgaagaaactcaagggaatgtgtatttgaaggaaatgcaaaaactaagtatttagcaaaatgaaattatgccttgatgactaaaaggcactagaaaggttgtgtctactaacttcagccctaatcagaacagatgcctagaaggagcatttttgtgacaacttcatagtgattagaatcagtggagaactccatcttagtggcaggaatataatgaaactacccacgcaagaacatggttgaatcacatttgcttgacttagggcaaagtacgaaagagagacaaaagggttctcttggaaacaagaagagtgactccagatgtggcctgaataattgccatgttaagttaatgcaaaagatcagaacagggctacatttgcacaggcagtttctctccgggccgtagttttcactgatgatcacctttcacagcattttccccaaccagcatttcacttagtcttctctatacccagcacctcccccggcacccccggcaagcccactatcacttccgacttccaacgtggcatccgtgagatctgtccacattaggcgaagcaggagaacactgagagcagcaggatgggtttggaaagagcatgcctctggaaacacagcttcctgggaa

SEQ ID NO: 6744 - DNA, 1215 bp, Homo sapiens
cagccaccgcgtggcccgcgcgcctccgctcccggccgcgctccagcgccgagtgcgccccgcgcggcctgggggcgctgcggcgggggcaggcgaagactcgggccttgggggttccgggggtacgcggccacgatcgcagggcgggagtgctcctccggcttttctccccccgcgttaataactcgtggccggggtcctatgggggaagggcagggaagcggatgcttattgttttgcaactccagtgtcgggggagagggctttccgcaggatcccccactaacccccgatggactccctcaagccccggtctggcacagacgtgctcgccccgcggcgcagcctggtgccgagggcggagcgagccgggaagcgcggccgagagggcgagggtggcgggaacgcgcgaggcggcatcccggggaaggggagcccagtgtggggctgcacgcaagggctggggattacaggggtttccgggtaaaagtctgagagccaaataggtgccgtgacatcaatgaaacgataatagtaggggcttctgttttttaaggttataagaggaaacgtggtcggcttcaatgagaaagttgtactggctccaagctcttcggtgtccaggacgtacgcgtcttggatccacggaagggggtcatcgtatgggtgtctgaccctcttaggagcctgtttcctttgttttatccgcaaggcaaggagagacaagggaaatgacttcctagctttacccggggttttttctgcaggtggagaagggtggagtcctcccagatggttctttctttgctcccctaacagcctttaagatgtggctacttgtttttcccaccgtttaacaccctccaacttcatttggagcacgggttcctcaagggatcctgagagctgggtgctgggtgctggtttggagaggcaggatgatgcttctcccggctggggagagcagagcaggaaggctggttggcgccatgaggaaagagccacgaggttttagctcccgaaccgactcgtcagtagcccctcctccatgttggttttacatttttccctcctggtctggactactttagcgcaaggagcccagccagacacggcggctggcgctgctggacttctttattgatgaagttgatctcgtccgtagctcccggggttaggaatcggcctgctttaggtcctgaagtttctgttctg

SEQ ID NO: 6745 - DNA, 1052 bp, Homo sapiens
agactcccacactcacccctgcacccatgcctgcacccgtaacgctctgctggtctctgccccacagtggccatcaacctcatcgtgcagcacatccaggacatcctgaatggagggccctccaaacggcagaccaatggctgtctcaacggctacaccccttcacgcaagaggcaggcatcggagtccagcagcaggccgcattgacccgtctccatcggaccccagcccctatctccaagagacagaggaggggtcaggaggcactgctcatctgtacatactgtttcctatgacattactgtatttaagaaaacaccatggagatgaaatgcctttgattttttttttctttttgtactttggaacgacaaaatgaaacagaacttgaccctgagcttaaataacaaaactgtgccaactactactggtgatgcctaattatgaatccaacgtgtaaccagttataaatacatatatatataaaaaaggatctatttttgtgtaaatgtacaaatactgtaaagctgtttgccataagtattttgcaggagggtctgtacttgagtgttttaggactggagctggaatttcaccaaggggaaattgcctgttgtgtcccagggtggggaggctcgggcatctgtgagagacagggagggtggctaaggtccagttgcttttgagtgccccgtggaacttgatgggaatggggttggaaaaccttgattgcctcctctgtcacatgccactcttggagctggagcttagtgatatgtcaatgagagatactcttgtcttttttttttttcttttcttttttttttttgagttgaaattaggtaaaatctcaactcaaaaatcaaactcagggaagaggcccactgaggagaacaagtcttctgcattttcttcctgccctgctcccaccttctcgcctctggctgcttggatagcttggtgactccttcctcaccctcctgcttctctgtctctccaagaagccagagctgcctctttccttccctggaagagattttatgggatcgctt

SEQ ID NO: 6746 - DNA, 1052 bp, Homo sapiens; identical to SEQ ID NO: 6745

SEQ ID NO: 6747 - DNA, 2889 bp, Homo sapiens
tgggtggaggggagcccaagtgagcctgaaggagttctgattatagagtcccgagcctcagtttctgactgcagaagagccagagatgttcatttcattgttgaccaccctagtgcttggtggactgtgcccttagctatcccactgtggctgccattgccagaaacattttggagaaccttttcttcccattgctctcagagcctgttcgagccattcaggtaaattggtctccattattacctggtcacaccagattttcccccagactcagcaccatccagtctgattccccgtttctgggctcagtttgactctaaatctgttttgctattttaaaaagtcaaacctggtccccagcagagcttgccacccggagactttcaggagaccgtgcaggctctgaagggagctcccagtcacagcagccgcctacttggagcaagggaaggctcccaagatgcctcctttgaaagccggtgctcaccaagatcagttcaggatcaatcattatccttgtagtcatgccttgatcagttctgagatgaagcagggaatgcaggcctgggttagtatcctgaggacacagggcccctggccttgatggcactgggctgtgctcaggtgaagcccacccgtgtctgggagagccttggcttttcagtgggcagcatgctcaactttacttgaagctcccaggtgccaaaccatttagtgccttggctgtttatcccactgccttggaagatggactcctctcatctctgagcctttacctagctgcttcctcatctacctgtggtgttgggaccaagcctccaatatctctgaatagcccactcctagcttggaaacagctataagggctgccctgccccttgtcaaatgatcaccaattcttggtggcttggctggggacaatgaacagtgtctgctggggtctgtgacacactgtttctggaacaaggaagggatggaaggctctacccctccgtggcagcccagcatttggccaactctgtatctgaacttgagctttctatggaacaaacaatggtcttagttttttaagagcctctgggtctctgattccatggagagtcaggagtagaattagtggaccagaaaccatgacatttgccatctaggtactctgctgttcagggtggaggcacagatgagcagagtggggtgatgttggttgtatgtgcatagaagtcccctggctccagagccatccagtggtgcttggttctctcttcctgcccaggtattgtgtgtggaccaagtgtttaggaaacaagcatagaagcattatgtcacaggaaggcctggcctctcactccttcacactaatgagccttctactgacccaagtttctttttctcgggcagcctgggaccactatgagcagagagatgggagtctgtgtaagaaggatgcaagtatcctttgatttggagtggacagagcaggtccttgcaaaggcagtgggttaaacaacgggatgtctgtgggacaggccagggaaggagggcagagacagggtctccagttcaccttgccgcagaactagcctaatcatccctgcttctggtcttggccacttggcaatcatggggaagttgactccccgcctcacttgggcttggagctggatacttgtggccacgcccaggataggttgccagagtttcattaggccgctgggtcgggctggaggcttgtgtacacctcggagcagtcgggcagcaggagggccggaagcctggttggtttgtatatgacctctcttgcccttgtgcactttccttgatttagcaaccttgacctgcactggccctcacagctgttggagggaagtagcctcttgcagggaaatattttcccctgccctggaatctcctatgtgcctgttaaagattccagggccaagaactcggcaggctgaggagcagctaggtaggtgggttatgcggttcaggactgcttctggaagggactgcctgtacttctgtaccaccgttgccctttacactttgctcagggcggggtgggggaagcattcaaacaaaacaaggaagggaactgtctggcaaagcataagtggatgcatccagagctcagtcccctttaatcttttgtctctgggcgttctgctgccttcctcataccggggactggcattccaggtcagcttggctgtggtcttagaggcagggagtgcctacccagtcctgcctcaggagcagggtgagtagctaaatacagacttaggcttttttttccccccttttaagatgcttgctcctctcccttttctttttaccaccctacctttattgttagtggttacaaagtgaccacatattatgtactttgctgtaaataaagacagacaaaaaggctctcgccttctgtgtgatgcttggcccagagcagcgaccgaatcctggctgtgtggcccaagtggctcaggaagggccatgctgtgcatgtgtggtgtagatgtcactgggcctgctgtcacgaagcctcatgatcctggggtgtatgtggggcagaccccaggcctcacctgggctcagatactggttcaggttagtggacttgcagttcttgtcaagtgggaagcccgggccagggtttctgggagcctttggttcttaggacaacctggcgctatgttcccctgattccatccagtttacctggcctctgccccattgccttccttaggctggtgacccagccccttccttgctcaaacaaacccttttaaagtaaacttttttgagggagatgggtggaagatgaggaaagtttacattataacaacacaaacagttccatgttgtccacacgcagtgaatggatgtatgtgtgtg

SEQ ID NO: 6748 - DNA, 1918 bp, Homo sapiens
gcagttactctcagcagaacacctatgggaaaccgagcagctatggacagcagagtagctatggtcaacaaagcagctatgggcagctgcctcccactagttacccaccccaaacttgatcctacagccaagctccaagtcagtatagctaacagagcagcagctacgggcagcagagttcattctgacaggaccaccccagtagcatgggtgtttatgggcaggagtctggaggattttccggactaggagagaaccggagcatgagtggccctgataactggggcaggggaagagggggatttgatcgtggaggcatgagcagaggtgggcggggaggaggatgcggtggaatgggcagcgctggagagcaagttggcttcaataagcctggtggacccatggatgaaggaccagatcttgatctaggcccacctgtagatccagatgaagactctgacaacagtgcaatttatgtacaaggattaaatgacaatgtgactctagatgatctggtagacttctttaagcagtgtggggttgttaagatgaacaagagaactgagcaacccatgatccacacctacctggacaaggaaacaagaaagcccaaaggtgatgccacagtgtcctgtgaagactcacctactgccaaagctgccgtggaatggtttgatgggaaagattttcaagggagcaaacttaaagtctctcttgctcggaagaggcctccagtgaacagtatgcagggtggtatgccaccccatgagggcagagggatgccaccaccactctgcggaggtccaggaggcccaggaagtcctgggggacccatgggtcacatgggaggccgtggaggagatagaggaggcctccctccaagaggaccccagggttcccgagggaacacctctggaggaggaaacgtccagcaccaagctggagacaggcagtgtcccaatccgggttgtggaaaccagaacttcgcctggagaacagagagcaacaagtgtaaggctccaaagcctgaaggcttcctcccgccacccttcccacccccgggtggtgatcatggcagaggtggccctggtggcatgtggggaggaagaggtggcctcatggatcatggtggtcccggtggaatgttcagaggtggctgtggtagagacagaagtggcttctgtggtggctgggcatggaccgaggtggctttggtggaggaagacaaggtggccctggggggcccccggacctttgatgtaaccaatgggaggaagaagaggaggacgtgaaggacctggaaaaacggataaaggcgagcactgtcaggagcgcagagatcagccctactagatgcagagaacccgcagagctgcattgactaccagatttattttttaaaccagaaaatgttttaaatttataattccatatttataatgttggccacaacattatgattattctttctctgtactttagtatttttcaccatttgtgaagaaacattaaaacaagttaaatggtaaaaaacaaacaaacaaaaaaaaacagatgctggtgaggttgtggagaaatgggaatgctttcacactgttggtgggagtgtaaattacttcagccattctggaagacaatgtggtgattcctcaaaaacctaggagcagaaatatcatttgacccagcaatcccattactgggtatatacccataggaatataagtcattctattataaagacacatgcacatgtatgttcactgcagcattattcacaatagcaaagacatggaatcaacctaaatgcccatcaatgacagattaaataaagaaaatgtggtacatatacaccatggaatactatgcagccataaaaaagaactagatcatgtcctttgtgggaacatagatagagctg

SEQ ID NO: 6749 - DNA, 1752 bp, Homo sapiens
cctgttctcctgtccctccatcccagacattgatggggacatttcttccccagtgtcagctgtggggaacatggctggcctggtaagggggtccctgtgctgatcctgctgacctcactgtcctgtgaagtaacccctcctggctgtgacacctggtgcgggcctggccctcactcaagaccaggctgcagcctccacttccctcgtagttggcaggagctcctggaagcacagcgctgagcatggggcgctcccactcagaactctccagggaggcgatgccagccttggggggtgggggctgtcctgctcacctgtgtgcccagcacctggaggggcaccaggtggagggtttgcactccacacatctttcttgaatgaatgaaagaataagtgagtatgcttgggccctgcattggcctggcctccagctcccactccctttccaacctcacttcccgtagctgccagtatgttccaaaccctcctgggaaggccacctcccactcctgctgcacaggccctggggagcttttgcccacacactttccatctctgcctgtcaatatcgtacctgtccctccaggcccatctcaaatcacaaggatttctctaaccctatcctaattgtccacatacgtggaaacaatcctgttactctgtcccacgtccaatcatgggccacaaggcacagtcttctgagcgagtgctctcactgtattagagcgccagctccttggggcagggcctgggcctcatggcttttgctttccctgaagccctagtagctggcgcccatcctagtgggcacttaagcttaattggggaaactgctttgattggttgtgccttcccttctctggtctccttgagatgatcgtagacacagggatgattcccacccaaacccacgtattcattcagtgagttaaacacgaattgatttaaagtgaacacacacaagggagcttgcttgcagatggtctgagttcttgtgtcctggtaattcctctccaggccagaataattggcatgtctcctcaacccacatggggttcctggttgttcctgcatcccgatacctcagccctggccctgcccagcccatttgggctctggttttctggtggggctgtcctgctgccctcccacagcctccttctgtttgtcgagcatttcttctactcttgagagctcaggcagcgttagggctgcttaggtctcatggaccagtggctggtctcacccaactgcagtttactattgctatcttttctggatgatcagaaaaataattccataaatctattgtctacttgcgattttttaaaaaatgtatatttttatatatattgttaaatcctttgcttcattccaaatgctttcagtaataataaaattgtgggtggaaattcttatttcttttttaatgtggattttgtttgcagtaagataaagcttgggtctcatggatcatctctactcaccatagcactcttctgcttcctaggggaggtgagacaaggtaacagatttgagaatcctggggtccctctgcttgtggccgcagtagggtcaggcagtgcctctagtggttgctgggaataggacagattcctgcctgctggtggaggtatattccaggagtctgcagtgtcaggacaccaggaggcctgggtgtcggtccacgtgcttgaaggaagatggtggagatgctctagccagttctgcttcctatgatgccccttctga

SEQ ID NO: 6750 - DNA, 1249 bp, Homo sapiens
ccgttttcaaacaaaaactacatccatggtgagctttataagaatcgcgtcagcatatccaacaatgctgagcagtccgatgcctccatcaccattgatcagctgaccatggctgacaacggcacctacgagtgttctgtctcgctgatgtcagacctggagggcaacaccaagtcacgtgtccgcctgttggtcctcggtgagtgtcttcatgtctttcaggagttgtaggaagagggtgggcaggtggcagcacagggagaagagcccaggtgttgagacgaagccagaggcagcaacaaggagctaagactcctcacctcgtccaggctgtcttcagcagagggaccgctcctccctttggaactaaacactattctgagttctccgccaatggccaacagtctcgaggacagagaaggccgacttggagtggtcccttgctctgtcggtgtcctttcctccataccagctcctctttttcataccacacttattacaaagataaaggaaaatcttaaatcctattgcaaagactcattgtgccttaattgggtgctcagggggccacatcatgattctcttatatctttccctgccgtaactttggctacccagcagaaattcttcatgccaccatctgctcacccccatccctcaacagatactccatcagtcaggttctgctccctttgaaatgtgtcccaagataacattcttttcataggaatgacttattattggaatttatagtttgggaaggatctgaaagatcatctactttaatatcctcattttgtagatgaagcccagagaaaggaaggaactgactcaaagtcaaatcgttattggaaaataactgttatttaatgagcacttagtctatgtccaatataagaaatggcaccactgctgggaggtagcaatgctttaaaccaaaacaaagatcttttttccctcttccttttacataattgattgcattttatttttaattaatatgtttaatttaaattaaatttattttaaaatttaatttaattaataattaagatatttttattgcataaggtggttgcctgacgttttgaaagcattatagtgggtccaactatacaactatgcaaactcgcattgtataaagaataactaaggtctccttccaccctaccccctagagaggtagccaatggcaacacaggtaggtattccatattttcctcatgtcctttcaacacacacacactct

SEQ ID NO: 6751 - DNA, 1149 bp, Homo sapiens
tgtgttcctaatctcacttgcttctctcaaaatgttcctgtctcacattcctttcctgggtttgatagataaggggcactagctagttagggagatggattactccacaggttaaagtgacttagagaaagtcacttagtgtgtcttccctgcctctcagacatcacctgcattttagcaggagcttctgtgccttctgtcaatggtggaagtttcagtattgcaagagctggtggaggacatagtggacttggggggaagttcagttgcccctcaagccaccccgggttggcagcactcaggttttgccctccatcgtcttctctctgcctgctctgtggggcttgtctctgttcccagatcaccctgtcccctttctgcctggggcaccaaccgtcaagcttggaacccgcctccttcctgaggtgtttccctctcctctcctacccagtgacctttggactgcttcctcattttctgccctggtgagtcagggatgccataaacaccaggcatgggcagaacatggcgacagacagacgcttcccattagggccgtcacaaagttcactgggagaggagcataaaacgtatatctgttggctagagctcacgccctgcacgtgtccaccaatgtatctccatctgcatttggggaacaggtgacacttgccgtgagcaaagctggctttccaactgtgccctggcccttcccctcctctcgggtcccctcccaggctaaggtcttgctccatctggtgtctgctgcactttcagactcttccttgctggcagcaccttccctataacctacaaacccacctccatttctccttcttcaatcccaaaggggctaaagaaatctgctcaggatcctctgtgcccctctggtctcagctttctcatcttccagtgttaggtgagctcctgacaaaataggctgccctcactgtctctactttttcacctcctagttggctttattgttaaaagagggctgtatgtttgttgcagagcatttgggaaataaaagtacacatagaagaaatctcagattgccccacgatctcagaatccacaggtaactgttattaatactgtattttggtgtattttcttctagaaatattctctctctctctctgtctg

SEQ ID NO: 6752 - DNA, 1260 bp, Homo sapiens
tttcttgcaaagaaggatgggaaataaggcccatgagcccaagaaaaagaggaaatcagtgtgtcgataatagcagtctcagccacaatgtactcctctagtcagtcaatccatgttatcttttttttccccacctatagaacatgtttactgcctcctaagtgaggcaactcaaaatcccacttaccaactgctgcatatgtagttccaggctaggttctccaatgggtgtgcattctgtccctcaggcctgaatgcaacacattatggtcggatcaggataactgccaaaaacagctaccattttataaaaggaggaagaggaaatactgctgtcatatcattaatgaacatgttgacccaggatgtgaggagtcctcctagatttgaccttgatttgtctctctgagagaaatacccttgtctattgttctctttgacctctagctctgccctcctagctgtcttgcttgtccattatcctccatagccacgttgaagacatgtcttccttgaaggctgtatagcttttgcagactgtgtcctgtttatgaaaatttggtggctctgggactgttttaaggtttatgccatgcaaaagcttttggaagttcctggtttctttgaaaatacgaccctttcaaaaactcaataggtttatgatctatgtagattagacaaatccatgtgttactaaccacactcaaagttctttcctagatatagttttcaatcctgattcattcatttgcctttttgtctccgtttaatgatagttatcttgggaggttatctgaaactgtaaatttgggtgtggagtccaagatgcatgttgtaatttgtagtgtaattgttagaaagttttgcagtggagtgtatagctaacaagctcatgaagggtggataaaataataaaatataatcaatctaaaaggagaaaagaaagtagagaaaaagaatacagaaaaagaacaactgtctccacaagaaactataggttaaaaaaaaaagaaagaaaaagaataataagaaaatagtaggatggtagatttaagctcaaatatataaataactacattaaatgtaaatagactaaatactccaattaaaagacaaagatggtcaaactcaatttttttaaaaaggctacatgctgtttacaagagacacaccttaaaaataacgatataggtttgtcatggtagctcatgcctgtaattctagcacttttggaggctgaggtaggatgattgcttgagg

SEQ ID NO: 6753 - DNA, 3835 bp, Homo sapiens
ctgtggggaatgttcttgctggtttccttatccttgatgactcttacagaggtgctagaaaattattttcttttgccacttatgcaagaggcttggtgcagaagctgaaggcagtgtgtgcaaacactcccattccacacacgccccttcccctccccacatcaggtggtgcctttggagcacttttgtgtaggaaggaattcctgctgaactgtagctctcactcacccccaaatcattgaatgaccctgaggcccagttcctgtggtgcaacagtgctgctttctgctactttcaatgggaacagctgtacatgttgcagggcaggatttggttcccaagagcaaagactactgcagacacctgacttggtggttctcctgatttcttatctcctgaaaaatgctcctgctgttggtgtgtttgtttgtttgttccattttgtggaagtttttcatccaaactttaactaacttggcaaagaaaaaaaactgacttactgaaattgggaaacttttcccttcttttattttctaaaggaattctactagactattttccattgataatatatacaaaagaggtgtgatgagaagggtataaggttaccaccttttcctctagagagccacagacttcctttccactggatggtttataaattcctctaaccctgagattcttcttggttctctgactaaaggaggcacttattagccgggctgggatctgtagaacctttgaagaaggactttgagcaggaactttgcacacaccttaagtgtctccttggtttgttcatgatgctcctgctaggtaggtctaaatggcaatacacatctctttattcaatgtagaaagtaattagctctgtaattattttcagggtgtttgtagactatataaatgagcccattgaaaaggaagagtttgtgaaagtggatgaagaggaataagggtaacttggagattaaattcctttttttgtcagtgtactgttgttatgccatctgtaccaaaaaattttccaaaagactggatcactgcagtgcagctcatctaagttccccttcttattggagttaaaggttcccatttggtggctgtgggtgcttgcttaaatctctggtggtcccaagactgcactttttctccctttcgagctggggatgtagagagaacttacaggtgatttttattctgattgcttttgtttgtgtccacaagggagcttggattctgtgtacttgtctctttcccattgtccagtaaggcagtaaatacagacacaatgtgtacttttgtgtgtgattcaagtgggagacagtctgttaaaaggtcagaaacattttagtcccctttaaaatatttcttttagtttatttctatcgtgttttatttcacagatatttaattaccacccctaaatttcctcctcttacccttcaccttccctaaaatccttccaaaatcagtgaactgcaagcagggaaactaacaaatgtccattcaccctttttgtgtggtgtgtttttttatgttttgttttgttttttaactaagcttgaaccaaagtcaatttttagcaagctgctgtactaatggactagttgataacgtgcagttcagacacatcgaggagatagatgctactgacaatttctttttcatttgtctttattaattttatatgaaagttgctgcttgtttttaatcttttatgttggtaaattgtgatatcctctgggcagacattaacttgatgtttaactagtttattaggttggtgtgtaaatagaatgacaatgtcaattactaatttctctcctctccattcactttttctctgttgtagttaaatttaatcttctatcctgacttgacatctctacctttagtctgtggaaatgattttagggctatcagtaatgctgtagctgcccataataatgagtccctcccttgggagtggtgaaacttagaaggaaggattcagggagggaaatgctggtacccagtatactggattagaagttatagcattaatttctcaaaattgctaccaaaggaagtgtggagtcccaagggactcaagctcagtgaggtaagacaaagggcaaggaaaggctgtttgggtggtttttttttccccacatatggtttagaaaatgatccctttcccaaacaaaactcaccaacagactttaatattagaaaagatactaagctttaaatgtcaatacagtggtcttttattccctgccctgtctatattttctactcaatttgggataaggggattttatgtgaagcacttgatgagggtagaccagcataaaaaatctgtttaaaagaagaaataatctttaggaaaagataaatctttagataaaaataaatttttttctctttttttacttatttaaaaataagttgtgaaatgaaaggtacatttacacatgtacacacgaaacactaatatagctttttggtggttgtttagtttaaaatcaactccctatccatcatccctagatattctacttatcgtattgcttcatgaacaccttagtcattttttactttacgtatatatttttttatcatctcaagaaatgcattttgaattgaatgaactatcttctaagctaagatactcaaatttaacttttagccaccttatatgggagagcctggaaactaaaggggaccagggaccatttgaccaaaagaggtgtttggtggagtttctgcatttcaaagaagaaaggccagataggtcatcacaattcattgtattattctttttttttccccttaatgtttatgcaaattttattttatatttctgaatttggttagcacatactaagccaaagactattctaaatgcatttatagtgaatactatgtatgcccatggtaatgggtcctccctaaggagtggtgaatgtaattgtgtgaatcctgcttatcacaagtggtgcaatttggtcataaactttatttataccctgtatacatctgaataacagagcagaaagacctaaaaaagggcttctcacaggaacaatattactatgttgttctaagaaaaaataagttgagtgctgtattagtttaagtgtttctaaagttctataggcagcattttagaattaagaattgtgtatatccattaactgatataattcacatgtccttttatttgttatcagaaagatcaatactatcccaatttattcaacttgttacccaagaaatggaaccaaaggaatccaactttcattttgtgtagaatcatacctacttatacttaatgctagcactgtaagaaataagtcttttttgtttaaaaaagggaagataagattaaagattcttagtgagatcatcttgccaatttgttgtacatctctcattcattgttgggggaaaaaaaagcacaactatacctctttaatgttattttcttccattatccctcatttatttggaaagataagggaaaccttgtctgtattatccagaagcacagatatttgcttgacacaatatttaaattcagcccaatctttaacattaaaaaattttctttttaacttgctggaaaagttggatacattggcaaatatagggaattcatgtcttttttttttttttttttctggtcttgctctgttgcctaggctagagtgcaacggcatgatctcggctcactgcaacctctgcctcccgggttcaagcaattctcctgcttcagcctcccaagtagctgggattacaggcgcccaccaccgcacccggctaatttttgtatttttagtagggacgg

SEQ ID NO: 6754 - DNA, 5061 bp, Homo sapiens
catcctcatgtcaatttttaaagtgataaatcctgatattatacattgcaattagtgtagaataaacgcttggcttatagaactctctgttcttagtctaaagctgttcccaaaccaggtcatcctcacgaaacattcttgaccaagaaaaaagataaggtcattgagataggaagacagaggaaaagcctcttgctgttgtttcttcccaagaaaggagaagccctgccagggagaagtcagtagtattgctgactcactgtatcactgagtgtagggtgtggtagcaaggaggaggcaggggattcacgctgacaggtggctctggcctggctcttggggggccttctgaagaccagtctgcagtttgaggaagggccccaacaattcatttggagagcttggccaaatactttctcattaaatcagcacctaaacttgatgaacttaaagtttgtttattagagttgaaaacattaaaagatgactgatactaatgggagaaaaatactaaagacccaaaatttaaaattttccaaaatggacaagaattgatgggttaatttgctcataactgatatgagtttgcttttatgtgtgtgtggaaagcatttaatgtgtgatgctgttcatagtcctggctatttgatgtcattttcagttttacaacattttgaggatgacactttataaaatggtaaatctttctcagcgtttacaaacttggcttttgagaagggaaaaatcctctttgctatttctgtaagaagaataactgagatcagctattatataggtttgcatggatggtgtccacaatacaaatgtaaacttggacaggaataggataaataaattgctttcatcataaaggccaatcatccatttcttagtccaaggagattaaatataaataggacacccctgagatttccagtaaggtatttgaaaggattccactgggagggcagggaatatattttttctcagagcatccagtttgtacccagttttctatatggtttgtgaactgtagcttttaaaaaaaaattttgtagttttcttctaaccttattcattaagtagttccttgttttggcccttctactcttggccttagctaaaagcagtaaatgtgagtgaattttatgttgattatgtcacctggatctcctttccttcccttctttttctcattgaatggtggtaccttaatttgggtaacagctagcttctggcaccttcataaaatacctcagaatagcttagcattgttgcaaaactggttttaaactaaaaaccaaataaataagtgaaaaaattttataaatagtggaaataattctagctgtagcatttagttgaactaatgtttattatgatcgataaacaagattgatgctgtatgtatttgggatcctgtttataggttacaatttatagggttagggagggttgggtgggggaagaggagatgttgattatgttagaaggaaaacattgctcgtgtgtgtgtttgttttttcttatatctgtcttgccaaaggaaacttgattttccctgtgattggctttggcctctgtggtctggtctgcagcagtgtgtggtggcatgcaggtaacatatggggtgtccagtaggttcagggaccctgagggtgcatttacatcccttcctatggttgcccatgccccccagaccctgccaacctctcctaatgattcattacctctgtacatagcaaaagcataggcaaaggatgaatgcgtgaatgcctggatgtgcagttgagaaacagaggcagacatagacatgcaccaattaatttggagccaagaggtgagtgattgatgtatcttaaatctaggaaagttaaagtgaaacaggttctttgtgttgccctctgtcaagttactgaatgttgtgctaataacacaacactttaaaaccttacttacttttctcataccaaggctagttctttctagaccaaaaacacaaacaggataaaaagcaaaccaagaagttgaaagctaacctgcccacctcacccctgtgatacaaagtgtgaaccttaaggattagttggtgggattgaggagagaattattcttggtgggaacatgaatgagaaatgatgctggcttaggaaaaatcacaagccctttctgcccatactctgggacaaactttcttggctccctgagttcggatatagactgtatctctagaaaggctatttttttaaataaatgatcccacagaacttaagtgggatttggtttagataccaaagacactgctaatgtcattgcttatccttaagttttcaaaacaggcagagggaataggagcaaaaagccaaaatttggaaaagctttactttatctctttccttcccttttccccttttcccagtcccctgctttttgaaggaagtcttcttggttatcctggctttggaaaagagatttattttgttttgctctgctggctctttaaagatggatagttgctcaatctagcagtgatgttcttggaattgctgagaaatttggggagggcaaaagataggggtagaattttttcattatttccctttatctaatacttttaaatagaaccaacacagcctatatgagttcagacaatatttagatgtggtatctccatctgtctcctgtaaaagataagaattttcaagaacaggattacgtggaaaaccaaaagatcttcccttactctcctataaatgttttgttccaaatgtttttatatatgggctctagggagtcaggtagttcattgtttcggtgtactattgataggacacagaaagggagagagggtaaagaaatgtatcactctctgaatattgcatcaaaaatgattaggttgcagaacttcatgaaagctttactaataatcttattgttctgacattatgtaaaggtggtattaatattgtatgacttgtcaaagtgctagataggtttataagtaggtaatagggatgttgaagattagagcacttgaaacagaagttctgggaaaacaaggtgtgtgtaatggaacaccactttgagcacagaaacaaaggtcccttggacctggtagggaagatgtgatttatgattgtttctgtgtccctgtatctgcccaccctgcacagggctccaccacccagggccaccttctggtttaaacccaggacactgtcaaaaagttaagaccccaaaactaatttactgtaaaaaacattgaggactgctgcaaagttttcccttgttttctttgtgtacttgttcatcattgtataagttagccacagcttcacaagagcagcttaaggcttctttcataaattggcagtggcattgagttctcaaacattatatcccaaagtctgcaggcagacagctggatacagcgctgtgtataaatgagacgtccaaacacttgagtttcttaagattgggatctctttcaaatgaaaaaggacagagccaagtagagaaaagactttgtgctcccacccagccttaatgagtctcatggtctaaaagtataggaagaaatgaaatgcactttcagaagctaaaatgacagtgtctgctacaaaaggctgtagttgtaggcagtcggggatgccatgtccttggttccattcctgcgtgagtctgcagaaggcacacactttgtaagagtagagtggactagtgccagcctgaataggtttaaaactgcaaacagttggagaacatggaacaggttggtgcaggaagcctaagattttgcaatcatattataacattggcttttgacaacataaatgttgtatcttccctaaggtcaggtcggggaaagaaagacttccagcttcttacctctgcgtgcatgggcacgtgtgcattgctcagtccgcaggaggtctcactccgcaggaaacgctctcctcccgcataagtctgtacttccatcccctcatctgtggtagtagtgaaggctaggtgagtaagcgtgggctgttctacccaccagaagtccaggagctgttgtatacctcatttctaactcgtgaccgagtgacttgctttaactttctcgaaatcctacagagttgccaagtctgccctccctcctcagtcatgttaaactctggcctatagcatcatgggacctgtagcctagggtgggaccccctaaagcctctgaatgtcgctgcttaaaagctactgcaaactgagggcaaattgcaatcttctattcctttttgttgcaaggggtcttcacaggtctcttaacatctgctttccctgccaccctgcctttaggggctggccagctatccacacccctaacccaccctgtgtttctgacagctggccacacgtcaacttctgtacttgccttttccttggtggggtagaggccaaccccttctcctctgaggcctcagggttctgtttcttttcaggactttgggtagaagggaagacaccaaaggctcctttaagctgactgctgcatacacatttcactttttttcctttgacatgaccaaaaatatccaaatatttaagtttattattattattattattatttgacaatcttatatccaatgggctctctagaagctgcatccccagccctttcaccttttctttgaatgtagttcccaaccttcaattcccacccctaatgctgacaaaaagcttagccaggtcatgatactgctgctataagccaggggagggtggtttctttgttttgttttgttttgttttgtttttcaaatttccagccaaaaccaaagatttcttaatgattgtataaactcaaaacaaacaaaagaaccaaagaaaagggaagtcttcagcatcagtccagtctgtggtgtcctggcacttagaagagtgaggccagggaaggtggggcggggggaccctctgactggatcagaaagggcaggcaagctgcttaccaccttccagggtccagcacaggtgcatgcccctagctttggccctcacaaacttgtgagcatgccctgaaac

SEQ ID NO: 6755 - DNA, 2187 bp, Homo sapiens
gggacttagcacagggcctagggagggtgggagctgctgctggactggcccgaggactccacagagtgggggacgttgaagacactggcgcacgattggctgctctgctgggtgctttaacctctggggctgggcgaatgcacgccacggtgcccttctgagcctttttttcttttcctgtactggaactgcttggaagtggctgtcctgtttgtgagaaaacatgcagaaagattatcaagcttttcatttctctttattgtagttttctttcctttttgcagcaccactgtgcaactatgcattgtacttcacaaccttttgtgctaggtagatgcctgtgactttttaacttggggggtggggggattgcaaatgaaggaactttttacatggatctttttaatctcagttggttgggggaggggggtacttggttcttgggtcacacaagctctatcccaaagcaaaatccaaatgttaataatattagcctgatgcagataccaaagataatttctttcctgcagaaccttagactcgtgtattaagtacgattacccagcacttgcattagtctaacctcagtaattccaaagcttagatgtatattttggtatatttctgggatattaaaaaaaaaatgtcgtttaacttcttgtttgtttcagtgtaatgctcttaaagtcatagcatgaaaataattgaactgtcctattcttagtagtttgaaataatagtatttttgtatgttttgggtgtgtctatgtatgtattaacataacagttttcactgcctaggtgttcataataaaaaagaaaatgaaaaaagttctgagtgtacataatattcaataataatctcccaccaggtgtcaatttagattgcatattcctcattactgttcccaactgggattttgttttcttttaaagagacagtgatcgtgtttttctaaagatgttttctttctctctttcaatatcttaactcactttttttttcttccttttttgtcttaattattaattcaggggtgtttgtccactgttgtcaaaggaggggcacaaggggaattggcccccggcctcctagaactttttgttttatgtactttaaaatgtgagtttgagttcttctttgtggaaacttaagatgtggtgtaaatgattctttccaaaattgtccagcagcttgaatgaggcagtgacaattctgaggtggtttattgggagtccttctacatttctcttagataactctgcactctgggtggctattgtgtagccttactgccccagagtgcctgttagccaaatatttcccctctgataggaatattttctaagaatcagctgataacttgcgtgctggaccttgttatctgtgcccctgggagacacacgttttcttggttttgaaaacctgaaacacaggcaactttacattttggggaattagctgatgcctcctgaagcctgaggaggtggcggggaatatgagcggtgctgtctctctcaaaagtgccctttagatgattccccctcctagggctgcctgcaggggctgtaggcttgggaaagattgtgtaggtgacagtgaatcagaatgaagtggtagattttgtgtagatgcatttgtctgctgtaattttttatatatatattaaacttactgtaactgtacagttcatttctgttgtaaaacatcattaaaccatcttccaagtgttttcacattgttggagtttctttgaaattgctgtgttggtattctggatgcttcacatacagattctcagacttcgcataattcagcttccaaattgttttttccaagtgctctcaggaaccccagaatcaccataagcaccctggttcctgccccactccacccttcctcctgcactccaggaggagctatggccactgcatttctccctcccagaccctcagtgtggtttcgtgggaccctgagtagcagtagtctccctcaggcccaagtactttgtgtgatcaaacacgcaggcccatgattgatcctgcaagggagctcttcaaagctccatctcactgtgtatttgactgcagaactgggaccgaactcaactttttccaaatgtattgtttaaactgcactgcccctctagcatttcttgccaagtcctgaacattcactgggtgggg

SEQ ID NO: 6756 - DNA, 1174 bp, Homo sapiens
gcccggcaagaatttttttttaagtgtcagaataaaattactaaattagacaccgaactgattaatgttttacagtgcaataaaatcatgagtttttgtttttgttttttactgaatggaaagcatttgcatcttcacaaaataaaagtctgcaggtcaccatgtgatttcacaatcccacatggctctaatctataataaatagcaaacaatgattcgttctcctggaaaattaaacggtccttgcgtggacttgtgaagcagtgcaccagactgacattgaaagtgcatacagtcctcctcttggcctttttttatgagtttttggataactttccttaacactttcttctaggtgcggacgaggggctcaataaaaaggcgccctccctccaggcgattccgaaggtcacagtcagactgtggagaacttggagatttcagggcggtggagtcatctcagcagaacggtgctaaggaagaggatggggatgaagtgttgccatccaagagcaaggccccaggatcccctttgtccagtgagggagcagcgggagagggagtgagaaccctgggacctgctgaaaagcctcctctgaggaggtcacccagcaggacagagaagcaggaggaggacagggccacagaggaagccaagaacggtgaaaaggccaggcggagttcagaggaggtggacggccagcacccggcccaagaggaggtcccggaatcgccccagacctctggcccagaggcagaaaataggtgtgggagccccagggaggaaaagccagctggagaggaagcagagatggaaaaggctacagaggtgaagggggagagggtgcaaaatgaagaggtgggacctgaacatgacagccaagaaacaaagaagctggaggagggagctgcagtgaaggagaccccccacagtccccctggaggagtgaagggcggagatgtccccaagcaggaaaaaggcaaggaaaaacaacaggagggggcagtgctcgagccaggctgcagcccccagaccggccctgcccagctggagaccagcagtgaggtccagagcgagccagcagtccccaagccggaggtaggtggcctggctcgttcacatgcagaaggcagtgccagggccagtgtgtgcctctgtcacatgtcctgttcc

SEQ ID NO: 6757 - DNA, 1234 bp, Homo sapiens
tttgggagaccaaggcaggtggctgggaggtggaggttgcagcgagccgagatcacaccactgcactccagcctgggcagcattgagcattgagtgagcaagactccatctgcaaacccagcaccttgggaggctgaggcaggcagaacactccaggtcaggagctggaggccagcccggtcaacacggcaaaacccctctccaccaaaaatacaaaaaccagtcaggcgtggccgcacgtgcctgcaatcccaggcagtcggcagcccgaggcaggagaatcacaggagcccgaggcagggaggttgcagcgagccaagatcacggcagtacagtccagcctcagcaacagagggagaccgaaaaaaggaggagagagagggggagagggagagggagagagatgttgcatttctttccgtatgaagtctttaaaagaacctttcatagcatgcacattacagagtttaggaattctgcctttgagaatagttcatgtgttccttttttctaattgcagtttttccactactcccaagggcaagtgtaccttgggaattatccaccatttaaagacagaatcagctgggctggagaccttgacaagaaagatgcatcaatcaacatagaaaatatgcagtttatacacaatggcacctatatctgtgatgtcaaaaaccctcctgacatcgttgtccagcctggacacattaggctctatgtcgtagaaaaaggtacttccttgagtattttggcagtaataatgcagtctcctttatctcatgtttggttggaaaacatgagttgcatttcatggtgggtttggagggaggatttttgccatacagttgtgctccctgttgccacgaacctgtggctctaccaaacacacttggagctgggaaacttgttgctcattctgacccagagtggctgatttctccatttttattcctaccgtctggtgcctattggtctaatttcaggagtatgaatttttcagtgttaattagaagaaagaccaaattcattatgtttggatgtgatgggcagtgggaaagaaggagattcatactgttttatattctccaggagaaagctttcaacaacagcacagttatttcttccttttgattttgagaacaaacaggaaatgcaggttctggtgtctcatttttgagacaaagtctgttttgttggagagtagatccaggtaaattcacacctccggttt

SEQ ID NO: 6758 - DNA, 3637 bp, Homo sapiens
tcctgaagacattcaagagggaagtctttgctttggaaccctgatgtgatcacgttaatcattgcttctatgcctgtagctgaaggaaccgccagcgttttcagtcctctaatccttctgcttcccttttccagggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatcctgatatgaggagccagtgttgcatgatgaaaagatggtatgattctacatatgtacccattgtcttgctgtttttgtactttcttttcaggtcatttacaattgggagatttcagaaacattcctttcaccatcatttagaaatggtttgccttaatggagacaatagcagatcctgtagtatttccagtagacatggccttttaatctaagggcttaagactgattagtcttagcatttactgtagttggaggatggagatgctatgatggaagcatacccagggtggcctttagcacagtatcagtaccatttatttgtctgccgcttttaaaaaatacccattggctatgccacttgaaaacaatttgagaagtttttttgaagtttttctcactaaaatatggggcaattgttagccttacatgttgtgtagacttactttaagtttgcacccttgaaatgtgtcatatcaatttctggattcataatagcaagattagcaaaggataaatgccgaaggtcacttcattctggacacagttggatcaatactgattaagtagaaaatccaagctttgcttgagaacttttgtaacgtggagagtaaaaagtatcggttttattctttgctgatgtcctttctgcttgaaataacagtcaccatacagctaaaggagaggagtttctttccttctaagtaggcagaaatggtatcattatgttgccgctctccaatctcccagagctcgctctctagagaatcaccttctttcgcttttttttttttttttgaggtagagtctcactatgttgcccagactagccttgaactcttgggctcaagtgattctccctcctcagcctcccgagtagctggaacgaactatagttgcaccactgcagctggcaagaatcaccttctttataaagcgtcagtcatgcttccagcaagaggcagcatcagtcatggctttataacagcttcatggtgcctcaaagactgttgaggttaatgagagcctagattagacagtttggctgtccttccctaaaacttgttttctcctattcactactccccaccgcacttaaaatctatgagtttttactttttactgggaatggaaagtgtggtgaagatcattcaacacttatgttgtcatttctcccattttctgaatttttttttaaatttccccccttttaaaattgttcgaaagcccacagttatggaaagaattactgtctagatggtctgcagaacgtgtttggggtgagtgggagtgaggggcaatgttactttttctccctgtagtttggagtccattatgagctgctgctttttcttctcatcttgtcatcttctggggatgtttgaaggctgagttccaacagaattcacaaagggaataaaacaggattgagattttgaggtgtgcacaaggtggtaagataaagggcatatgagcttcaaaactaatgctgttgcatacatgaagccttttgttttttgaggagctatttttgttattcttgtaacgctccaccttacatgccacatctgtgtgagtcaacagggatcaggtttggtcaccacacatgtctgaagctgggcagcgtctgctctgtgttctgtgtggaatggagaaaaaaacgcctgccctgctgccttccatgttcataggcccagcccaagagagtgacacacagtgctggccctgagacatttccacaaagtggtcaactctgccttgcatcctaaaactttttgggcatctattttgaaaactataggagcctttggaaggcctcttatgtttggaggggaagggtgttgagattgtcaccatccttcaagctgagactcctggtgagcctttgccaccatgaaaaccacatagctgaccagggctgtgcttgaggtacagaggacacacattgtagacaggcctgtgtcatgtttccttacagtcgttttttacagagaaaaggggcattgttttttcactgctttctcaacagttcctgtgaataaatgaaacatttcggagctccctgagagcaagagccttcacttcttcttgcggtgccgggaccatgtgttggtgaagctggtgctgtgggggccactcactcgaatgacacctggaggcctgttcctcccttaccactcccttccccagcccgacttcttggcctcctgcccaaccagacacctcaaactctgtcagtgccctggcattctggcagagaatcctcaccagttctcaccaaccttccccccaggcaagggcagctgccagcatggtgctctgccaggacaggtttccctgaaggaagctgctcacactgagatgagcctctcagggcaggacctcttcccaagccctgcacacccacccctgcagcccttttggctccccttttccctgtgcctcagcactcctttcctggttgcagataacgaactaaggttgcctaaagggcagatctgccctctccatgtcttcgtcctggcaaacagggtcgtcttaaaattatgcgctaattctgtatgggagcactcaaaaggcattacttagagattgaaatttcaaactatctctagtttttcaatggaaatatatcagctagggaaaaaccatcaagctcattattattttttgatcttcagttgtatttttgtgaatattttaatacatctttttcaatttctgaattgtgttgtgtgctcattttgaccagaatagaaaaagagatatgcctttcactcatatcattccagctacacctgccttcttttcttcaaaaatgccgtccgtgtgcctgcttctgggcctttgcacatgctgttccctgggcctgaagcatgccttctgccaatattcctgtggtttgctctctgacttcctttaagcctctgctcaaatgttacctcctcagggagaccttctgtgatatataaaagagcaagccccccaccccaccgcctcagccttcctggccccctcagttctgctctagttactctatttctctccctctttcccagtacacacttgtctgttctcccgcattagaacatagttaacaagagaccagaaccttgctgttttgttcactgctccgtctgcagtaaagggaacagcacctggcacttagctgctcaatacatgttacgtggatggatgagtaggtggaagcattcatccattcag

SEQ ID NO: 6759 - DNA, 2355 bp, Homo sapiens
ctacagtgcgacaaaccacccatccagctctgcctagagtgggttaatatgccacaattcgaaaagagaaagagaatgagtgtttcatggtggccccagacagtttggtggccgcagaagttgagaaggctcaaatctggagatcaggtttgggttggagtcgtgcgtaagggagcggatgtcacataggtggggaagggagctgacttgagatacgttggcttaggaagagatgttgcaggagagagggtgaaatgcacaggctaggagagtagacggcttcacttgaagggaagggattggggctgtggatgcctctagaggcagttgtcagagggcctctaaaaggtccattttagaggaagcgagaaggaaggtctcgataaggagccattcagggtccattacctgctggatggttgtacaacggcctcaatttctcgggcagcatcagctccactttatcgaggagccggtggtaggtggcccgcaggcctcgggcaccggcggccgacatcgccgccgagggatcgttggcagccgggtgggagcgtggctgtgttctcgtccctggctgacaacgaaggggagctagtcacttttcctgccacgacgactcgcgtccgcctctcgcctggagtacccttcccgcggctttccctgcccgctgtgaaccgaaaagctgcggcccgcgccccgcgaaggttgagggggcggaggctgccgactgccagcccccggtccgcctccggcccccggcaggagagagggaggagccatggcaacaggtgccaaaataatcacctcaccaagtctgcgctgcgccctgctggcagcgcgcttgcgcaggccgagctgcccgccatgattggcccgccccgaggcgcgggcggggtcgagcggaaacctcctccttctccccatgccctcgaggccatgttggagaagggaaagtgaagctgcgctggttctactgccctttcactttgattaagcaggcccgtagttaaaatgggtttttgggccttcagtgcctaaagatgatgccgcacaattctcttgcttcttttcactggagactcgtgagcgagagactacagaattgagtagcttctctctctactcgtcttttatccctagcgacttaaggatctggttagagtggcccgaatgcattcttccagggtgagggcagccgcagcacacaccagcctcagtccccagggtggtcgtcatctcgcgagaaagggttggcggggagggtatccaggacgaggagagggaggagtcgccatcgcctccgcctccgcctcctcctgttggaggggggctgagggaggagactgttgctgatctttggatgttctggttagtctaagaaggagagtatgaggcgagctccggcccgggtgcggccgggcttcaggggcccaggcgccgctgctgccaccgccatctaacgctgcgccctggaggcccggcgcgcggatggtgccggtgcggctcgggtgttgaaacgggtgtcccctccccctcctcccctcccccacgcggtggtctcccctcccacccggctcaggcagagccatgtctcggggtggctcctacccacacctgttgtgggacgtgaggaaaaggtccctcgggctggaggacccgtcccggctgcggagtcgatacctgggtgagcgggggccccggggcggaggcgctgaggtcgccgcctagagtgggggagggggcacgctgccgggtctgttggaggtgggacggcgtctcggtgggggcgcccggagactctggggtgttgggtggggccttggttgccgaattccgtgccggtgcctcccccagtcaagccccctgtgcatgctgccagccgccgcccttgctgggtttttctcggagggccgggccgtgggcagaaggtactggcttgtaaaggtgttggggtcgctgatgggttgggactcgggagacttgcggaacctccaggagctgccgcgtttagagcaaaagttagctcttttgctcttttccagcgcgctttccccgctcagccgaagaacctaagttgttgcccaccctctccttcaatctccagagggtttaggtgtcggctgcgacgcgttgaccaccctcagggacttcacgctccagacagaatccgtgtaaactgtttttgcggcgctgagccaaaacctaaaagtgatagctgagctctccccacccccgcgcgctctcccagttccactctgctcttcagttcgttttgaccgcttaaaggtggtgtagggtttcacgttcctcttcccacccctggaaaacacacttggcatttacagtttcgtagtt

SEQ ID NO: 6760 - DNA, 1141 bp, Homo sapiens
gagctcttctcaataaattctgagttgtttctaaatgcataagtttttatccttttaattgaattttgttatttgattgaaattaacaaagcagcttaaatttttgtgtataaatcagatgagttaactgattgttttcaatttctgtttctttcctagtatcattttgttctatgttcattttgaaatcttttgcttatggaggactttttatttccatttggtttaattacttaaatattcctagagaaatatatgtatctaattcatcgtagttaaatagaagcatttggttgtatatgtattgtctcataatttaatgaccagtaattttttatcagtaatttgtttatagtattcctctatgagacatgtgttttgtttatatccttcttcttttttaatgtataatcaaattcttattattttctattttattactgtcttttcacctttcttttcctatttgtgtcagaatttttaaggggccctgagatagctttgcttcgtaagcgcctgcaacaactgaggcttaagaaggctgagcagcagaggcagcaagagctagctgcacatacccagcaacagccttccacttctgatcagtcttctcatgagggctcttcacaggaccctcatgcttcaggttattaatgtcaagtgtccttaagcagctgatagaattgttttttaatactgctactgtgtaataaggtgcttcccttttcccattcaaaaagagagctaatgcgcttgcagcttacccctcctttccttgcatatgggtggtattcaacatcacgtgttagggggacagattggcagcagcatctgccagagaggtgaatataaaataatcaattttaaaagttgtaatatatttggagaggggcaaatatttattacttttaaagctgatgacctctttttgaataattagtgaatttagagcctgcattgatctttctattgaaagtttgcatatgctgaaatgaatctatgctttatggctcctagctcttcttcttcttcctctttgaatgttagccaatattcctaaaacctagtaatgctagattttagaattatagtattatttggccatactagcatgctgactaaattatttccttctgtcatt

SEQ ID NO: 6761 - DNA, 1255 bp, Homo sapiens
cttatgataaagtaagtgtggaaaatgatataccaaacaaagcttaaagaggtttcttgctgcaagtcttctcagaggctttattacgctacaggttcttgtgaatctcacaaagaggtatacacaatgtagtatttcccaaattttgtgaccacattgtagagtatcagaacactttggacaacagtgaccttcatcttcttattctgtaattaaattattccattcaaaaataaattgagtgtgaatttattattaaaaacttaagcctgggcccctccccgccccgcctcccggcgcgggtggccgaggcgtagcgctgcgacccccgcacccctgcgaacatggcgctgcgagtggtgcggagcgtgcgggccctgctctgcaccctgcgcgcggtcccgtcacccgccgcgccctgcccgccgaggccctggcagctgggggtgggcgccgtccgtacgctacgcactggacccgctctgctctcggtgcgtaaattcacagagaaacacgaatgggtaacaacagaaaatggcattggaacagtgggaatcagcaattttgcacaggaagcgttgggagatgttgtttattgtagtctccctgaagttgggacaaaattgaacaaacaagatgagtttggtgctttggaaagtgtgaaagctgctagtgaactctattctcctttatcaggagaagtaactgaaattaatgaagctcttgcagaaaatccaggacttgtaaacaaatcttgttatgaagatggttggctgatcaagatgacactgagtaacccttcagaactagatgaacttatgagtgaagaagcatatgagaaatacataaaatctattgaggagtgaaaatggaactcctaaataaactagtatgaaataacgcaagccagcagagttgtcttaaattagtggtggatagaagacttagaatagaaacttttagtattaccgatggggaaaaaaaaactactgttaacactgctaatgaaagaaaatgccctttaactttctaatgattatagataaatataatatgcgtctttttcacaatatcctatgatttttagactaggctctagtgttcagaattcatgaaattatccatggtaaaaactagttataaaaattacataattcaaagataacattgttattcttaagccttatataatattgtaacttgcatgtatccatacctggatttgggatgaaatacttaatgatctttccattgg

SEQ ID NO: 6762 - DNA, 1509 bp, Homo sapiens
ggcctgacctgtttgacatttgagggcctatgatgtgctaggtgctgtgttaggtacttccaaatgctttatctcattttaccccagtgcaagtgtgatatagtgaggatggtgaagacgtgggtatggttaagtcatgagttcagatcccgtgcttccaattacatgggtgttttcaaacaagtcactacttatgagtttcctcatctgtgaagggaagtttagtcatctgtttcaatgtggagacacacaggattgagggagtcctccgtcacagggtgactgtctggattctatgaggaaatacttggaaagcatgcagcacaatgcctggggtgcagctgaagctgagccactggtgtttcttcacagtatctctgtggggagggtgtattattcctttttatagggatctctataatgaagtgagaatcttgaaaatataagtgttatcctagatgggaggtgttaaaggtttttgccttgggaattttgtcatatttgttgcacagcaaggaaggactttcagaaaagcagggatgtggtgaggaagagcaggcaatagagagcagggaggaaaggctaagtagcatctggaacttgagaagtctaagggagccaaaatgagattttctattaaaaatgtctatcctcagccgggcgtggtagctcacgcctgtaatcccagcactttggggggtcgagatgggcagatcacctgaggtcaggagttcgagaccagcctgaccaatatggagaaaccccgtctctactaaaaatacaaaattagttgcgcgtggtggtgggcgcctgtaatcccagctactcaggagcctgaggcaggagaatcacttaaacccaggaggcggaggttgcagtgagccgagatcgcgccattgcactccagcctgggcaacaagagcgaaaccccgcctaaaaaaagaaaaaaaagaaaaagtctatcctctatgctactggcctgtttgtacaaagataaaatcattctaatttgtccggaatgactatcaaagatgatcaaatccccagggcctggtgtaacgttccaaatcatagcacaaatacagcttgaccttccttacagtccagaaaggacattctccctgagaaatgcccttggttgctgaggacagctctgtcctgtagtgacagagtgactgcctggctgtggctcttgggttcacagaatccctaatcctccaagcccctaagaggcagggcagggatgctacccacaatatatgcagaaccccagatggagcctgtgggagagagaggaaattaccgtcttcactgtaggcaaaggagaatggctgtgattagccatatatgcctataagaaggagcagagccatactgtccttgtgggttgggagaggggacacagaatccagggcaattgtctgaggtctcaaagtaagttaagccagagtcaaagccaaactccaagtcttggccaaggggatgagaaaagcaaggagctagtcttat

SEQ ID NO: 6763 - DNA, 1168 bp, Homo sapiens
atttagtacaacatattttaactgtggtgatagaaattcagactgtaggaagaatcactcagaatataaagttccttttagtaggaccctctcctctactcggcccttctccccacttcccttccatgctgggccggcagatgccatgcttctggggtctggtcattgaggcagataaccccctacttcagataacttggctgcattttttgtgtggctgacgcagccccaccggctgtctgcaaactccctgaaacaggatgacaggcgggtgtttcttgggcacgtgctgcggcgcagtcagctccacttgatgatgggtttggatgaacgggagaagaggggtggaaggggtgttgagaggggagaagaggccaggaggactttagattgtagttacatatgcacaatctgcccgttgttttagggacagatatgatgctgcttgaggactacacgtctgatgacaaccctccctctcactgcacttgcccacccaagagaaggagctcggtgacatttgaggatgaagtggaacaaatcaaaggttggcttctgtgactgattgcttcaagaaaacatagggaaacggaaaggatcttaggacaattccttggctcaggctggctcccatcccggaatatatcagggctccatccctttgctcactccctggttactcccagccctgttggtctcacctgagtccttaggcacccagttctcagagcaagcagcatcgaaggctgggcaaacaatggctgtcaaactccacacacacacacacacacacacacccacacgtgtttacacacacagcccagatcctgggtgaggtatggttataactgaacctgctttccctgagcctcagtttcctcctgtggaaaatgagataatggcccaatgagtgtatctgctttgctggaggccaaagctgccatcttgcttgtccgtcgctcctacagcggtgatggcccttgggtcctgtgaggagaatgagttctgccgcagcccaatccctacatttttctactctatatcttccccgctcacccccagggactgttgtttactctggaacttggaattcgtttcccatccagacatgctgattaggagagtgacaagagccatccagataccaatatgactgggctgtggattt

SEQ ID NO: 6764 - DNA, 2505 bp, Homo sapiens
ctcccaagaaactgggactacaggcatgtgccaccacacccggctaatttttgtatttttagtagaaacagggtttcaccatgttggccaggctggtctcgaactcctgacctcaagtgatcctcctgcctcggcctcccaaagtgctgggattacaggcgtgagccaccatgcccagccccatgtcctttttaatgcctggattgactttgtgggacatgaggccaaggtaccttttaagatgtcacctgtatagcatactagtagtgaatgtaggctttgaagtcagatgcatctggctgtgagctgtgactagtcatatactagttgtgtcattttgaacaggttacctaacctctggctcctcagtttgttcatctgtttaaaaattgtgggaataacagttcctgctgggtcattgcaagatgtcagtgagacgtgtcaagtgcttagaatagggcttggcataagtagagtctcagtagggtaggtgttatttaatcccagaaataactgacaactttggaagatgagagtgaatgtctccgatcattaatttatttaacaaatacttatctagtactatgtgcccggcgctgtagacactgccatgttttatctcattcaatattcacagtgactgcccagtgaatggtattgcctccatcctctgagaaggtaaagagcctatcccagaccccacgagtggaggcgtcagggaggggttcttggcaggagatgggtcttgtagaaaggcttctgctttgctttcactcacggcctgtggccagtttgctcagacagctcccatcaggacaccattggcagcttttgcatgaccctgcctcccagggtcttcctgcgtttttccttaagttgccttattctttggttgtttccctacttgtttttgttagactgtgggaggaagaaatccatttcaaatctgctgaaacctgttaccaagcaacagcagtgattaaaagcaacctgatgagtgagtaaagaattagggtttcagacctgtagttaatgatggtctctgtctccctgctgccctgcattcccttcccttccgttcactgctgggtgaaggagggcttgctgcattttggaagttaagggaaccaataaggtgactcttttgcagattggaatatggtgctcagccagccatatggaagcactgtcctggcgtgatctgccctgggctgttggctctctgagtgctgtcttgggaggagcactgcccttcagaacagaagagatggcttccagtcccctctcccccttctcccagtctctctgaggctgcttgttgggtattgggcgtgctgtgtactaactcactcccgtctcttgtctcattatctgaaatgcatccccttttgcagaaagggctcaaacggagccttcagttctgctcctctgcatagccgtagctcagatcctagctcaagatgtcttgtctgggaagggcaaaacatggtccccagtgtagcattttcactgggttgattatctcagtggtggatcatctatcacccttgtgtggtgactttgtgaattatctgcctgagtgccacttcccttccaccctaatcactgcaggctcagggagcaagaaataaaatcatgaaatgcattccaaataaaattaccttttggctgggtgcagtggctcacacctgtaatctgagcactttgggaggctgaggtgggtggatcgcttgaggtcaggagttcaagaccagcctggccaacatggcaaaaccccatctctacaaaaaatacaacagcaaaaaaatcagccaggctagctggtgtgcgcctataatcccagctacttgggagggaggctgaggcacaagaattgcttgaacccaggaggtggaagttcagtgagccgagatcgcacccctgcactccagcctgagcaacagagtgagactctgtctcaaaaataaataaaaaaaaaaatcactttttgatacttctgttaaaatagataataaggaaccatatcttaaagtgtggaggatctggcttggcttctgtttttgatagctctatgaaagtgacagatttgcatcatgagacttagtggaatgaattgggaaattgaagggcagcccagtggctatggattctattttctatgggactgtctacgccaggctttattttctctttgctcagataacttctgactagagtcgacggtaggattataaatggtttaaaatacgtattctcaaacctcattttcagcatataaatttttaagaatcagtgtttaaaggtacgtgaaaccatttgctagatttttgtcctagttttttttttttaatttaaaaatcttaagttttttttagtaagcttaagatgtccagtagtttatttgcagacagcatttttaaaaagtgaatagatgtttaactgaagttaaatacaaatttatgtctgtgtaactcttggtaagatataacaaaacctagacatcta

SEQ ID NO: 6765 - DNA, 2058 bp, Homo sapiens
gtcttgtttttgagtacacatagtgatgcatgatgtgagccattaaaatttcatttcattctggatttcagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaattttttttttttttttttttttgttttttggctctttcaaaggtaatggcccatcgatgagcatttttaacatactccatagtcttttcctgtggtgttaggtctttatttttatttttttcctgggggctggggtgggggtttgtcatgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaacggacaataaaagaatgaacacattcctcgtgtgtgattcactcttgtctaaatgtcccaacctgtgacttctttactttccacaccactaattatccaagatcttgaagaagtattgaacctgaaacggagaaacacataatttcttagttcagacaaattttggtcttttccacttaacagagtccaagaggttggtcaggacttcagacactggcataccccttcccaaagacactaaaagttaatcaatcaatcagaggcagagaatcgatgaagctccagtttgaagttccatttaaaaaaatcatcttgcagtgctactgctacttcactcagtttagaaaacatgaagtgttggttcctgctattgcttcactagacatatgtgttaaaaaaaaaagttgttagcacttcagtttttaaaaaatgaggttaggtttgtggttcagtaaattaaggttcataccttgctttttggttcagggattggcctaagtccttatttagctgtatttaaaaattagccttagtgtgaaagaagataaaaaagctttccaaaaaacattttccagctataat

SEQ ID NO: 6766 - DNA, 1195 bp, Homo sapiens
cagcctgggccacagagcgagactccatctcaaaaaaaaaaaaaaaaagacataatgatataacctcattttcttctatgttttcctgctttcctaccaatatctgtaaaacattaacgtcattatttaaaaaaatatgtaacctagataatatagtaatcagacatcattgttaaatttacagcttaaggaagtaagttgtcttttcaatcagattagtcattctgtttttttagtaatagttatatattaatgaagtgaaactttataggtaggtatacatcaatgaaatcttaggcttttaccatctatattgcatacttctgacattatatcttattttccttaggttctaagaattttagatccagttacctgcaaagagagttcacctgataatccattttttgagtcttcaccaaccaccttacttgctacaaagaaaaatattggacgatttcatccctatactagatatgaaaatataactttcaattgctgcaatcactgccggggagaactgattgccctttaacagtcaatatgttggaggcatgctaaggtacttccttattacccaagagtcattattatttgggagctggggttcttacaatgctagaaataatatcacttcctatttacataatgtatacacccaaagatattttatgtactagactccagattaccctttcttaataaatatctcagggtaaggaaagaaagaaactgtatagatatatttaaaatagagaatactttccaagcaatacatgatacttttcctaaaagactctaaaagaaaaagattctgtaactctcttttagcaccaaattattgtttatcttgctggatattttatatgaacagtgttaatttagatgcactaaagcaaaggtaggcaaactacaaccatgagtcaaacatggccacacccattcatgtgctattgtctaagctggttttgcactacaactgcagagttgaatagatgcagcagatcctttacagaaaaagttttctgacctcaattctaaagtaattgtagtagggagctggaggactttctttccctttatggtaattttttgagctacaaaagagccttgcagaaatgggtgaagggattaatcttttaaaaataaatgctatatattaggaaaataaaaaatattttagagccaagttaac

SEQ ID NO: 6767 - DNA, 1147 bp, Homo sapiens
atcagcttgaaggcagagaccaggactgaattataacaataacagcaacaacaataaaagtaatactaacagcattagcattgtgctaataagcatttatgatctcactgatgggtaccaacatcgctgtaaagtgagaactactatgaattccattttgtaagtgaagaagggctcagagatgaagtatctcaatcaagttcacgcagcttgtaagggatgaagtcaggattcacactcaggcagtcaggctttatttagtaccaccgtgctgtgatgctgctttgtgtcttcagggtctggcacgtggtgtaagtatgcaatattttttgaggctttatggacaaattctgaatatactttattatagagtaatcctcttgtcattgataattcaataaactgcttttcccccttctagtttttgatctatgccagttattttgcactcatcgctgtggttttcctggccagtggtgcagtcagtgttatgaagaaatgtagaaagctggaagatccacaatcaagttctcaagtaaccacttcataatatactgctgaagggcttcttcttatagcaagaactctgcacagcaactgcctggatgtgtttgattttttaaagcgtagacatatatttatgaatgtgcatttcttgacttcacagcagccacttgactaataccttgtgttccgggaataacatgatactattcagaggagccagaagtaaagtttatttcatggattatttatgagagctaatttaaggatgactttttttctgattcaaaagtgaacttgattttaaaaaccagtcaagagcaatcaaagcagcacatggtgttgtatacttcattagcaagtgagtttggtgttttataggtcacatatgtctgtatctacttagccagatgcttggcctggtgggaccagggctccacagaggccacaaaatgttgcaagtcatgatggatggaaatatgttctaacagcatctgcctctattcaatttaattcttatttctgtgttactcatgtacattggtctttctacatagttattctatcactggcaatatttgttctggtttagtgttctgtattttaaggtgtacgtatcatttctaattttaagttattttaa

SEQ ID NO: 6768 - DNA, 1102 bp, Homo sapiens
tgtaatgtggcttagcgtgactgcccagactggtccagcagttcctgctgggggcgagggggcaatattttgacaaagaagtgaaaacagcaaagtgtactttggacacggcttagtaaatattcattgactgaaagtaggcaaccactgcttttctgaaaggatcttccctctacctccttcacctgcttcctgtccataccttactttgtttgcatttggcagaatgggtgggcttaatcaagtaaggacaggacagaagtacagaacatcttaatttgtcttgatttttaattgggtgaggttgtgtccaaggatatcctgcccctctctaccttaagaccaacctccagggataaaggcagatggtgaaacataattgacttttaattatagtgtttcttgtattgcgaattgttgcttcacagatgttagttttgcttctcagatacaaggtgatgtctttgaaggccttctgtgatgttcagggtaattgagagcacgtagtccatcatcaagagtttcttgctgattgattttttccctagatgagggcttacaaataaagtacttcagaagcgcatagtgtactttagaaatgtgctgacctatttaagtgcatggtcaaaaccagcacttgatttttgcagaagaaagacaatatataaactgagaaagaaattaaacccaaagtacttccacaaaaccgaaataaagccgattcaacaccctcttccttgaatacaacaaagggtgaaagctgaggtctcatgttctttttcctactatcagtcaaggggccacttgagagctttttcttttttcctacacctgttccttccaccctgcctccttgccccaggtgctgtaaaatactcctcccatttaaaccttactcttctctatgtgggtagtagtcagtcacttcttttgagtagccactcagtaaccctgcataacaggtcagaacaagagatggcactaccggaatcatttgcacactggcgagatatagttactcatagtttgttgtttgcagtttgtttgttgcaatgctccgtcattttcaagggcacttgagagagaattaagaatcagtatt

SEQ ID NO: 6769 - DNA, 1238 bp, Homo sapiens
taggaggcatttaaagccatgaaatgagattgactgatttatccattcgggaaagattacgtttttgctgtacccagtgctgttttaatcattggcaatgcagtaatgaaccaaactaataaatccccactgttagcctgtttagaggcaataaacaataacaacatgatgatatgtgcagtatattaaatggtggtgagtgctatggagaaaaataaagcagggaaggaagatagggaatatgaatgtgggggtccaatttgaaatgggatatatagttagtgaagtcctcaccaaggtgacatgcaagtaaaaacctgaaatgcaaagcactggagatgggagcatgcctcatattcagggaagcaagtatagctaacacaaaggtagcaggactttgcaggtcatttgaggactttggctttcactaacaagggaaatagggagctactggaaggatttgagtaaaagagtgacattacctaatatgttttagtgtgtgtcccctgggacaggattatgttaacttgacaacactgggcttattgaatgtatggctattttatgattatctattatggtttcttttctctattataataaggcttggttcttttaggacagaattctgcccaacctgtcctgtatgtttgccttactgctagctgacaggagttggctgctagaacaacataccttggaggcgtttactcagttcgctgaggtaattataaaactgatttatcacagtgactttcaaaccattttaatatttcaaatattccagaacaatcccaaaacatttattgaactgcttctgtattgcaatcggaaaattgtctgaagggtacattactcgttatctcttttacagcttctcaaaatgaggcttagataaatgaagtgaatttcgtaaggtcctctgaataaacaaggaccagaacaggcatacacagcaggcctactgatacagacagacacagacacagtcttccagcagatagtatttttgggtcaaatgataatacatttcattttgtgctatcagtcataagggttaggctgatgaacctaaacctgtaagatgggttgctcctttactcttactgcatttgctgtatagtcatgcctatgatcataagggagtccagaagcattagtatgacccagcagaagtaattaaagcttacaacacttgtacagaagttaattttgtattatccttagggaccctgaag

SEQ ID NO: 6770 - DNA, 2364 bp, Homo sapiens
tgtatcttcatatgaaaagacattataaacagcaaaactcactttactacagttttatttttatcattccctagcaatatattactgatcattgctagcatgtaaaatcttttcatatttttgcttaagagccatatataagtaatttattaaataaaacttttctgatttgattcttccactttgtttcaaatagtacctactgacagaggtttcccatacttttaacacacattgttagaagtattttattatatacacttttaatggctctattaaccttaaaaaaaaaagttaatgatatccacctaaatcactatccctgctaggaagagaatcttggtggtataaaaatgtaggcctcttaatctgcattgtggatgtgtgatgaaaaacatagcttatcattcttttttttcttttttagccttggaatggatggctttggccaaccagttggcattcttggacgccctgccacagcatatggattccgccctgatgaaccttactactatggctatggatcttgataaagtatctgtttccatgtgtaatctcagcttagaagaaatctgtgtgggttgggttaattttggatctttgcctaataatgcatgttgatgttattgtgggtctgtgtttgtttttatttttatatgttgttagctgcagattaaccccagcccctctgtcttctgttaagtacagttgatactgacattgttcactcatcaaaccacatcttgatgctaagtaacatttcccatgagccacaaaactgaatgctgaaaagctactagactggaaaacaaacactgcattatgtatgttaagtgactaatttaatttcaattaaaaagcgtaaagtgaaaatgaataagtgaaagtcatgtgtttatatttcacacatttcactacgaattacatgttaatatagggtgcgcgtgaattttattttttctcctttttttctgcttgtaaactcttgagtaatttgtataatatatgctacctttaaaatttataaaaagaacatcaccttcatattccatgccatgtgcctgaaagtttccttcccaaagtttattaactatgagttttcaattaataatggaacatatgtcataagttatttatggttatagtctctttggtggttttaattcatatcttcctagttgtaatatagaaatcctaggacaagtagtatacaagacaagcagtgatacaagattagcatttggcttttaacttttattcttcataaatttagtatctaaagcatgggaaagctaattaaaagtcgcattaaggaaaactaaggaacagaatatttcactcacttgggtacccagttcccaattgttcacttgttcttataacgtacatttagatagcaagaaatggagagacattatataattcataatgggttttgaaaatagttcagtgttttcatattaaaaaaatgttcaattctacttgaaaagctgagcaaagaaataaccataataataactataatcagagatagttccatgatcacctgctatgggagaaaatatgaagcttcaaagggaatacatagatcaaagataagacttctgttcttgaatttaaaatctcattgatctaactacactatttatgtggcttaaattacattttaagcagaagataacatttggaaaaggcctttgaaataactcattccatctacttatttaagaaaccaatcacataaaaaatttaaatgtaatcaacagatattttcctgactacctgctatgtgtaaggaagtatatgatgccccttaggagatgtaaatctgaggtatgtttatgcctttgatctttctgaaaacatacatttatttgtcttagtttctattttaaccataaaatattaaagctggaaaaggccttagaagcaaccctgtccaactctaatttttgcagtcaaaaaaactggccaggagaggttaagtgacttagtcaatgacataggctgtctctttgcttcctattcagcaatctcaatactaaatagcttgttttattatttatcatgtgtacaaagtataaatacacataagtgacattaataggaaaatgatgcaaacatcctatagctttaacttccctcatgttgttataaactgcattaggaagaacacccgccaaaattgataaaattcccagggctatgctcgctcaattttacgtgcacatgctcactctccctaattttgttttcattagtataggacttaacaaatttagaaattgtaatctttccactcaggcttgaactggcttaccattgcattatttatgaaggaatatttttctaaagagatta

SEQ ID NO: 6771 - DNA, 1110 bp, Homo sapiens
aaagtgtgttttcttatgttagtttctatttcctattctacctttcttgtggtcttttggtatttttttattctgtctctttaaaattaccaaataccatccctctgcatatacataaacacgcacaaaggtctttgaggcattcaaatgagtcttttattttctgtgtctatgttgtcattcagttgtactctcaaaggctcatttccacttttctactgccccctgcccccactatcacaaactgtcatcagcaaacatggaaatttggaaaaaggacaaatttatagcatatcaaggattcatatgacttgatttaatagctttcagtatcctttctgtgtatttacattttgatactctaaatgaatttggatcaggacatttcagtgaaaactttctatggtttgacttcactaggtgctgcagaagatgatcttgttttagaagtggttataatgattggaactgtatccatggatgactcttgtgctgcattgctagccaaatctggcataatccctgcactcattgaattgctaaatggtaaataaccttaatttatttttatgttaatgtctaaacagcttattgatttaaatatttaaatataaaatgcagagtctgtaatctgtttttctcattacattaattgtttcatagcaacttatataatcaagaaaaatgaattaaatatactgctaactgggattggatagagtaatatcaaagatctttagctttcaaagttaagaatgttgctgtaaagcagttcaggaccaattttacagaagtactctcctcaccaaccttgaacaaccaatatagtagtcacaacttaatcaaggggaatacattccaagacccccagcagatgcctgaaactacagatactatcaaaccctatatatactttttttttctaaacataccaatgataaagtttaatttataaattaggcacagtaagagattaacaaccataattaataataaaacagaaaaattataacagtatgcttagcatcactactcttatactttggagccattattaaatgaaataagggttacttgaatacaagcattgcaatactatgctagtggacc

SEQ ID NO: 6772 - DNA, 1435 bp, Homo sapiens
ttgtctctaaatttagattttgagattcactgttgtgcttctagttttattcagcaaatactgaatgagcaacaacgtctggcacaataataggtacatactcagtaaacattggaccgctggattaattattctggtcttagtttggtgaattatctagatgtaatatatttcccatcttatgtgttttcattttaatgtgtatgttcatcagagaaatttctgatatttttgtggggtttttccttctccatgcctgatacccagtgttagtcagaaatagagttgtcataactcatctgataccttaatgtttcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtaaacggcgtgaagaggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaaggtttgatagtattcttcattctcttttaaaaactttacaaagagctttatgttggttacagtttggggtttgtatattttaaatatatgtaatcaatataaaagtgattgttttatgatagcatttgcagtacaaaatatgggctagagccgtgttttctaattctgtatatgaacagacgtctctgaagtgtttctcagttattagatgagcttcatttctgttttatctgcagaattgtattggcttcatagtcacatatactgattctccccctgcttttttctgactccaagacatttaactaaacaaaatctcatttgttcacatgcattaatacctctaaaactgaactggcatagagcttaatgagtatgttggattatcataattaaatgactgcacctagttcataatttcaggtttgctgtttaatcagtttaaacatgcaagcttccatggtgtagttgatatgctattaaactgtaatttcctgg

SEQ ID NO: 6773 - DNA, 1172 bp, Homo sapiens
tgatcacaaatcatgttttgatttttacatttatactggtatttggaaatttaagtggcatattttgtagaatattgaccaactaaggtaggttaatggaatttaggaaagaattttctctgaaagttatcatagtataattttcatgatgtttgtattgacatccagagtcacagtacttggtgtctgatttttatatgcataatattttctttcttttgaagtaaaacaggctgctattgtgattttgcttattttgcttcctcagttcttaaatgcaatttttatttaacagcagtaataaaattccattcacagaacaacccttacataatttccaccaatcttttactcaggaaaaaaatgcttttaatatggagaattccacctaacaattaataacctgtattctatgtctatcatggttttgtttcgttcatttttcaaaatcctcatttcacctttttctgaacttttgttacaggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtaataaattatttcaatttaatagatgatacagaatattttggtaaaaggaaaactgtgtagtgtttctgaagatcattccaatttaggactgaagcataaatctggtttccttctatttaatttagcatgctacgcttactctttggacatattctctgtattcattagggcattttgtaacctggttctgtactcaattgtatgctgtaatttagtattagatgttgaaattggtaggttcttttttgagataggaacttgctctgttattcaggctggagtgcgttggtatgatcttggctcactgcagcgttcacctcccaggctcaagtgatcggcttacctcagcttcctgagtggctgagactacatgcgttcaccaccacaccccgctaatctttgtggggttttttgttttgtttttgtttttgtttttgtttttgagacagagtcttgctctgtctcccaggctgg

SEQ ID NO: 6774 - DNA, 1532 bp, Homo sapiens
cctttacctatatttcctatatttacctttacctatatttcctatattatacctatacctatatttcctatttccccctactcctagcccctggcagccaccattatggtttctgctttgatgaagttgattatttcatgttcctcatgtaagatatttgtcctgactgactgacttcacttaagcataatgtcctcagggtttatccatgttgtagcatatgacactatttccttcttttttatccctgaataatattctattgtatgtgtataccacattttctttatccattcagctattggatatttaggctgtttccacctcttggctattgtgagtaattctcctctaaactttttatatagcgagagaaagattctcattatggttaagagtcattgctttctgttttagagggattattttgctatatacttacgcatgggaaagattgctttgttgattatacctttgaattcttatcatcataggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccgctcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattg

SEQ ID NO: 6775 - DNA, 1130 bp, Homo sapiens
cttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttccgggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggtgagtactttgttttaaatatagttgcttttgcacctttaaagaagctaaaagtagagttcttggttgaattatgcaaagagccagtctagataaaggaccaaaaaacattgttcttcccaaatgctttattctctgttctcaaagtgtaagggtgcttaaggaagagaggttaaggtgtcttaggagtctttgcctgctacgttacattttccagaagagttctcttggaaacttgtagctttgggaaaatgttcacatctaaggagggacatgtactgtgtccttatttggtaagttatctgatgagtagccctcccttctttctcagtttctcctaataaacctctaatgctacacaggtgtcctctgagatttaaattaatgttataaccatatactttgtcactctagagagaggcccagaaaacaaatccctgttctactaccaaggaca

SEQ ID NO: 6776 - DNA, 1135 bp, Homo sapiens
tggaatgcagtggcacggtctcagctcattgcaacttccacctcccaggttcaagtgattcttgtgcttcagcctcctgagtatctgggactacaggtatataccaccacacacatctaatttttgtatttttagtagagacagagttttgccatgttggccaggctggtctcaaacttccggcctcaagcagtatgcccatctcggcctccaaaagtgctgggattacagacgtgagccactgcacctggccagttttaggatttttattttcaactttaagagtatgaaatcttttcagatctttacaatgaatggccatgcaatagggtgagaaataggttatacactataagttataggaactaggcctttggctagttttttttttttttttaagtactactgtactaaacatttttattaattttcatttgaaaaacagaaaatatcttaaatcctttcccacacccacaggtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtttaaatcttgtttcaacttgttgctagttatctagatttgttgcccaaagtgtatcagcaaatgttcaaggtttttatacttgtcaaggctgttttcattattcaagtgttaaaagtgacatcatcttcccaacttttaatcattttgaccagaatcaaaggaaattttaaataaaatataaggactgtagctccttatattttgacttacagcaaagaccatctttttttttttttttaaatactgtaagttctagggtacatgtgcacaacatgcaggtttgttacatatgtatacatgtgctatgttggtgtgctgcacccattaactcatcgtttacactaggtatttctcctaatgctatccctcccccctccccccatcccacaacaggcccaggtgtgtgatgttccctgccctgtgtgcaagtgttctcgttgttcagttcctacctatgagtgagaacatgaggtgtttggttttctgtccttgcaatagtt

SEQ ID NO: 6777 - DNA, 1580 bp, Homo sapiens
cattttggcttctcatcattcaaaatcttattagcaaccctgacattttgtggtttgagtacctattttgaaaagtaaaggagccaagttagtgggagttgttaaaagttgcatttatgaactgttgcattcagctgcattattgacaaaaatggtccccgttaattttttaaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccggcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaatgtaagttgcaaaagagaagtgaggggtggggaatggcataggaatactgaggtttcttttcaattttatttatatactctttaagtgttttctagccatctcattttttattgtaggaaaaagtaatagtaatcctctcaactttcttaaaatttttgttttaagcatgtttaacaagcatattatattttatggaaataattttgtgttgatgagaaaataataggcaatgtttgggggggtcttgtacatgcatatctcatttgattacagtttgtggacactgcatttttaaaaattaaaagttcatggtaactgtcaagcaagtcttctggtgtcatttttccaacagcatgtggtcatttcatgttctgtgtcacattttggtcattcttgcaatatgtcaaatttttcatcatttatctgttatggtggtcagttatctttgatattgtaattgtttcagggtaccatgaacacccaaataagatagtgaacttaa

SEQ ID NO: 6778 - DNA, 2714 bp, Homo sapiens
gttttaagtgttacatgtatgtttttagatttgcaagcaggttccctaaataaaatttaatatgagagggcagaccttgaaaaggtggtgggaggtggtcctgtggttttttttttttttttaaatcacatgaaatatttcaaaaataggaagaaatctattcattaaaagctcaaagatcaatgaggtacttttggctttggccaaaccagtgtggggaaaactgatttgtgattggtaaaagaatttgaaccaagattgatttgacaggctttggtaatgctgcagtattttcagttgttctttctcattttttaaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcatcttcagtcagaatttatatataaatgtatgcacccatttttttgagtgcatataatttagacctaaaaatccttatgattagatgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgattcttggagcttataatcatttcctaaaatctgaagcaagagggtttgtcatgtattaaaaatagtggtcaagagtactggccagtcgcagtggctcatgcctgtaatcctagcactttgggaggccgaggcgggtgaattgcctgagctcaggagtacgagaccagcctgggcaacatggtgaaaccccatctctactaaaaatacaaaaaaaaagtacattatacagccgggagcaatggctcatgcctgtaatcctaacactttgggaggccaagggaggtggatcacctgaggtcaggagtttgagaccagcctggccagcatggcaaaaccctgtctctactaaaaatacaaaaattagctggcctggtggcaggtgcctataatcccagctacttgggaagctgaggcaggagaattgcttgaacctggggcgggagtcagaggttgcaatgagccaacatcaa

SEQ ID NO: 6779 - DNA, 1174 bp, Homo sapiens
aagctatggctatgccattatttatttaagatgccaatgttagacatttaggttgttttatgatattttttgcttctcctttcccattgattatttattacctcagataaaagttcagtcaatcctcattacccatttctaaaagtagacacaactacatttaggaatattgcttcaaacatagcatatatatctgatgttgatatattgcttttttcatgttttctcttacagttcttatagtcatgaaataccgtacttgatttgatgacagagatcttcattaaacaagatctgggacagtaataaaagattgctgcataatttaaatgaaacctatgtgtatataactttcaaaacttctttttcaagaaactaagaggcaagtatcacttcaaattggaacgttgagaatgtccaattatcttctccctttctaacaaaatgttcttttaataattatgtttaaggcaaagagaactagcctctatttttccatatttcaaggatctaatttgaaactagatacttgccagttcattatttgtgtatataaacactgattataatatttcatattaatattttaatggcataaggacttgcattattgcattagggagcgggtcatgctgggggtcaggaagcctgtgtagagtaccaaattatatgctgaaagagatgcataaccattctgtcaatatttgcagaaatatagttcctttcatattacagttgttttgcaagcaatttccacatttataggtgtaacaaaagctaaatgttgtaaatgttgttgccctcaggtataactaaaaacattccagtaaatatatttttgactgtgtaagagaatgtgtagtaatttttttggcattggattatggaaatggaaatttttaaacagtgtgaaaaaacatggtatggcatcataaaactggagataataaagttattgaagagtgtcattggagtatttgaaaatgaccaatatatagctgccagtcatggtccagtctgttttctgttaaactccaataaagagagaccagtcagtcctaatgtgagtaaatgaaatttacaggtaacttacttactccttaattttattttagttaatagcctctaacttccaactatctcatttaccaaaagtacaaaaagtagcaaaacc

SEQ ID NO: 6780 - DNA, 1244 bp, Homo sapiens
aaaaaaaaaaaaaagtaattgcagtagcctgaatgaggtggtattgacttagagtaggattctaaaagtggagaacagtgtaaacttgttgaattcagaatatttgtaagttgtagaaagataagccttaaggaactaaggttgatctctaagttttgggcttacgtaactgggtggttgatagttcattttataagatgggaaagactgggtaaaagcacaattattttttctccttgaggaggagatagtgtaaatggaaagacaaacaaaatgtgacaaaatgttaacaattggtgagatagataaaggtgtaaatatatttcttgttttatttctaaaacttccataggtttcactcctatagaaagaattggaatgctgcaaagaattttttttctttaatgtcatagtttattttcaaagagcatgccctgcatttctggtctttgaagcacattaaaaaaatacttaaaatgatttgtcctttgaattttagatacccttatatttttcctaatatgatttcctatgattattatttaaccctcttctcatctcaggtttcagatcgacaaagctatcttgtcatatctttggttctttgtgttgtcttgggactgatgctttgtatgcagcgttgtcgaaatacttctcaatttgatggagattatatttcaaaacttcctaaaagtaatcagtatccaagccctaaaaggtaatatcagcattatatttcacaattttattttttttactatgctttgtatatttttgagaaattttaagcaaataaagggagactgaggtaatttctttccctatatgattatcttgaaaccaaaacattaaaaacatcattcgatagtaagatggtcctatgcctaacctggctctgtagactataatagagaaaacactaatagtaagtgcatgaaacccctgaaatatttggttgagaaagatgcttaaatgtggaattcaaaggaagaagagaatactattttaatacagtaccttttagacaaagatctctaaatttttttttccacctgtattagcaataactggagtgttagagttagtcccgtgtggtatgtacagttctcaataacctctgtgtagcctcaacaaaagagtaaattatatgtgctttactcgttgtaaccaatatgtatttttcctaatgtgttaggtgtttctcttcctatgatgatatgaatttgaaaagaagaacttcattc

SEQ ID NO: 6781 - DNA, 1242 bp, Homo sapiens
ctaatacagactaagtcgggatcattgccgagcctgcatgacataatcaaaggaaacaaagagatcaccgtgggaacatttggtgttacagcagtctcgggacatatctaaaattaattgaacttttcatacagaagacttttttgttgttgttctttgaagaacagtctgtagtatttgaagggtttgggggagggagaaaatattaatgggaaaggcattcagaaattatggtttctacctttttaaaaagtagatgggattgtgtcaatcttggttaatgagctacagttttacaaagctgatcacttcctataaggacaatggtagacattttataaagatgttttttcacaagattaattactgggacaaaagtaatttggaagcccagttccttaggtgggataggaatgaaagcctaaacctcttcctttagctttgttcctatttcttgcaccttcccatatttatgtgccttttgtctatttataatgccactggaagaggagggataactttttctgttatttgatttcttttataactttgttaggtttttgaagctgcaaacactacaatgctttgagggggtctgtgcctgaagctcaggagtgtggatcagacagtctaaagatcctaaaaacttgccaactggatctttgtttagcaaactcactggaaatgaacacttaatggaatttttaagtctgttctgttaggtagatggtgatgctcttgttattttcacttattcagactggattacttcttacttagttactaactcaatgaggaaaaatccctacaggatctttttttgcaaacaactgatatatgcagacaaatttttgacaaattcaccttttaaacacacttaaccatttgtgaaggttttctttagcttacattttaaacatacacaataaacactaatcctccaaactttcactgtttttattagtatgaatataaaatttgaaggtttggccaattagtacaagtctcatgatataatcactgcctgcatacatatgcacagatccagttagtgagtttgtcaagcttaatctaattggttaagtctaaagagattattattccttgatgtttgctttgtattggctacaaatgtgcagaggtaatacatatgtgatgtcgatgtctctgtctttttttttgtctttaaaaaataattggcagcaactgtatttgaataaaatgatttcttagtatgattgt

SEQ ID NO: 6782 - DNA, 1537 bp, Homo sapiens
ccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactgggtcagagaattctgttgtcatattttgaagtatcagatttatgtcctaaagggcagaggcttccttcttcctaggattggcatgagtaatttcttccaaagacagatacataagattttatataatgaaaatggaggaacagctgaagaacgtgtgatgtcaccacatatcttggtccactttgctccttcatgttacttgtttggatcctacagtcccatgatgttatgatccctggtataaagagctctcttaacctaattccttaatgggattgctgggtgtaggaatgtgaacctcaaagataatggtacatctgtgctttttgctgctctgaactaatactctctcagactttgattatactctactaataagtgccaggtttagaaaagggtgtcccatttacgatgtcttagtctgcttgggctgctatagcaaaaatactacagactgggtggcttaaacaacaaacatttctcaca

SEQ ID NO: 6783 - DNA, 1223 bp, Homo sapiens
tccacaagtgggttcacaagagacacaaacgcacccaggaagacctccgctccctcagacgcggggcgggccctgcgacttcactctgggagggacatttccgctcacccagctctgcgaccctcgctcctgcggagtcagcttctgctcgcggagggggaagggcaaaaggacagtgcgtcccaacccgtccctctccagctgagcctgtcagagaccagcccagctctgaaatcaagccgttgagaaaagggaattcggccctccgccgcctcttcagtttaaaatcgtttcccgactcgctctgcggccccacgcaggaagcctccttggcgcctcgccgattccgtatcagtgaagcaactaaaattgccattttaactgagggcaaggccgagccacttaaccactatcgtcaacctttccaatcgtgctcggttgctcctcagttttcctaccggtgcgaagctttctctcaaatttccgcccgtagtaggcatggcggcggcacctcaccactgattcgttgaattccttcccggtaatcttgggcactagcgggcggagttgaagggcgcttggaccccagcggcgatctgtgtttgggttcgcgctctgggagaattttggctttgctcgccttcctctttcagaagactcgaaatcggccagcaggtctgcgagatttgaaacgcgactgttactccttgttttccggttctggccgcgggagcctctcgagaagcgtggaaagaggagaagggcgtataccttgtgaccgcctctggttgtcttgggctcgcgcctggcgccgctacgtggagtcgctctctcgtcgtcacttttggctgccgacttgttgagtagaagtgcagactgatgctttaagactcagggagaggtctttcccttatctccaccccagcaagcaccccagagaccttggagatttgtcttgtttctagacacgtgtactccaatgttgtgcggaggaggccttaaatattcgagaagagagtgggaactcctggaattttaagggatttctgtgtatttccaaaactgacttttaactaccggcagcgtgggatttcgtgattgtttttcgccatcgtgtggctccaacatgtacttcccttcttggttaagtcagctgtacaggggtttatccagacccatcagaaggaccacccaaccgatctggggttctctctacagaagtc

SEQ ID NO: 6784 - DNA, 1218 bp, Homo sapiens
ggtggtgcgtgctggtggtcccagctactcaggaggctgaggtgggaggatcatctgatcctgaggaggtctaggctgtagtgagccgtgatcacaccactgcactccagcctgagtgagagaccctgtctcaaaacaaaaacaaaaacagatagttctgttagaccagcactgcctaagtatttgattgtctagaatataattgtaagattaggatccagggtatagtataagtgggctcagtttctcctcacattactgtaaaatagtacattcagcaggggtttaataagcatccagtttgtcagccagaaagtaactttactgtgttgttcttttatagtaatggaatagagtagtctcaattttttaaaaattattatggtaatatctttactttttggtaataattttctgtttgatccgccactaaaaaggtacatatatcttagtaacaagtaaaaatagatttgattgcttttaatatgtatgcttaataatatttgttctttcttggttattttccttacctggtacaggtagaagagtcagcaatgatgggagtaagtggctatgtggagtatctccgagagcaggaagtatctgagcggtggttccggtacaaccctcgtctcacctgcatctattgcgccaaatctttcaaccagaagggaagcctggaccgccacatgcgcctacacatggggatcacaccattcgtctgccgcatgtgtggcaagaagtatacccggaaagatcagctggagtatcatatccgcaagcacacaggcaacaagccctttcactgtcatgtctgtggcaaaagtttccccttccaggccatcttgaatcagcactttcgcaaaaaccaccctggctgtatacccctggaggggcctcacagcatctcccctgaaacaactgtcacatctcgaggacaagctgaggaagagtcaccttcacaggaagagacagttgctcctggggaagctgtccagggctctgtgtccaccactgggccagactgaaacatccagggggagggggctgaccctcttcccctatgagccataagcagccagcatcagagccatgggctgatacttagattcacaaaatgccacatcactaggccagaagatgctcccaagatgttgccaaactggaggatcagcaacttacacaaaagcactaaaggctcctcccttcttattgccc

SEQ ID NO: 6785 - DNA, 1180 bp, Homo sapiens
ggtatatttaacaagacaaaaataatcttggttaataaaggagcccatgagatttgagtcaggttgtaagtgaaatcacttacacttttggatagaatttatactcctgctcttataaatcagtggtagacttaccattttttaaagttttcttgcatttttttgtttttttattgccacagctccctattctttcttgcctgcctccacccccctgttcaggaaaaaaaaaaattgagccttaaagtgacagctgattttttaattgctgaattttgtgaaattttactttttccaagtgtttccaactttaaaaagagaagtgaagacaaataggttggaatggtgaagacaaatggattggaatttcacaggctgtgaataattccttaggatctggcaaaccgtgaagtcttatttgaagaccttatctcctgagagttcttttggagtaggaaaaagaaccctatttgaaatagaccgtttttctcttgtttttaatctgtttaatatttctgatttttaagcagctttcaaaacaagtgtggtggaaaaaaagaaatagtagtaggaagatgtttagggcagcagaactctgggtctaaataagtacatgttcccacttgttgccgatttttgagagtactagggccatctttctcaattttgtattatttgtgtgcatgtttatatcaaagatgcccattttgttaaaatgctatttcctttattaccttggaaactgactcagcctcatgttgctcctaattagtgtttaaggctcccatgagttgcagataaaatgatttattttaacaagtagaaggaggtgattcaccttttggattgtaaatatatgaaaatgtctacaaggtctttatctgctttctgtcagcatttatattaaatgataaattaatgaggaacgtgtgtattttgtaaatgagtgtgtgccatcttattctaatcttgagattactttcttacacgtttttaatggagggggcttttttaggtgaaaaataaagaaatggctaatctgcatgagcaaacacatacttggagtagccaattttgtgtggacatcacaggaattagtccaatcttaaataagctacagtcatattccttcatttgtcacacagtgattgcacattaggagtgagggtagtggttctga

SEQ ID NO: 6786 - DNA, 1265 bp, Homo sapiens
ttataaaatgtaaaagtaatgaaaattcatcagtttctctaagccagtgaatgtcgtcttttgtaatattgtgtataagcatttgtgcccaccccagcttctgctatcactgtggtcaagtcatgggtctgagtaaaagaattcttgagtatgtgactggtgagaaataactaactatagtcagtacatgtacagattgttaaaattcaagacaaaatactttcactaaaaaaaaggattcgtctcagtaaagaagtattcagttgctgtcacttacatacaaatggtggtgggtagcagtctcaccatttttctactctctttttgctcgttttaaataattgagtaaaggttttatttgtaaaatctatctgtaaaaagcacctgtaacgatttatatgtcattgaaaggaatggcccagttactttttaggagagattaataacctacctggaaattaactgcagtgtttacttagattttttccccctaataagagtctaagtgtgttaaatttttaactgatgatatggttacagtgttgcaaggtgatctcttcccctgaaaaatctgcctatccttttaagaaaaattagacctactaaactaaagcaaattttactttcatcattagcacctaaacaagcaagcagtctactactgtcatcattttacctgagtgcccattttgctgatccacattcatacctttctaccttggacagctatgatttttatatttatttgttgcttcagctcaggtttatgaaattttcctgctgaaatgacttattgggagttgtaggttgattatagttactattaaacattttctcaatttagcttttctgagccacttcaagaagaaagctgtttttgtcaaaaggtactattaattgtagcaagtaaatcttaagatttgaatttttaagattttatttctgtgttcactaaagatctttccacaagtaatagattataattgataagtaatactagctatagtgttaataaagagtaagactatcaccaccaggaataagtaacaccttttaataataaatctattcctaataggtatgttttcaatactgcactgaacaaagtgggtaaagagccctttgaaatcttattgtaataaagggacttacctcaccactggaatccttgttttcagagcctctggattttcagccaaacactgaatttctcctaaactttatccctgaaacatccctagagaacgaactttattttcacaaga

SEQ ID NO: 6787 - DNA, 1248 bp, Homo sapiens
gcagaaggatggtatattgtcccattgtgcctataatgtattttaaattggtcattccaccttacctaatggaaattcttgcagctttcctagtgctcatcagcggttttaggaattcactaacacccccaaaatttgttttttgttttttgctttttttccttttccttttctctgtgatatcatgagcctgtaaggacaaatggcatatttgggcataactgcttgactctgtaactacttttttaaaatcaaaattgaaaaggtattaattgcttctggctttttaatttttttttttagagacaaagatgaaaccagataggaaatacagtttttatgttttctacttactaaaatattagtttcttctaaatattactttatttgtatttcactaaattccaaagcaaaaatcagatatctgagatgaacaattttgaatgggttaaggtaggagtaataagcattgtgttcactcatacataggtgagggaattttatttatagcgagaaatataaaagtattttgacttactcttttttcaaggagtcgctaggaaagggtagaagaactgagaataagacatctagattccatttctggtttatatgtagctcttttgcctaatttatatataattttgtcataagataagtccagtaactgtcctgtcttagataacgtacagaggctgaagtgaccaaagatccattccttattacttttctaattaaaagaagagttagctagatttctagtagtagtattctagatattgataagacattattcctaatgccaactacaaatattcaactactcagaatgtatttaaaaaattgtttggtacagcattaatgttggtgattcctttctcccatcttatttcccttcccttctattctttcccatgtatttcttttgcctaaaagaatattggtatgattctcatttgctactttgagtatataactccatcagactttccagagttcttcagggatggagctcaaagtttacatttttccatatatgtctttttttttcttgacctttttccaccctgtaatttccccttgacttacccactgccctccccaatctgcaacagtgacagtttgctgcctcaaaacagagcattcaaatgaattcgcttagccaataacttctgtgaagttgccttttctaatggtgttattactcagtgatgcacaaatgtggtatttgccctactggtaggcaaa

SEQ ID NO: 6788 - DNA, 1696 bp, Homo sapiens
gcattctcttaatataatcagaaagctgattcagtgtttaattagatttaaatgttgatcaagaattaactgtaacttactagcactgaaaatacatgtttggtgtttcgcctgcgttcagctcatggttggaaatttgaagcagtgcttttcaaattaaacttttgctgacatcataggatgctaaaaaacaaggacaatcaactatgttttaaaactgcaacatttgatttgaacttaaaatgaatagagccacattattttaatggatgttttgttttacttgtgaactgattgagtcttaaggatagtttatgaattgatcacttgttgctcagaatcattagtataagtaggtaggaaatagtttgaagtcatttttcatagacttaactgtccaatgttgcaaatgtttcttcatgaaaatattgaaaagagtaaggttttttttttttttaattctgctgcacatattctgatgccatgtgtctgtgcttaattaactaagaccctataaaacgtgtttagtggggactgtttgatatagttgccctctccattcctctatttgcctgatttttttcagtttccctttctgtattttactactaaattagaaagcactggttatgtaataagttactacattgctttggttgagtaaaaacaagagtttatatttttcttgtttcttattttcttaacccttaactcctgctgaggtcataacaacctcagtctaagctctgtgtccatcatactgttaacttaaacaaatgggtggtgggggtgggaagggtaatacagtcctgccattgcctaccagtaggagagtccaaacagaacactcttttgagtagcaattatttaatttgcccagtcaaggcaccgtgtttatatactatttcacattgaatttgattatgccctacagacctggctggtcaaggatttgatatacacatattggcttgggattcgagctttcttttttatttaaataaaaatttatatatatattatatatatacatatatacatagctatatctgtatatatattgggtatgttttaaggattttttcgcatgagcgcagctgttgcgataaattgaccgattgggaggtggtagaagcactgaatgaaggtgaggctttttttttttccagttttcttatacatttgtcttctttttttaaaaaaaaaaaaaaaaatatatatatatatatatatatatatatatatgtatgctttttcttttttttttggcttttgtttgctttttgacttttacttaaaacccttttacatttccactttaaatgcctattgtttattgggagaaggaaagaaacttttgtatgtctgacagagtcccaagatttttcatttctctgcataacagtaaaaggcaacattattggcctccaaccttctttttttttttttttttttttttttggagagggagtctgcttctgttgcccaggctggagtgcagtgggttgatctcggctcgctacaacctccacctcccgggttcaagcgattctcctgcctcagcctcctgagtagctgggactacaggcacgcgccaccacgtccagctaatttttgtactacaaccttcttataagcagatttggactgatcttctcctttgggtatgtcagatcatcctaaattttagaagcag

SEQ ID NO: 6789 - DNA, 1193 bp, Homo sapiens
tttttagtagagacagggtttcaccatgttggccaggctgatctccaactcctgagctcaagtgatccacctgccttggcctccgaaagtgctgggattataggcatgagctcaaaattatttcttgtagtagcaaacctgctaaatcagggataagtactcttcttaaaggccaggtagtaagtattttaagatacgggccttacagtttttgtcgcaattctcaactctgctctgtggtttgaaagcagtggataatacgttaaacaaatgaccaggctatattccaataaaactttagttacaaaaatatgcacctgaaaaaaaaaatacgcacctggctagctttagtttgccaactgtgtgctaaaacatggataaggggctgtagattaaaatgtggaagccatttatatattttcaatcatgctaaattatatcccctgttgattttattgtagtaatcatttttctctctctcctttttcaaaattttaaaatgtcagcagtgatgtaccaaatggatcagccttgacacaagagaatatcagcctcctatcaaacaagaccagctctctgaacctgtcagaggaccctgagggaggaggggataataatgactcccagagatcaggagttactcccagttctgctccttaaaatatgaggagtcctacttttatcttctgctcctaatcagtttgtcgggcataggggtaggagaacgcataacttctaaactttttctcttaagagcggtcagagaaatccaggaaattcaccagaggcaatgtgcacaaacaccactactaaaaacaaaccctgcacatagttcacattaatgcatttttttaatttaaagaaaaagaaaattagcagtatctgcaagcaattcagattaaatttgtttttgttctgtgaatgaactttattttaataactttggacgccttggatccagggctttaaaaaaaaaagatattatatatacactctgtttgattaattgtatgatcttaatgaagtaggttttcttgtattttggtattacatacccagtgtataatttgtataattcctcacccccaatccttatcaattctcaccaccccataaacttaaaacagaccaaaaatgtcagctttcagagaattctgtggtgcttgagaaacagacagtactagactgagtta

SEQ ID NO: 6790 - DNA, 1213 bp, Homo sapiens
ctttttggtgttaataagtgataatgtgtcaggaaagagaagctatatgtcttaggatgttgaattctgtattagtcaactttagttactcagaaaaaatatttgcaggtacaatattcggtcttgaggagataagtttttttttgaagcatttagatttaattaatatagcagtgtcagtgaatatggttttgtgtctgtgtgtgcatttgtaggtatttctagtatcatttaattatttcctctattaaaaagaaaacagtatttctaagagaaatgagagtgagtgtgtcaggtaaacagtgataaatctggttgagatatggactggtttgtgtaaatttttaggtaacaatatggctctattagtctggaaacttaggatgaagagagagtacatttccattaagtggctcagtccaagaaggtagcctccctaactttgagataattatctagccagcaggattcttcttcacataaaccatttttaaagctttattagttcatgtttttaattagttcatgtttttaatcagtaggtttttttttttaatcccttttgtttttccaggtggttgtgggaagagaagtttgcagaactgaaatggaggtcagagcttcattacagaaggttagtggatcatctgattctgtggctacaatgaacagtgaagaatttgttttggttcctcagtatgcagatgataattctacaaaacatgaagaaaaacctcaactgaaggtatttttttcttttctacatatggtataatttttaattaaaaactatttgaaacttaggagatgtgtaaaatgcaaaggtttttctcaagtgctgactttcaaaataaaatcaatgtttgatttatccagaccctaattatttggtttgtgtattttaaaaagttcttgcttttggttgtttaccttttgatttggaattttagggggaagaataaaagaagaaaaagaagagaaaggattttttggtgaattagacataatggttaaattttacattactttatctggatgtttttgtttctcttactgctgggttttagaagttaattaaatgttttgctttcacttgagagacttttttctttatgatttttatgttttaaatcagctggtaacgttccgttgtgtgatttaacagtcgacttgtctaaatgtttttaaagcatatcttatatttttagcattt

SEQ ID NO: 6791 - DNA, 1247 bp, Homo sapiens
tgcctcctatttagatgattaaagttaaagctaatttattttctctgttttcattactaacgtaaaatttttaggtggccagtagaaagaattcctaacagccaaaatctctggtcttttagaatgtcattttaaaccacttttctctcatcttcttatacatatttgctccgactctacctttcactgtgggtttcatttaccctggaacctaggttactaggggctgcaggaagtacctggtgcagggaatactagtacccattctttcatagccaggaaaaaggggagagggtgttggaatatacacaaacaagtcaaagttggggagacttgagtgcatcaagtcgataagtctttgccaagtcctgcctactgagggatgctcagtttctacagggcagggaagacacctttggtaagaaaataatttaccttctagcattgacccccttatcaatcccttatcctcctttagaagaattgaattgcctgtggttagcttctaacttccccaaagcatgtagtactctgcagcctgggttgtaaggcttataatgagtgtttgccctagtctggggattctttttaccataagtggtgtgtctgatggaaactgcctccctctggaagatatatatcatgaactctcattgtttcagtgtaacttctagtctcacaaattcatggagtgaaagtcagagagtgaaatttagcttagtttctatggggatgtgagtaatctttagggattattaaaacaatatactttttttccccccaagttttcccttgctcctctttttctagctcttcccccattcacctatggaatcatctgcattcattatttcaggagagaggtagatacagtctaaaatgtaggagtaattgctcagctctgagacttacattttataaaaataaattcttatcttaatgtaaaatacttcttcaggaacaaaattcaaaagatccaaaaggatctaattgtacataaatctcctccttctttctccccaacccaccagcattctttctctttgtcattcagttctgtatacacaaacagtacatagtttacactcttgtacaccttgcttttttcaagtaatacctttgctatagttctagattggtacatattaaactacctcattctttttaattagttatagtaatcatatcttactggtagatattacttcagttcctcatcttatgctttcacaaatgatgctgcggtg

SEQ ID NO: 6792 - DNA, 1140 bp, Homo sapiens
agtatttcatttaacgttgatatatacttgctaaggaaacactaacaatactgtaactttgttaaaggacatagtattgaaatgggaaatagaggtcaggctcacatcatcttagtttaatgctgggcaactttttctgatttctgtagttccctgaaaatgtgtccttcgtacccataaagagatacaaatgcatttgtaacatttttgattgaatataaaacctttacagaaatacttatctcatggaaaggtaaagctattgtttaaaaattagtggaaatattttttcaattatatttaacatgcctataaaaatagtccttgcaggaaattatttgataagagcaaaactatttttattttataaactattttggaggcctctgatcctttcaaaccaaccaaactactattagatatgtacaataacatttgttgatattaatcattggcctcattgttgaacatattatttgcaaagaatcttaaactctgtagtgccagaatgattctcatctgtgccatattttgcaattaaaagtaacacacccttagaagaatcaaataagagccatctacatcccaggaggatgcaccaagttgctcacagtggatcttttcctctaaaatgatcttttatgttctaaaaagtgaaatcccctttatctgtgtttatattctctacagcccataaaactgatgtgattgttatgttatactcatcagataatacttttcttacataaatctttcattgttgttctgacatctttcattacaaaatttattttcttaacaaaaaggaacataacccagcattccaagtgtctgtgttggctttaacattctctacatggtggtctagataagctaatttttttttttttttttttgtaaaatgtaatagctagaaaatgttatcttggcgcttgtttttgtaaatcatttagtataggctgttagctttactggtactttacgctttgattccaagaagccttgtgcagttgccttatcaaatggccagctaaattaaagatgctcttttgtgttgtgaatttcatagttctgtacagagcttgtttcaatttacaaaaataagtacattccacagaatgcctaaagtgtgtaattttc

SEQ ID NO: 6793 - DNA, 1823 bp, Homo sapiens
gtcaggagtttgagaccagcctggccaacatggtgaaactctgtctctactaaaaatacaaaaattagccgggcatggtggcatgtgcctgtaatcccagctactcgggaggctgaggcagacagaattgtttgaacctgggaggcggaggttgcagtgaaccgagatgcgccactgcactccagcctgggcaacagagcaggactgtctcaaaaaaaaaaaaaaaaaaaaaatcatgggaaatccctgtgcctaaaaatagcccctaactattttgatgacctctttcgtgcaccaagtgtgtgcatgcttgatacgtgtgtgttgttttcattaagatgaatttgtgcgtgccgttttgattgtaaatatctttgggtactctgtcttccttcttatccctctacttcctgccagtgttaacaacctgaatgatagtatcttccggtgctttcgtttccccattgttgtatatgttttctttttaaaggaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcctgcaaagatggttttattagtaccctggtcattttgttcaaggaagggttatattgcattctcacgtgaaatataaaaagcaagtcttgcccaataaaaacgctacattgtgtgtattttttgttcagctaagaattggaaaagtatttgcttgccttttaagttactgacatcagcttccaccagtgtaaaaattgagtaaaacctgaagttttgcataaaatgcaaatcggtgcctgtgcttgaaggttgctgtagagcatctgaccccttattaccaccttaagcaatgtatatgccatgcattaccatgcactaattcaatcacaggtgtttctatctagatttaaatatatttgtcaatgaatgtggaatagaaaatctaaacatgacaataatagacatatctttgtatggtaccagttagttttgccgtggatcagatggtttataaaagtaataaccataaagcaaaaaataatttgaaagcccgtctattcctatgctcaataaagttaagtttttcttcattagaacagttttatgatttatttgtctaggagtatgtcagaaaaatcaggcttttagtaggaattactcctattccccctgaagtcaggaccagtgcctgtgatctccattactttattttcctggaggtattagccaacacagttagatcagagaaagcaattgaagccaggcatgaaggctggcgcccgtaatcccagctactaaggctggaggatcacttcagcccaggagtttaaggctgcagtgagctatgatgatgccactgtactgcagcttgggtaacagattgagaacctgtctcattaaaaaaaaaaaaaaaaaaaaagccgttagacacacaggaaaaatccagaagggtaaactaaactaaagctacaattaatatgggaatttggaagaagtggtaggatttaaaatacagaaacagtttatgtataggatagctataagtaa

SEQ ID NO: 6794 - DNA, 1279 bp, Homo sapiens
ggagttttctaagataatatgtatgtgtttggggagtgagagttttactacaaaataaaagagttttaaataaaaaagaggtttttagaaaaagagttttaagtaaaaaaaattgtactataaaaattctactcctgttgtgcaacaaaggcctgactcctgctttgattctgtttacaggatctagaattaactgtggctttcaagcagattctaggctggggtcacaactctgtcctctgaacctgtttagtttgtcaagttcttcattggtttctctctttactacccttgtcctcaactgaccagtcttctttgtgatattttaggccaggttatgagaattcatatcagagctatcagtctcccacaatgagggaggaatatgcttatggaagttattactatcatggacacccacagtggctgcaggaagaaagaggtatggaaaagtctccaagaagcctctgggatttggggatggggcagctggtctgagaggcaggggagagaccaaaggagccatgttcagaccctcaccttgggcatcctttcttggccagacgagaccatagcagaaacactcctcctagatgtcctgagaagagatataaaggagttgttttcctttgtatgcatagatgatggtactgttactagcactatgggtagtttgtacttcatccatgttttttctcctactttgccttatagcccagattatatagtctttgaccaagtaacagtgaagtcagttcttaaggacatctgctgggctatagtaagagtgtatcacttcaccctgaggacagcagatatgcacccaaatgagtgttctaccgtatgctaataggtatagggtgtgtcttaatggcagcatctgaactgctaggaaagataaatctgtttcaacattgaacacacacacacacaccaatccccatcgttgtgcggttgtatagatccatgctaactagttcagaggggactgagaggcgtcctatggactttctttattagctctcacctatctattttttcaatttggaaaatatgtttttagatctactgtgctccaggagctcctcacagctcactaatatctttctaagaactttcagaaacaggaagtgacctgtcttgattttgttttctctgagggtgcagtgccaaggcaacggagtccttatatctggcacgaagattaccgagagcaaaagtaccttgatgaacatcattatgaaaaccagcacagtccatttggaacaaatagtgagac

SEQ ID NO: 6795 - DNA, 1194 bp, Homo sapiens
ttgtctgtggaaggagacagaaggaaattgacccactctcctatctccagacctttacctagcccctccaggtttacagaatgttgctacttcacaatggcgatgtggtgagaaactcctgaatgaagaaaggaaccttgtctttcagggcataaggcggcgacttccaaggtcaatgcttttcccccacatctctatgtacatagggaacttagttctgggccatgtacagaaaatatcactgtaatataccaaaaggaagttaataatgtagattacctttttgattattgctatttttattattgttttcctcttgttgaaagcactgcagttgttacaggaagtaaagtaggaactgttgtgtgagcgagacatgagcctgtaggttcagtaggtagagaccaagcatctatctgatagaagcacatggagtgcaataggacattgtgagaaggaatttttcagggattcatctactagtttaaaaaccccactctggccctcttgtcctttcagaaaacatgcaaataccaagatccatacaaaacaataatttattccactgatcaaccaagactggttctggttggacagctaatctgatttggggattcactgtttcagaggacacagacaaaagctgttgcatcaaaactggactttaggagtaatttctattgaactcctgtcaatatgtttatttcctctgtctacagcagatgggagtcttctcttttagacaggggctttttgtttttaaccccaattgtaataaagggtgttctttttcctctttagagtttacaaaactataaatatttgtgtctccacataccatcttcatcttcacacattcactgtgctttcctccccatagtgggagctgtcatcaccaacagggtttactctcccctggagaggttatttaaatagctgtccataagccatccagatcaacaccctttcttccatacagaaaagggctaaccataccacagctggaatctctgaatatttcctattaaaaattttttctatgtgttgttataatttttgtttgggataaagactctatccattgtactagcaaatctatggggggtaattttatctccatctttaacttttaaagtacttcttccccttatcccctcaataaagaaaggaaatccaaatttgaagcatcactct

SEQ ID NO: 6796 - DNA, 1717 bp, Homo sapiens
gagagcagagttcttctttggaagtcccagagcaaaataactgccatcaagtgagtttgcattcgtatttgtttccccttccatagagggttagttttagttacctctagcttggagttcctgagaaggctggttataggactgagcgtgggaaaggaaccctcttcaggattacctcagtcccatcagtctaccccattgtgacattgagcccaacacacacgcttgacaccagactagacttgtcacagggccaaacccaacagccacatgccatagcttcactgcattttcagctacacctttggaggccaccttctcctatcaactgtggaaagccagaagggctcccttctccattctccttccctttttcaagtctaatagtgaaatctcctgcttaccccagcagtaaatagttgccttcctaccccttacctgggggccgataatttgagatactttgttttttcaatgcgtcagttgaaggatttagtttcttaaaagcaagaaatgttggagtgttgaatttttaaatagaatctcttttcatgtttgaatgattgttattagttctagaagcattctctttgtcatgacccgattatgtatactcttgggtttaggaaggacaaaagtgatgaaatttgcatgagatagaataaatatcttaggaggagtgaaagaacctgaggaagagacacgaccctaagggaatgaatgcataagcagtcttctcagtagcccagagtttccaggaaacaggaatatttatatcccttgcccactcttaaaatacatagatacataaaaaggcagtctctgtagacaacacatgcacacacccacacaaaacataattcctggggcttcctttttctgaatgttaatccattttatcgagcagtgattcccaaactttgagattttcagattttatgctctcgtctgttagattttatgacattctatcatcctaaaaaatgtactatatgtgttatatgtatatataagttaaagcaacttgaaattgacttggtttggcattgtctcaagaaccctagatatcattattgataccatggggaatcatagaaataaagttgaatatcattgatctgagagtaggatccagaaataagtagtttcagttcctgatcagttaagcctcaagtgtttgagtaaccaacacagcaagacttgggaaatgcagtgagcacccgaggaaaggaaagtggtagtctttgcctgcatttcagcatgcattttcctttcctactcagttgctatcttccacttaaataccctcatttgaccctaggaagttttttgtttttttttttagtttgagacttaaaaccagatttatttgttgttgtagagagatttccacagaagttgtgttttagggacctccatcatctttgtgggggtacagatatttatgtgtaaatatcattttatgtgatttccaaattttcgagggaaacatttcaattcccagttcaacaaaaggttaaatactaattgactcaatgaccaccttcaggaaagttaaatagtaaattaggttaaattttgactggtgcttagacatttcctagttatattaacttaagcagacagcagcacattaacctgagttacacctgtgaggaaatgaccttctaaatttgattttgtttttcatctccagggccttaataagagtgtgtta

SEQ ID NO: 6797 - DNA, 1197 bp, Homo sapiens
tagagacttcagaaaagtcccctaatgtctctgcctgtgctttcgtctcattggggaagggggatgaggaaggggagaagctgtacatgtcacggacactccaaaagccacctcacccaagtctagcgaggattcttgaggaagtaagatgcagaatggtttgcagagaggcaggaggaaggtatttccaaagtccttcaaaatgaagatgctagttctgaattctctctcgaaggaaatgcagaaagatatggatgagaagatggacattttaataaatacacagaagaactataagctgtaagtgtaacctgcactcgtctctcctcatccctaaagggtctcctcccttccctttgttggatccctttggggttcagaggacacccagactcttggaggagttgtctttgctcctactgcccctgtgacttggagtcaaggccttccatggccacccgtgtactggttatctccttgtcatgctgcaaaatgtctccccaactctctgcccctccctggccctcctcccccagtccccttagaagagcaccaaaggagcagcaggaactcaggctgatgggaaagactcacagagaaccacagctcaggcccaagaaaatggatggagccagtggagtcaatggagcaccctgtgctcttcacaagaagacgatggcaccacaaaaaacaaaacagggctcactggatccccttcatcactgtgggacctgctgcgtaagtgaaaccctgcccgagcccagcactggtgccagacccctggctccggctccctggtgacttccccgagcttgtgctgtatcatagtgaagggacaggtccgcccgctgctgacttctgggtgccgcccgagcctgcgccctccctgacctgccttgccttctaggcctgtggagcctccttagctgtgaccatgcaggacttgaccctggatgggcctacccgccagctccaccctcttattctgtccttccctttagcaagggcagataaggtgcctagcaggctgcccttcttggaccaggggaaattgatctttcttgtgccgtttctgtcctctgcaggagaaatgtttgttgtgtgctctaaagaacaactacaatcggggtaggtagattcatacaagatgtgccttttctcgatcaggtgccttgttgtccccaaggccatgtgctc

SEQ ID NO: 6798 - DNA, 1140 bp, Homo sapiens
aacttaaatttgtaatataataggaagaatagtattaattgtactatcacaaacagatcacataactaagaatggattatatgtaactctttaattaacagcattctgaatattttctgataacttgttataaagctagtttgtctttttcttaataaaaattagtttaaaaaattgtaagtaagtgtatagccttctcccctgacttccctttaccttatttgagaatcattgaactagttaaaatcatttatttctataggaaatgataggttgtcaggatgaggaaactgacacacaagaaaatgactcattcaagaacctaaaaatttaaagtcacagttttagatttcaagttgtctgaccctttatctggtactctaacaactaagcagcatgttgtgctcagcttttctgcagcatttgttaacctactgttttgttttctcagtttttaaggccaatctagtttctatcacttgattgtgagacagtatgtaaaaggctgcattttctttcactttaacagaaaagtagcagctctgaatccttaagtgacaaaggctctgaattgaagaaaagctttgatgctgtggtattcgatgttcttaaggttacaccagaagaatatgcggtaagcctcctacctctgtcttctccggttttgcacataatttacatattggtgctattgagttagaatttgtaggtccagcaaaagagacagcttttagaaacctggatatgggaattattggggaaaatagtacagctgtggagcaaacagagggatgaagtgggaaaagtaagaaaagctgtacatttttttttagggcaactttataagttacacttcaatttggtaagtagcaatatgtatttaccattatggtaattgctgtcatccctctataccatttctctaagccaactgtattttgttgacatatctaagaaacattttcactggtttttttaattaaaaaattgaaaaatgaaatatgaaggtgttattagatgaaaggtatctagaaaaacatttatttcttaatataaatttatttgttttctcattctcctttaatttgttaacagaatatattgatttcctaatgttaaaccattcctgcattccagaga

SEQ ID NO: 6799 - DNA, 1203 bp, Homo sapiens
tataaacaattaataaatataatgagagatttgaagaaagcaaagaagacttgtagacttgaaattgttctgctatacagaccagaataaaccaattgctgtgttagaagcgagttgccgctgttttgtcagtttgtattactgctgttcatcactgtgaacttctttaatatataataagataaggcttagattaggattaaggaaggtagagaagaaaagtgttgtttggtagtgtaggtgtatatgacatcagagataggaaaagaaagctcctgcctgtatctgtgatctcattatacggacagctttaacatattgggaggaaggaagagaaaagaggatgtgagtacattagaaaatagaagggtttatatatatatatcttaatacctaggagttagttttaaagtttatattgtgggttaagatataggaatagtagtgagcacttcatgtgtgactgagacttctttgtagataaccatattaggctgaatgctaatggatatgccgtattcctctaaagctgtcctcttttgagcacagagatgtctcagcaataattatcttctctttgttaggatctcccagccccattgccctctccctgcttccagtcatttacagattccatcgctttttcttttcttccctcagtctcttatctacatactagtctatattggctttttctctcttctatctgtaggtatccctacagcatcacccttagaacattccttttaagagtattggaacctacaagatgaaatttagatcaagaatttctttgcagaacaaacctacaagatataaggaagctctgacttctgtgaattcagtaattctttcatagggtaggtggtcatcagttgtgggattttgccctccctgtgcttccaaaataaatgcaagtgaaaattgggcttagtagtttcatagtttaaaattaatcaatgaatattctttcaaatacacttataatgactgttaagaaattgcctttatatatgatttactatttgaagatttctctttactacgtgattttaaaattgcaagttaaatccattgtaacaaattttaaggggtatcaaggctgctaaatttcatttagcctttgctaaaatggaggcttatttacatagtatactcaaaacagttttattcctaagtcatacccttgaaaaaagcatcctt

SEQ ID NO: 6800 - DNA, 1104 bp, Homo sapiens
tgcaaagtttgtataagtggctttattcctcttctagaagatttatgaggagcctaggaagcactattggtacaggaggaaaaaagaatggaaaacatgtttacagactctagctttccttattagcttaaactggggccctcaaagagcagcctgttgatcttttggccaaatgacttgagcataagtcttttatttctttttaaggttaaatcgtaaactgtatacctttactactgaaaacaaaactatagggcatcatactaattgaaaatcaatagtaatgggttccatccattagctttttaaatgaatagatctggtattgatttccttcctgtttttttgaggcacattcctttacaaccagtgtttaaaccaccacgtaatcatcttctgcaaacaaggggtgccagtgttgcctaacagaagataatctttaataaagcaaatcctctgcttcaaaggtttttgaaataattggatccctttttgaaaaggaagatgagtttaactgtgtccaggtggagtaatagtactgctgttgcatgaatagatgatacaaagcaagtgatgaggttggtatgacttctttagtgaccttttagggtttgcttttattttcctctcttttttgtattatttctttcaaacatagtaaatatatgattttacagccaaagtggtattctgttttttctaagctttgagatacaaatattgctatttaatcacattgatgatgaattactttccatgtgaaccttctcaaaatgatttaagtacctttgattttgctcccctaaaaatggcttgtgtctaaagtgacatttttttccctatttggagggttctaatgaaagagatccaggcataaaaactcttttgcttattgaaagcaatttgattacacctatgtttcaggttatagtggggagaaaatttggtcagtgccttattatttgaagagcaattttagggcatcaagtatgacaataatcatgtgccctcttgctcctcttatttcaggagtgtgtgctatccctctctccaccagcttaatctttctcaccccaagtctaacaaagtctttacagaaacctc

SEQ ID NO: 6801 - DNA, 1890 bp, Homo sapiens
gtgaatttttttttaagttttgtaacactgtcctactttatttattagaatctaaggctgttacaatcaagtcgttgcagggtttggatcagctgtaagttaggtatgcctaccaaacatccaaaggtagacgtggagacattttaatactacaaaactaggaaaatcagaactcatggccatttcctgccctcctccaacttgttaaaacatgtttattctaaagttcgaatggataaatttgagtataaaggttttgttataaaactgttctttagtgtaaggctgcattgtgggtttgggggaaatgtaaataattttctgtgtaaaacaaattcataggatctgatttgctcagagtattattcaagaatgtattaataaggcattgccccctgtttgcactcagggttaatatgtcaaatgaaatttaagaaggaaatggaagaattcaggtacattaattgcatattattttgggaaagatgagtcctatacgtggcaatttttcaatgtcatctgaagccagcattatcttccaaagaaatcgatcttttttttctaaaaaaaaaaaatgcttttgccttcccttcccttcccatccgccatatttcttcagcctttcttctcgatcacccgtgtattctttgaccagtaaatgaccacacctcaatgatggtaaaacagcatcatcagtaagctatcttatatgcctcatcctgtgagtttgagcttcaggaaacatgagtaaaagtatatgtaatgtatatagtcgtatatgtattctagcaagaaaaacatatttattttgacaaaggggaacactgactttctgaaggattcagaaagaaccttagtgaaaggttctcagtctctgagagtggaccctaattaacataaagaccattcatcagcgaataactactgagcaactctagtgtgccagcacaggccagacatactagtgagccaggcacatctggccttgggaaactcatcctacaggggaaggccagtttttttcccttcaattcctcaagtctgggtggtgacaaggtaggggctaggtactggactaccacaggtttttaggaactaaggtgtttctcataaacacaaaatgttgggtgaaactgggaacaactactcagaagctcatttatttgcttaaatggaaagtgtgggagccactaccctctcttttgatctgccaaggatttcctctcagagctgttgcacagacagagattgtacttggtaagataccaaacaagacagatatggatctaaatttctaatgtgttctatgggtttcaattctgaaaaaagaaaatgaataaagattttaataaatattgatatctgatcttttcctcttctttcccccttcaggatatttccagtggttcctatttcagttcccttcctgttaggggacagaagaagattacatcttttgtgaccacttaaacttccacagggatagtttcacagtacctggtggattagacctttaaatttcctcaccagtcttcaaacggttcatactagattgtaactataccaaaattttctatgggatcattgttaggtgctttttgtatatttaatagttaactccatttttgcagcttccttagaggtaaagaattatgaatcctgaagaacttgtcagcacactacaaaaaaggcaggaagagaaggccagttgccctagtagtacttcttaggacacctagatttttaacttttgaaatagaatccagcatcataaacctcaaccaggtaactgagcaaagctcttaagatttttattgggccaggcaccatggctcatgtctgtaatcccggcactttgggaggccaaggcccgtgggtcacctgaggtcg

SEQ ID NO: 6802 - DNA, 1765 bp, Homo sapiens
cttcttcatccccatgtacatctctaactttgaaattgtttacctctcctacaaaaatcttaccttttgacctgagcagagtagcaaagccctgttcactctgagggagcagctggcgtgttgaaggggaaaggccaggcacagcactgtcctcagaccacaccatatttggagcagaattgtgatacatgtcatctgtgtctattctggaaggttctttgttcatcactgtactcgcatcagcaaattttcagggtcctacctgtcactccaggctactgagctgaaccctcagaagctgaggtctccgagcatgctaagtaaccttttagaaaagctggaggcaaactgtcgaatgctagcaggctttatgaaaggaaacataaggagtttgtgtagtcagaacttgcttaaatttgcttcggaattaggcaccataaactttagttggagaatgggacttaaattttcacatatatgtatacttaattttcagcaattatgacacaataaaaagaatatgcaaatttattgttgtttcagaaggttttgcaggactgggaacgctttagtgtcatcaacagtaaacctcagatactgttctgcacagttcagaagtaccataccaggtattgtgagtggcaagaacgccaggggacagagatgcttctggtagatgagggccagagaaaccagctctcctccattttgacagcaatttctcactgtggccatttggcctccattatgttttgagaggaatttcttgagatcttgagaaatcaccatgattaggccaattgtcaatcagtattcagaaactagaaaggaacaatgagatacttgtttatggttctttagggcatatgtttgaaaaccctctcatctcagatctgtatagctggtgtgtgtttgtgtccataaatacacgtgcattgctgtcgtgcccattaagaaagggggagtaagtaaaagaggaatcgctcagatctttccttggatgaacagcagtggcgtggttggtgtgttgactgtgaacaggctgacttagctgttgatgtatactcagaacctccatctcctcccagaccctgcacttttccttctctgcagtctgattctctaatgactgtcactggacaaaccccagttttatgctcgcttagtaaaaataagtttaaacatttcatggtggttgacagaactttgtccccaaacatgcggattcaattctttaaaactcgttgaacgtttataccaaaggtcccgccccgcaggtgtgtatgtggtgcacagagggtgaggtttggagcatcgggcactgtgtgcattgctaaggggacatagtgagacaatgtgggatttaactaaaaacacatcaattgtgtgtcacattaccagtgttgtcaggtatttgttcttaattgttattgtaatatattttcagttgtttttctaatttaattctctccgtctgttgtctgactgtgaactgctaacagtgttaaacttgatgtaaataaatgaggcccttgaaagggactgctttctctgtcttctcacaaggtttgccaagttgtgttctgttttaaataaaggttgcaatattttattggcaaagtaggctggagattggagtgtttctcccatgattttagttgacagggagtctaagcagcatttctttctctctctgtaatgcagatgtctataaggtaaagaagctgattttagcaagcatccctctggcacattcttttttttt

SEQ ID NO: 6803 - DNA, 2310 bp, Homo sapiens
tgattgtgctttacctaaagtattttcttaaaaggctttgtgtaaaatttaaatgtatatattttcctgtagacttccatcatgattttcagagattagccttaaaaaatttggccctaagaaattcattcagtgtttttctagatgacctctgtacatagaggtcattatagtggagaccctttaccagcagcattttaagatttaaattagatagaaagtttcttaggattcaactgaaaattggctagtaaaatatgtcccaggtaataaagcatgctgactttgctaaggcactgcccatttttatttaactaaagtcatggagattttgagtttaaaggatgcagtatagatagtggtttagtgtttaggctctaatgccagtctaaaaggcaagtcatttaaccttgggagcctcagtttcctcactgtaaaacagggataataatagtaactacctcagggttgttgtaaggattaaatgagatgatatttgtaagatacttagctcaagtgcctggcacacaatgagcacactctataaatgttctactactactattattaacacctagtctagggatgcacagcagaatcccctagggttaaaaaacaaaacaaaacaaacaaaaaaaactgacggaatagccccactccagatcagaattcccagtgggctggggtctcggccagtgtattctccagtaatctcgccaggtgtttgaaacacccagtgctatctgaaaactatcagtaccccaaccctttggtttatagattaagaaactagcagaagatggttaaattacttgcctattgtctcagaacggttaattagtggcggagccaaggctagaattcaagtctcttgactttatggttgtggggtctttccaccatacctgctgccatgtgagacactgcaaaaaagtggctcagaccgacaatcagcctgtgtggtgctgcacactttctaaagcacatgctcctgacactttgaccttaaggggcttgaatgtggagtaatgggaacacaagccaagcaagcactcagtagaattcagtcatttaaaaaattcaatggggtcattcttttggacagacctcagcaacacagcaatgtgcactttgtagtaaagaaataccaacttgagtttttaaaaaacctagttagtcctacattcccttttctttaaaaaaactttattgttcacattattttaatgactatgagataatgtatatgacagcactttgagaaaatatcaactgtaatataactataaggttgtagtattgtctgtttaaaagataagacagttgattcaatgtggatggaccctgtggggtacctgaaaatgtagatacgtaagaatcacctctgtcatttatcacatttagaaatatgaaactgcttaacaggtatgagcaggtatagcaagtgtttgctaaagttgtagttcagagctgaattacttcaggaaactagggaccaactttttggtttaattccgatctttaaaaagtaagaatgtgtactcactccagaacacagaagctcttccaaggaccttgactcaagaaggatgaggtcctcttactcttctccatttatccactatatgcttggccatttatcctaaatgtggtgggaacagacttgttatctgttgatgttgacagtgtcttttttaacctatgtcctgcatagttttgttaggtttacagggggaggtggatggccataaaaccagtgcactttgggaattacttttctaggatttcctaccagttataaatgacattgacatttgtcatcttttttttctttttctaaaaagaatagctgaatttaattcacctattataaaatactcaaaagtaaattgccttggtggccacttctgaattatagctacatttcattatgaccccttctgctcccttccattttgctactgatgtcattcttgttatcaggctgtgcccctaccaggagttcatattgggttgacagggttatctatatttttgttcttgatttttgagtttcatcatcttgcattaaattgttccacctggatttggggttcatctctgtgccctaaggatctgctatgaccaatcctctttttgtaggtgggtctctggcttaagtattgataggcttcagcggtttgtgtctctgtcttagcttgtatcaagccagtagtagctcacttcctttgtaaattcctgcttcagtctgggatccgtaggagtatgtgagaacttctgaaacgtctccaactcttaacagtcaagata

SEQ ID NO: 6804 - DNA, 1695 bp, Homo sapiens
tgtacctttcccttcccttaccaccttaagcccaatccaggtagagaatagggagaggcattctcctctctatggatttgaagtgaatcacccccacattattctcacatgcttttcttctctcacatattcctccctactcccccacccaatcattgtgcttatttgtacagatcttattgggaatattctttatttattttgtcatttcacttctattttaagaatgcataattgaaggagtagtcattttcagggagcaccaggtagaccctgggaacctaatgacttaatccttaaatatgttttgcccttgaaaaataggccttttccttccttccttagttataattgtggaagctaattaggatggcatggaagtgaatctaatgagttaggtattattaatgttcttggtatcgggtctaattccagttactgcttcattctctttttaaagctttatgaatacttcccccatcctccccaaggagagctcaatacacacatatttttattttattctctcaaaggaatattagcttaggaagataggaattcaacattgagcactgagttttcttctggctctgtcattgatacactgtcaaaccacagcctcatctcttaatctatttaattaaggtaacagtacatgttctcaagggtgttgcaagtaagtgtgcagctatcccttggagagcctctctggaaagctcttttagtgcagtgttgttatgctgaattgttttccattatcttatttgctgagtagaaaatattaatgaaattaagaattgttgagattatatgaattgggctagaatactaaggggaaaactatgttttgaatagagtttggcatttttgaccaagaacaaaattgagttttcattggaaagaaaggaaaccttgattcttaccattgctgctccaaaggaggcccaggttaagaggattagaggagacacgcggtgctgggcattcctggcaggtgttgggtgatccccgcagtatgtcacctgcagttgcagcacaggcagctagtgattgggttcatctcctcctagtggttggaagagaactcagatgtaaaaaccagcggtccttctcccaccttctttcctgccattcttgctcatcatacatgtccgtaaacttgaagaactcgttttagcagctagccttttaaggtcgaggatgggaaagctaaaactgtagaatattattatgctgctttttaggtttatccctgttgttgtgggatgcaagttaagggattgtaattgtttttcagggtttttttgttttttgttttttaagcaagggctctattttcccttgagagttctggaactaagccttggagaaacactactgagtgtatttaggctccctggttttcttgcccaacaacaatctgaagggtagggggtgggggctgtgtcttactcaggggcagcacctagctgtcttgcctacagtgggtgcacgatatataaatggaattgatttttgtcaacactgtcaagagtggcattgactattggagcataccccgtccacatgatgcttgaactatgtaacttcaggggttgagggctcaaggttcaggttaaagaggcactgtcaacttactatacaagcataatttaggtttttcctttttctacttgaaaaggaccagcttaaaca

SEQ ID NO: 6805 - DNA, 2026 bp, Homo sapiens
aacctgactttttttctttggaccaaatcaggtttgaaatatcgatgatatatatgagaattttttttaaattctaaaatatagcaacattgcacaggaagatactcttacttcttagagtaactacagagtgattttttttttttcttgagtgagactctgaagaaccttttcgataatgtttggacttggactaaagcaattagaattatgaagcaatgataacctttagaaaatttttctatcacatgttgaatattttcaaaccttactttaataatctaaagttacgggattatatcttatattaattttgcagttttgagtagtatgataaaagaaataagaattcaaaccattaagtacctacctaaatactacatgtaaggcactgtgcttttatttcattcagctgaggtataagcagctgtactcaaatgttcttaaaaatgagaaccagtggggaaattgtttataatcattggaaatgaagaaattccaattggctatatctttacttcagcttttcttgaacaatttacagcattgattttcaaactgtgtctactggcacccttcccctttgtatcagagcagttctgcttttaactgttttatatgttggggttctctatgagatttcattggaacaaagagtttcactgatattcgagtttgaaaaccattgattaagtgaaaaaacatcttagaagataggaaatatgtttaaaaaatgaatgtattaaatcttatgagtaggaagatgaaatacaggtttattgtatagatacattatttatgaaggataaagatctatacatgaacagcagaatgtataagctagcatttactagcatgtctctgatgcttttgttcatttctgttaatcgtcatttctgtcccctctgcatggaattttatacttgtctagggtaagagtttgtagactctttcagcagaacagattttaataaccaatttatttgttttattttaaaaatttatttttgaataaccaatttaatagtaaattttatatgaacatttggcataactttaccagtttatttctatgcagtgatggaacattatgtaatgcagctcatttcttgaccaactagttatagaagtaccattaggttaaaaattagagaaatctaagagatgttatacttagtgagaggaagcagaaatggtgggtagattctcagaggttttgatgttcagtactgacggaccatgttctgtgattgtaagaaagattgaaaacagtttgtatggagatagagttgattagcatttgagctctgaaagcagaactctagtaaaatgatctcgacctaacaaagggtctgttccattatatagactattaccataatcctggattatttcaactgggttttggcctctccattatatgagatcatatgtatatagctaagaagtctgattaaagtatggaaagattttaggaaacactaagaagatacagggatctttactgatacctaaaaagattacaattgagtaattgctcaattgagtgtaggggcatacctgaaggaagaatttgcatttgggacttcgaaggaagcttccaagagatttgggaagagacctgaacaaaaagttaaagcatggtgaatgtgatatcactgtcaatccagtataaaagcagaggaagttgaaggaaaatctgtatcccatatgcacattttttctgtctttttagatcttagatgctagcgttacatccacaaaaccagtgttgccttgtataactattatattggcctgctgacctgtgctacctcagatctgtcaaggaaccagtatgtcgcatattcttgtttcttcattcagttgaatatggtttttcatcatttctcttcaaaataatttagaaaaataaatttctaaagtcataatttttaatttagcctttttaaaaacattttcccttccatgtatagtgcaatcaattgagggtgttgtcagttttctgtctgctatttcaaaagtc

SEQ ID NO: 6806 - DNA, 1543 bp, Homo sapiens
aaactgttttggaactaacttaccactcctaaaaaaatttctgcaacctaatgagtgtcatatgacaaagtagtcctagaggggaagtcctatactgtgtgcttcatagtggtatttctaatgataacttttgtgggaaagcagcctcgttatagctggatcctagattagtccagtgaattttaataagaaattacactgttgtaaactcacctcttatgcattggtcagtgatgagatatatatataaatagatagatagataaaatttgctcttatatagccatttattcatcattggccctgtttggcccatcctcagtgtggctgtgagattattgataactggtcactgtcagataaatcacattctattaggaaacacctatataggttatgcagaaacatgcagaaatgccacctgtccatacttacgtggctttacataaacaaaagactgtcttgtctttgtggtgactgaatttacaacgtcctcccctggaaatggaaaagtacctatcaggagatgtatgacaaaagaaattatcaagcctgacttcatatatattatgaacagtctagaggaagcatctttcttagaactaaggaggtctgctgaacattggccacattctggactttcatgaaaatcatggacccagagttggggttaagccacttagaaaaagctgttgaaaacatctcaaaggccactgaacaatttttaaattacacttaacatgccaggtatctaggtatctagtgcttttagcaatattatcaatattatcaaggtcccagcttctttgtgtccttcccccttgcgatcctctttttttttttttttttttttgctttttaaaaaatagtgacagagtcttgctgtatgacccaggctggtctccaactcctaggctcaagccatcctcccacctcggtctcccaaggtgctgggattacaggcgtgagccaccctacccggcctaggatccatgtttgctttttatcgttaggtttttttttctcaatgagtacaatatgacttcttgttgtaacagacattttaatccctaggaaaggctggaagtagagagcaaaaggctttctttcaagtcagtgttttatttgggaatcaagtctttcccaaaaatccctagcaaatttcttcttacatctcattagaaagtaccagtttacaagggagcctgggaaaccttggcaaaggggaatagggttagcattgcctgggtaggccacattgcctccattgaagaaatcagggcttttttttttttttttttttttttgagacagagtctcactctgtcgcccaggctggagtgcagtggcagtcttggttcactgcaacctctgccttccgggttcaagcaattctcctgcctcagcctcccgagtagctgggactacaggtgtgcgccaccacacttggctaatttttgtatttttagtagagatggggtttcaccattgttggccaggatggtcttgatctcttgatctcatgatccacccgccttggcct

SEQ ID NO: 6807 - DNA, 1123 bp, Homo sapiens
tgccaaggccttaagacttgggtacgtgtgttacaacggcaagagtgccagcgccaacaaaagacccattggacctgtcagctcctctgtttcaccaagcagacacaataaccttaccaacaaagcagagtaagccaagtgcctctgtgtgacaccaccagcagctgatgacgcataagaaaaatataactaatttagactagagccctatctcttcttgagaagctgggatttgaaggagctatcctgagatctgtactgctagtaagtgactgataacattataaactggatcggtccctgagttcagagactgagttgcaattgagtgaaaaatagacaacgaaatcttgaagaattgcacggaggtgcaagccaagtttatttggctctccaaataatattggttgaactaagaaattggtaaacgaaacctgtaataggactggtgtttgggcgtctctctctgtcactgttgtctcttgctgtcacattgctgtctgtgttgtctttctaggtccagatgttttcagataattcacattgccctgattgtggacaacagtggttccctagtttagaactaggccactggttgtaccaaactgaacttgttgaaaatgaatgttaccaggtattcttagaccgtattaacagagctgattattgtcctgagtgttatcctgataatcctgctaatagaagccttgttcttccttggtctttcccacttgagtgggctccccagaatctcaccagatggacctttgagaaagcttgccatccatttcttctgggtcctccactggttagaaaaagaatacatgactctcgagtagctggttttaaccctgcattacagttaatcttgaccagaacagataaaaccttaaacaaaaaactgggccaaaacaaatagcttctataatagtcaaaattgtcaagtctagaggcttttgtgtaggtagcccaaggaagatggaaaaataattcatttctaagtctgacccagattgtcactactttgggaactgcttaaattgttggatctgcttccgtggcctatacatattttattcacatgaatttagttagtattccagccagcctgttcatctagact

SEQ ID NO: 6808 - DNA, 1183 bp, Homo sapiens
tgaggtgtgtggatcacctggggtcaggagatcgagaccagcctggccaacatgtggaaactccatctctactaaaactacaaaaattagcccggcgtggtggcgcacgcctgtaatcccagcctctagggaggctgagggagaatctcttgaacccgtgaggtggaggttgcagtgacctgagatcacgccactgcactccagcctgcgcgacagaccgagaccgtctcaaaaaaaaaaaagtcagataatttactactttgaaaatactcaacaatttaaaaaatagatcaacatgtcaaatggaaactctttgatattcttcagaatcttactgattttcttgtctaaatttggggagcattgtgccagatgttattatagctaaagtaaaaaatgatgaaaaacaaatattataagaaaggattcctgagtttttttctactttggaaaaaggtattgggcaatatacttttaaataaccatgtaaattgatggtagctggattatttacagaattaacttatgtcttatgatggtgtttaaactttagctgagacacattgaaaataaattagaagtagcccctacaagtacagctgtgtgtgattctgtcatggataccaagaagtcttctacaagtgctactcgaaaaataagtagaaaaggtatgtatgaagttacttccaaatatatacatatattaaatataaattttgacaaaacagacagctagatctacaggggtgtgccaccacacctggctaatctttttttatcttttgtagagacgaagtctctctgtgctgccccagcttgtcttgaactcctggccttaagtaatcctctcatcttggactccttttaaagtgctgggattataggtgtagctaccacactctaccttaaatataagttgttgatgtaatagttttatttcagtttgatttcttcttacagtctcgtgttgtttgcttttttgtcagagacactggcatttaatttttttcctttgatatttggtagctatgaagcagcctcatgttcagtaaccgtagatggtgttttcaccatcttttgaccagggactttagcactattgcatcacccttgacaatgagttttcatttgtttttagtgatgagagtttcattttgaggttatatatgtctgattttttttt

SEQ ID NO: 6809 - DNA, 1183 bp, Homo sapiens
gagacagtcagatcaagatatgaatcatagtccaaacatccaatcaggaaaagacattcacgaacaaaagaacacaaaggaaaaagatttgtcttggtcagaacatctttttgctcctaaagagataccatactctgaagattttgaagtgtcttctttcaagaaagaaatttcagctgaattgtacaaagatgattttgaggtgtcatctttgctgtcactcaggaaagactctcagtcttgcagagataagccacagccaatgaggagctctacaagtggagccactagctttggtagtaatgaggaaatcagtgagtgcctaagtgagaaaagcctttctatccatagcaatgttcattctgacaggctgttggaactcaagtcccctactgagctgatgaaaagtaaggagcgcagtgatgtggagcatgaacagcaagttactgaatccccttccttggcttcagttcctactgcagacgagttatttgatttccacattggtgatagggtgttgattggaaatgttcagccaggaattcttcgattcaaaggtgagactagttttgctaaaggattttgggccggagtggagttagataaacctgaaggaaataacaatggaacatatgatggtattgcatattttgagtgcaaagaaaagcatggtatttttgctcctcctcaaaaaatatctcacattccagaaaactttgatgactatgtagacattaatgaagatgaagactgttactcagatgaacgatatcagtgctataatcaagagcaaaatgatacagagggtccaaaagacagagaaaaggatgtcagtgaatatttttatgagaaatccctacctagtgtgaatgatatagaagcctcagttaatagaagtagaagccttaaaatagaaacagacaatgtacaggacatttctggggtacttgaagcccatgttcaccagcagtcttcagtggattcacagatttcttcaaaggaaaacaaagacctcatttctgatgccacagaaaaggtttccatcgctgcagaagatgacactttagacaataccttttccgaagaattggagaagcaacagcagtttacagaagaggaagacaacctatatgctgaagcttcagaaaagctttgtacaccacttctggatcttttaacaaga

SEQ ID NO: 6810 - DNA, 4234 bp, Homo sapiens
gtaagtagaggaacatttctgtctaatattttgtgttttcctcccattaaattccttattctcttatgttatggaattccttatggaatacatattcccttacgttgacattgacaacatactggtaatctttaatatatatgaaatacttgaatattgtcaaatgttatttttgaagtcattttgatatttggcaattgaggttttttcaactttttgcaattttaaaaggggtattgatatcatatgaattatcttttttctctggtttatttccttgggctgtattcctatggataggactacaaagtcagcaattatattttctagcttttgtatgacaggaattttctaaccttattgtcttctaaatcctaggttcaggagctccatgaggaggaggcacagtgggtgaactatgatgaggatgagttgtgtgtgaaaatgcagctagccgacgggatctttgagaccctgatcaaagatactattgatgttctgaatcagatcagtgaaaagcaggggagaatgctacttgtgtgacatcttgcaaataaatcgaacgctgagtgctaatgtgagtcctgggcctttctgcctcctgatgtacacccatcgccatcatagcaagagtgcttctggaccttgtacttattcttaaagactaccagtatggagttcataggacaatgtggtacacctggtattacagcctttgcctttcgagactatccactggattaatgggttattttcagtgggcagggttgcacagtgtaatcctacaccttttgctaacacccctactaggtcccagagggccagaaacacctgacttacctctgagtttagactagggtatcacttctttgagtctgaagtcaagtgagagaggtatagataaatgcatcacatcacttttgaaatgtaattctggtctataccatggaagtcataaatggacattatagtctctaaacagtattaaacccttaaccacttctaaaataggcaagctcaataatgtctgccaacttcacattctggagtttatttcatttctttttgaagaccattttcttccattattgtagttgagcagcaccaagtggactgtcaggctaacaggaataagtggtagccttgctttctgagcaccatctaaagaattttaaacctctgcattatgtttagtgttctctgtgtgggcatgaaaacaaagaaatgcccctactgaagactgggctcaaaggaccaatgcagggctggttcttttaccccttggtttactcctgcacttgtcttactcattctgaatctctaccagctgctcccagaatcacagatactcaggaccatctcaggcatccaggcatggcaaagtggaaataattcattttggcctgcaaaccttcaactcccatctttccccaagaagtcagagatgctgttacttgaatgatttaggaaatgagtgtgtgcaccaaagacaaaaagatattgtctattgtttgtgtgcttgttttgcgctatggaacattttttaatttattttaagataaattattaagttgaaaatgtgtgtccctattcagaagtgaaagattcatcttgtaatagttaaacctccatcttgaagcttctatggttcatagtctttgcacaggaacctgtggttttaacaaaccaatacacatattgaagaagtcattttaattcagtgaaacgaagatgggcttttccagatcacctgcaatagcagcagtgggataaaatgatttaaaaacactgtacaatttaactctgcctctcttgcagcattgcttctcacaactattacctgcatctgaaaaaaaatctatagactccagctgctacattagagcataagagatgctctcctgggacctcagtaccctgccttcttgactggtttccgttcatcagtcctgtccctcttcaagtaatctagaagaatgtggatactcttaggcgtgaatgtaaatgccttaatattgaaggtcctggttagaagcatgatacaagacatctactggattcatatttacaaatatcctggaatgttatagcttcaaagtatattagaaaaaccccaaagatggtataatctttaagtgtgcacgttcgtttatttctgcatcttccctccaaacttgcctttgcatcttaaatatttcactatgcacactcccattcctcttgggtttcatcttgtcgtttaagaaatgtactgaaataatcattggaatatttgcattttgcacaatgactggtatgatagctcttgacaaataaggaaagcactgaaatgttgtgattgggtctcgggaaatgctcagattgatgtcttaccagcatttcttctgggcttgtgatgttgagctgtagtcttgtagccataatgagcaaattgactaagagaagcaaaggtttcttggggttattaaccagtagtgtggaaatactagttttatgtggccaaggaaaagcaaaggcttttcttttcagtttgtgttatttggaagacagaaaaacatcttgtctacatcctttggctgtttgtaggatcacgttgtccttacgatactgaaactttacagctgctgtaaattttttataaatgaatttcaaaatgttataatgggactgtaggttgtttttctacatcttcattatttggacctaaaaccagtttttaataagaaagtttatctttactctttctgaaattatgactccagaaaaagaaaaaaaaaatacaagtcatggaatcagcaatctggtaagaaatgctgccaagaatgtggcagtagctgtcctgacagactccaactgtctttactatctgaagaatcctaggctccacatgagaggcagaaatggatcagtcttattcttttctagaaatggttatctgtagtttggtagcaaaaaaaaagaaaaaagaatccataattagcagatttcttattaactatttggatctaattgaaatggctttattcttaggattaagaaagatagatgtggatacccagccactcgttccatattggtatctttttaaatcagctctgcctcttaatcaagaacctaaatattccctctttctaatctttgttccttctccctacaccctcatcctctttcactcttccttcataattcctctaagaaaaatatctttgcatcagcagtaatatcttttagaatagcactatcagaatttagcagtaaaccaacatacaggcttcagatttacttctgagtccaaaacaatttgtgctatccagggtagttaactctgggttaaacaagtacagggtatagattccctcttcaggtctacacaggaatttttaccatagggaaaagtggggagagctcaaacgtagttaataaggaaggtaatttgtttttcttttacctaaaagaaaagaaaattccttctgtgactacaggtctctgagaaattatctttcaaaagagatttcattgctcataagagtgttgtggcctattgataaaaacaattttgttcagtttcttgtcttgaaaaaaaagtggccttagctttttgcaatacttgaataaagtgtgtactcgcaaaagaatttctgtagcacagcattagagactcataacttttctgcaagaaatacaaacttacatcttccttttactaccttaagaatactagtgaataaaacattaattcaaagagcaaattatagaaactacaatgacatttaatgcaaattgtaggaatttacatgtttacaaatcatcttcaactggttgtgcagcaattcaataaaatatctttgtattataaaaatgtgaagaaaaaatgtaaactgatgtaaaggaggtactgtcattttaattaacctatgtttaatagcttttccttctggactttgcaaagccttcttggcaaacacattgcaaagcattctctgggaggttcagcctccttgtgtgtactgtactgtgcagacatgaaaaaataaacccgtttactgtgtgcgtgtaaatagcctggtcatcaggccattttcagccaatagtcacatccagtgcaattttgcaccgaacacttaagggtgtggtttgtaagtacgatctgtaaaataactgggatgaattcccatgtatacctgtgtaaatagatttgttaactgaaatatactttaagaaagataaaatctgt

SEQ ID NO: 6811 - DNA, 1127 bp, Homo sapiens
gaaagggaaggtggatttcttgtatcttagtaagaagtttgatgcattttccttgggaatattgttttttatgtgatgattagtttctgtacgaccaaaatgccataagcacagttaatttatgagaataatctctattagtctgtagatcatatatcctcaataggggtgaaattttgtttgaggaaattataaaatcttagattacagtggtttgtggtctttcaaaatttaatagctatgcattgtatctgtgtttttaaaatttcacggggaggacgattaggaaaaaaaatgtctgaaaagactgcttaggtagggcaataaggtctgtatagctctagaccaatgtaaatgcaaaaagacagagcttctctatccatagcttattatctctatattcagagacccttgaaatgtgcatacagtttttttaataataagaaaaatgctgtttgtgttatttgcataatgacaggccattttggatattccatattgtagggaagcttggaaagcacttggtgattcaagccccagccaagcaatgcaggaatatatcgcagtagttaaaaaactagatccaggttggaatcctcaggtaagacttaatgattataaataatactttccaaaaacttatgatccttctctgaaataaatgtctaaaactaaacttagttttaagtaacatgcttaaagttttactttcttgaaatattttaaagttattgtaatatttatctaataaaataattgctggccaggtgtggtggctcatacctgtaatcccagcactctgggaggccaagccaggtggttcacctgaggtaagagttcaagaccggcctggccagcatggtgaaatctcatctctactaaaaatacaaaaattagctggacgtggtggtacacacctgtaatcccagctactcaggaagctgaggcaggggaatcaattgaacctgggaggctgaggctgcagtgagccaaaatcaggccactgcactccagcctgggtgacagtgtgagactccatctcagaaaaatgaaaaaaattaataataattacttaaatagtaatataaccagctactgatgctgagaacttctctgagttgcagagt

SEQ ID NO: 6812 - DNA, 1284 bp, Homo sapiens
gtaaacaataaatggttatttaagtatataaattagtatataggctgggcatggtggctcactcctgtaatcccagcactttgggaggccgaggagggcagatcacctgaggtcaggagttccagaccagcctggccaacatgatgaaaccccgtctctactaaaaatacaaaaaattagctgggtgtggcgtcacgcatctgtaatcccagccactcaggaggctgaggcaggagaatcgcttgaacgcgggaggcagaggttgcagtgagccaagatgacaccactgcactccagtctgagcgacagagcaagactccatctcaaaaaaaaaaaacaaaagtttgtatgtaattaaattccaaatgagcagtactgtcaataaattttatagttatttggaaaatcattagaccaaatggaagtgtttctcatacagtgggcttaaaacgaaatatgttgattcagtgaatttatgaacaggtaaggatccaggatctgtctcttaaatagtaagtagaatttgaattagtggagagaaagaacaaggccattttaagtagagggaacaacataagtaaatgtgaaaaacaaacttattaaaaggataataaaattcatcacgagtcaagagttaatattttaggggtgctgcgagataagtttgggaaaagtgagttggtgattagattatgaagaatttgaattgtgaggctaaggtatctaaagtatttgaacattataattactggcgagccatagaataatgatattgaacatttgtgtggacataatgggcaatagaatgtagtgcttaagagtatgaactttggagcaaaactgggttcaaattctagcttaggtcagtaactaagcaaatgacaacctctctgtgctctagtttcctaatcaaatggagataatggtttttaactcaaagagccattgtgatggttaaatgaattaccaattattctatgtaaaaatactgagaacagtgcttagcacatagtaagcattccgtaaatattaactgttgtcatttatatgacatttaaattttcacactactttcatgtgtactgttccttctcattttcatggcaactctgtgaggtagatattactatatccagtttaataatggagtaaatgaagccaaagagaggttttgtcatgccggatccccaaatgacagaactgatcacatgattctaagccacttcaccatgattctttgtaatctaaaaaactaatagaacaatgggatgacatgctgaaagt

SEQ ID NO: 6813 - DNA, 1514 bp, Homo sapiens
tgttataaactttaggaatcctgccatctatgccttgaccaaatgacttaatttctgttttctgcccccatctgtaaattgaaattaatatggttcttgcttatagggaggttaagtggattatattcattattacatagaacttggaccagttccctcacagaaagagcctactaagaataaactattactatttttatcttcttattaaatacctacaacaatatttttatcagtcattgactacgtatgttgctaaaagttaccataaatgtacagtatatggtgactgcatatgaaatttagagacaatagatagcacagtagattggaatgaaggaggcttaggttgaggatgaacggttttctaaaggataagggagtgaatagactagagacacagtaaagaacataaaggtagaaatgaagtgcagaaagaaaaaccatgtgactagaattatagtaagaataattttgctgaatagatgaagtatgattgtaaaaggctgaaaatgcaaacttgatcttgtaggcaggaatgagtcacagataattttttttttttgagatggagtctcgctctgttgcccaggctggagtgcagtggtgcaatctccactcactgcaagctgcacctcctgggttcacgccattctcctgcctcagcctcccgagtagctgggactacaggcgtccgctaccacacgcagctaattttttgtgtttttggtagagatggggtttcaccatgttagccaggatggtctcgatctcctgacctcgtgatccgcccgcattggcctcccaaagtgctggcattacaggcatgagccaccgcacccagccacgagtcacagagaatttttctgtagaagaatgacattgtgaaagtagtatcctaggaagttttaatagcactgtgtaagatatattaggcaagggaaaaactgaaggccagaaagccagatgaaaagctatgcagtacttcaatgtatggggcagtgaaaattcagatcaggatgcttactgttggaccagaaggaacataaggagatgttttgaaggaagtaagaaacaggaggtagtatcagtaactcattggatatagaggagtagagtagaacctgctgaactttaaatagagatttggaagttctctgaagaaggcagagaaaagcagagagcagggaactgagtcttaatccctggctcaaccatagtagccagggaacaaacacagacaagagaaaaaaagaaaataaacaaaagaggtaggaatagtcagggaggtaataggaagagcatcaaaacaaagcatggttggtgctgtgatcccaaggaagcagagtttgaagaagctggggcaggggagcactgagtgggtcagtgagataagtgccacaaagggctggaagaaaatgctaagtgtgattggtgacctcattgagctcctgattttgaagtctaattatccttgttagttaccagcagagggcaatctaaacatatactat

SEQ ID NO: 6814 - DNA, 3711 bp, Homo sapiens
ccaccttacaatttgattggaggctcccatacactgaaactctcaatagaattcttaaaaatgaacatcagctgggcgcagtggctcacgtctgtaatcccagcactttgggaggccaaggtgggcagatcacgagctcaggagttcgagaccagcctgaccaacatggtgaaaccccgtctctactaaaaatacaaaaattagctgggcgtggtggcgcatgcctgtaatcccagctactcaggagactgaggcaggagaattgcttaaacctgggaagcagaggttgcagtgagactagatcatgccactgcactccactgccactgcctgggcaacagagcaagactccatctcaaaaacaaacaaaaaaaatcacagactcattttaaaggagcagcaacctaaccaaatacaaacttcatttgattttaggtttagaaattctagttttattttggagaatcactcagtttttaatatcaattaaaatagtcctcaaaggaatgaagaggaagtctaaataaatgaataaaactcatttttcattttatggtagtatagaaagcattgatgtgtgtagagaaattaaaagacaagagtggtttactgtctatgcacaaatgagtgcctatatttaaggctgcctataccattacagtggcgtaattggtgatttcatagcatacagagaaacaatgaaatcaaagattaaatcattaggttatgatggtcatttgtaagattggaaagtagtcaaaaacccatgtgcaactttttttcagcactctaccattaggctccttaggcaagctgcttaacttccgtcagaagcaaaggtgtgggagaacaccattcacctcagtagtaacttataaaaaccgtttaaagaaggaaaatgggccccagcccctaggatccctgacttcctgatattctaaacatgagagttctgtgactttaactgagctctttaccagaagtaacgtgttgatgtatattatctttccaccatgctttgaccaaagtacattcacagtaactagagaaagcagatcatccatttctggataggtgaactacggcaaggtaagaacagaaaaaagtaaagtagtattgagtcatgcaggtatcagattaacagacattcattgaagataagtgaaataactttggagatagcagagaagagcaagaagatgttggacgttggcagtaagccgcagcaaggcagttaggaaagtacgtgagcctgatgacgcgaaggtgatgcctccatctgtccgcttagtggttattaaattgctgggaaagacctgcctttattttcctatcatcttttccccattactttgcattattcaggaaataattatttattcccaaatgcagttttctaagcagtgaccacaaaaatttcttattctaaggaaaataattaagaaaataaccctatctgtggcattgttttaaaatgtgggatacaaatctggtaagcagatttcaggtcattattgttttcttttaatggtttacatgaaattttcctctcaaaaaacaagtacctcttactgtataacatttgagtttttaaaattgagatagcttctgagagaaaaaaagaaagttgaatttgtagctctctcaactacaaaatcaccacacttttctcaaatctaataggaattcagtgtcattacagatacggtctctagtgaccaggtgaagacaattgaagctttggtagaacttctgcaaaagttaggtaaagaagaataaatccaatttatcagctttgttcatattctttttctgagtgatctaaatttttcttgcttgtgatcattagctaagacaaggagtgttaaaggttttctaaatgcaaacacatacgtttctgcatttcagaagtcagtcttgatagtaaatcctacaaactctcaactttctgcattgtattttaagtctatacaatgttagagcacatggtaatgtgggacagagttgattatatgatagcatgagaaatttgcactggttggtgttacaaaccaatgatctaaccagcatactctccaaatatgaaaaagtaaaaacatctcattaggtttggaagagcctaaggtagtccatacaggaagtttgcctgagaacagagaggagcctgttgattggcatggctcatgatgcctttcttgtatgaattatcaaaactgatactgagttgcccctagaaaacagccttccagaatatgtttgcttatttatggtggaagaggaagtgagaacaagatgagagtttcccttaaagtgaggagaatcattatacaactttgcaactgaagtatgtttccttgtagcaaacctttggtttattttatcgtcaaatcaaagccaccctcagttttttgtatggtgccatcaacctaaggaggacaatcaaataacctattgtttgccttggattcagtatatctactaagtacacagtctcgtataccttcaaaccagttacttgactaaacttccaccatattaccttagttcttcctatgccctttcctctgtgccaccacaaatcagagggaaagactgcagtacttctagaaagttgtggacttctaagaaagagccaggcttccatctcactatcccttgatcattatctctgaagtccctacctgcacttccctgattgccctgtagcaacaccagcatggtgggaattggagggaaagattgtggaaaatccctaaagggtcattgttcatgacgttattttgaattgtaaaattgtgagccactcacatttcaattacaaaaagaacagaactcttaatcacgttgtgaagattaatttcttgccattttctggattagcacagaagcttgtatcaatgaagagtatttaggaggggaatagggggaaaattgtatttttctgttcaaactctctccttctatttgtgtttccttcacccctctccctccaccacactgtgttggtcaaatgatactattctatgaaaccctgagctatagttgtcaaaagtaactatggattgtgattagtcctctgtgggtgcttccttccctcttttttctccctcactctctttctcagtctccactctggtaaatggaaaaggtgatgtcgaagaattgatgcttgcttggactcatgttgtatctgtgactatgctattagctgtctcctttttccttcctatatgggtagaattcttatgacttatgaagttcccttcttgataagtaggttaaatgcacaatgtggtactgttttatagtttctagatggttgtataaagcaaaaagttaatgtggttatgtgtttttaaagaaaataagtgattggtcactaaactctgtccttttttcattattacaatttctctctgttttccaacagtttgctgactcctttgtcactggtgaatggtttgtgtgactgtttttctctcttggtttcttgaattcctgaacatagttccccttaggactaattttcatatggggttagggcaaacagactacagtggtgaaatttttaaactatcctactaagttaaaagaagtttaaatggcttttatcttcaggtaatatgtgaggtgtgactctaaagcaatgggattgttgtaacaaatctttcttttactcgcacaaagaatctcaaatattacaaatatgag

SEQ ID NO: 6815 - DNA, 1609 bp, Homo sapiens
ctgacttttctccgtgtgaccccacaattgacatggctcctccatcccagcgctggaagggccagtgggaagaggaaatagatgtctgcactcctggctgcagctggacaacagaagccccatgccgcctgtccagttcggaggagaactagctgctgccttgccttccgggacctcgtttgctgaggagggacttacagactccactggtgttttgctgttgctcattccatgcatctttggcagctcttttcttctgctcagacccttccccgtgctcagacagtgcaccgctgtcccatctaaagaaacctgtcaggaatacgagcttctgggtatgtttcgtttcccattgctgtagcatttcttatcccctgagagctgatgattattgaggacagaaggctcagaaacagtttgtgacagaaaatgcagtgtttcatttttcagggataaatgctaagataaaattgcttttccaggtcatttttttttgtggtaagaataactaatggaaaataatgaaacaccctggggtttgggggtgctaacaacttgtggctttaactgacaggagcaattaaaaagagcaagagggttctgcattggcatagcttagggaagggttaatgatgtcgccacaggtcagctcctgatccttgccgacttgatgttgctgtaccagggcttcctccccagaggtgcagcttgcgttttgagggtgattgctacatatgttgttgctaaacagctcagtaacacacttgaatgaatttggataccagattgtcctcattacagttcttttactcttagggcactctacactgggggttggggttgggagtggttagtacatttattacatttattaagaaacgtaatgacataaaaggttagctctgggccagacttctcttactctgtgggtaatggcaaggatgtgtaggtaaacttggttcttttttttccctaagatgacagcttgattttatcatctgcagtcaaataactgagccaatccaaatttaaatgatagatgctttaattgagtttaagtagctgaaactgctgagacactaaactttaaccttctgatgactttttaaaatgcctcaaatgtgcacatgtatataggatatttttataacttccctgatgaataatctgatattaaagtagtatttggacccagagccagaactcggtggtggaggctgctggtctctcctcaccaccttcttttgcacttggaaagaacagcaacatctggatagagttctagctttgacttctcatttccttgtctttttgggtgcattcctcagcacactttttttttaaacctttttgttttgttttgtttgtatttcatgtggttttatttgggggttttggttttttcacccttttttgtgatttgcaatgatgtgcttgcccagctaacttttgaattgcactttttaataaatattcttaacaatttttgaagaaggatattttatctcatttgagatcatggtaggttaagaaaatatgcctgttgatgaaagctaaaagcaaatttatgaaactaaaagggtgattgacatccatgtttacactccgc

SEQ ID NO: 6816 - DNA, 1171 bp, Homo sapiens
cacagggaatcctttcgtttgtccttgaagagagaggaaagactgcatagtttccccacatccagagatttgccagactctcttgtatttaagctgtggcagtctgttgtggattgagaccttgatcttggcaatgggcttcctcctcccaaacatccccatgtctcaatggtcatctgcacgtgtgctttcaaccattgtctgctccattattggacgtcagccaaccagagtaaatctctcttggtggtttcaagccccgctgactgttcacaagttggatcagcaggagatatcagtagcttaacaatccagccttttgagcagtgtgttctcagaggcaacggtctggtcctttgatttctgggctttgcttctgaatgtgaattgtcccaagttggcaaagaaactagcagctgctagagtgctgggcttggaaccaggtaagatggattttaattgcttatttcccatttctctggcaccagttgatcgtggaacagcaggatgagcagttggagctggtctctggcagcatcggggtgctgaagaacatgtcccagcgcatcggaggggagctggaggaacaggcagtgtgagtattgagacacccctctcgcttcagtgaaattgaggggcagagccatcctatgacacccctaaaaagcctggcagctacgtggctggtaaaatcaaaagctattttattcatagctgcatttttattctgttttacagattagcctccccaaaagaagcaattctacttcgtaaattttactacaggctttaggtgaagttgttattatttttaaacacctccaaaaacagacacagatgtctctgagcagatactcgaagtatagttatgaatgggaatatgaaacagagaagcctctgtaacctgtgggaatttttgttccagagaggataggacatgagctgactttatcatcccatgactctcctgctatattgaacagacacgttttgctttgaatcttaaattattgtaactttgttttttttttttaaaaaaaacttacaaatttaacgccagttaataaaaactctttcctctcagaaaaataaataaaaacaaaacataacctcagtttgtttttccttatgaacaatcccttttgcacccagaagttcgatggcaaaaact

SEQ ID NO: 6817 - DNA, 1177 bp, Homo sapiens
aagggctatggcttaccttcttgtcattccagggaactctccctttccccccaccaaaaaaacccacaacttcccctgggtcacactttttttaaaaaagtactctagatcttcggaatcaggttgactggaacctatgggttgctgaagttccacaggtaccaggaagagctcttttacaagagattgaatgcttttcaattataacacagtatatagatgggtgtttgttgatttagcagacgtttatttgcactttaaggggacaaagcccattgtgaggcctattgggagagcttaaagacatagagggcccttcctggaattccttaaatagtaccacccaggcaccaacctacaccactacataaaagccttgcccaggggaaaatagacaagaaatgtgaaaactctttatatcactcttgatgcatcacttgttcagagatagtaattgtttgtttctcctgactcctctggttgttcttctcacacaggcactgctgggagacagtggcagccagaactggagcactggaacaacagataaatatgggcgtctggaccgagagctccagagagccaattctcatttcattgaggagcagcaggcacagcagcaggtaccccaaggaccccagacttaggacgggccagtgggaaacaagacacccccttagttcctttgccagccatggggtcttgtggcttagtgacaaggagggtaagccagagcttgtcctgtgttgattgtgtttaataattgcatatgtaaagggtttcaaaatcttcacagtgtgactgcttcaagagaaccaagctcagccaggcgtggtggctcacacctttagtcctagctactgaggaggctgaggctggaggatccttgagcccaggagttcaaggctacagtgagcttcgatcatgccattgcattctagcctgggtgacagagcaagaccctttctctaaaaaaataaagaaccaagctcagttagttctcttagaaaaaacagacctttgtccatctcagcaaagacactttcagaaagatctctcatttttttcttcgaaaattattgattggtttcttttttttttttttttttgtgagacggagtctcactctgtcacccaggctggagtgcagtggcaccatctcggctcacggcaacct

SEQ ID NO: 6818 - DNA, 1227 bp, Homo sapiens
ggtttaagaatttctcggattaaaatacttaacctataataaaatggtagctatgtaagagtaaccttccctccagcattctcattcctcccacaccaagaaaagaaaggccatattaggacttatcatctgagtataaattattaatactgtcacaccaagtggaagcatgtgggaatgctcattgccctttagttaatttgtaggattgcttcattatacttttacgtatagtctgttcagagaaaaatattaaatttgtccttccccaacaaacttgatattgtagctgcttaaataatggctattgtattccaagcatcagctgagaacataatactcagactgtgtatcaaagttttgaactttgatatttgtctgtgaagagccttctgtgggaatggtggttgctgaggatggtgtatgatcataaatgttaacctaaatcatgcagtaacttgaccatggaatgttgtctgtgatttctctcctttgcctcatcttgattacagagaggtacagaaagcagtcaacactgcccagggattgtttcagagatggacagagctcctccaggacccctccacagcaacaagggaagaaatcgactggaccaccaacgagctgagaaataacctccggagcatagagtgggatctagaggaccttgatgaaaccatcaatatccttttctgtggtgtctgtgccattcgggataaatagacaaatggacaagtttttctccagttgtttccagtatgtagatgaaacattttataatcgattaatgtttgttgctcttacttgtaccatgacatgtttaaagtatttgcccagtaacttaaggtacagtagccaaattcttatacagtgtgtgacaaatcctgtactataaatgtatatatatatataaaggcagcatagtgtaatgattatgactgtggaccctggagtcagatttctggtgttcaagtcctgcctccaccaatgtaaagggaaaaaaaaaaaaccctttttttcttttttttttaagtctctaccctcacactcaagtcagtatgatatttctgacactgtctacttggagatagcatcaggtccacaggttaagagctcagtcccacaagactgcccccacttcagatgccagttgcaagccctaggttgtgaccagcgcttccaactgaccacgtataaattggagttcccacgaccccctccatagat

SEQ ID NO: 6819 - DNA, 1163 bp, Homo sapiens
ccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacaacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattatttt

SEQ ID NO: 6820 - DNA, 1246 bp, Homo sapiens
tgagcaggcccgccctggggcctcttcctggatgtgccctctctgagttctgtgctgtctcttggaggcagggcccaggagaacaaagtgtggaggcctcggggagtggcttttccagctctcatgccccgcagtgtggaacaaggcagaaaaggatcctaggaaataagtctcttggcggtccctgagagtcctgctgaaatccagccagtgttttttgtggtatgagaacaggcaaaaagagatgccccgagatagaaggggagccttgtgtttctttcctgcagacgtgagatgaacactggagtgggcagaggtggcccaggaccatggcacccttagagtgcagaagctggggggagaggctgcttcgaagggcaggactggggataatcagaacctgcctgtcacctcagggcatcactgaacaaacatttcctgatggcaactcctgcggcagagcccaggctggggaagtgaactacccagggcagcccctttgtggcccaggataatcaacactgttctctctgtaccatgagctcctccaggagattatttaagtgtattgtatcattggttttctgtgattgtcataacattgtttttgttattgttggtgctgttgttatttattattgtaatttcagtttgcctctactggagaatctcagcaggggtttcagcctgactgtctccctttctctaccagactctacctctgaatgtgctgggaacctcttggagcctgtcaggaactcctcactgtttaaatatttatttattgtgacaaatggagctggtttcctagatatgaatgatgtttgcaatccccattttcctgtttcagcatgttatattcttataaaataaaagcaaaagtcaaatatgacatcctgtcttcaagtgctgtgtgggtcaggggaaaaggggaagtgttgtggagagctctggggaggagctggcttttgggaattccacaggacaggcgagtaagcttccatggcacaggcagaagtacagggagagcttgatattcacctggtacctgccagagtcaagagaagggataggttctaacgaggctgctatgatcagtgactttttaagctcgtgacagccccacttgtgttgggctgttgtgtggattggactgggctcagcccactgtcatttcagagcccgtatcttttgcccacctggctgggactcggcatgagccatttccaattctgcctgtaacagt

SEQ ID NO: 6821 - DNA, 1287 bp, Homo sapiens
ttaaatcagggagcaatgagggatttcctaggagaaacaggaaagaaaagactttgtagtgcttgagagttggacgacgatagtatagaaatggattatctggaaatacagactgagacagccagcaatgcagaatttgctagaaaacctaagattatatctttttaatcaaaagatctgaagatgtaaatgaacagcagattagaaaatttagaaaaagaccaattgcaacaactgtttctcaacttgctttatcattgattcaaatgtaaactttttggaaaatacattatttcaataatacaaagaaatatactcagaaggctccatgagagttttgagtcaaatttaagtttgtgtttgaattttagtcctatcctgtgagaaatactaattagtggaaaagttcagtatattgatgtaagctctacatttttggaaattaaatttcttctgtattctatagtgtgtgactagtcaactagaataaataatgacattacaagtaattagagtcactagaagaaatctagaagacttacctcatgagtaactgagacaatccaaaaatatgtctccctgttttttacaggcaaattgcaacttgatctgtggtgatgaatatggtccagaaacaaggttgagcatgtctcaattgaacgaaaaggaaactccttttgaactcatcgaggctctacttaagtacattgaaacccttaatgttcctggagctgtgttggtttttttgcctggctggaatctgatttatactatgcagaagcatttggaaatgaatccacattttggtatgagtctttgaattctcacatatttgagagtgaaaatgaatgtttttgctagtgccttagccagtatgtgaaaacaaaattttgtattgtttctactttcgaataaaaatatgtataatggagagctgtttgaaaccagctcctgtttttagtccctgattgttctttattgttatataggaagccatcggtatcagattctacccctgcattctcagattcctcgagaggaacagcgcaaagtgtttgatccagtaccagttggagtaaccaaggtaaatattaaacattagagtgatgggattggaagtgacgtagatactaaacaaatgttacaggctttcaaagagctacccaaaaaattgtaacccatctaaattgaggaagaaaaaaggagtcttctctttctgagcttagtagattgttgttcattaatcagttattgggtgatctttttaggacttctgtaattttcttg

SEQ ID NO: 6822 - DNA, 1124 bp, Homo sapiens
aagtcaaaaagttttggattttaaagatacatctataagagcctttctagtggcactaaaattacatgaactaggaaggtgggaggttgtagagaaatgttagtatgagttatcatcctacaaaaagtcttgttgtcgtttttaacccatgtttgtcaacaggcaaggcctgaagagaccatgggtggagctaataacattcgcgattttggataattttttcatttttcttctcagcctaaaaggctatcaagctgtgaggataagtcagaaaccactatgcaaccagattaaattttgtcaacagtgtgtatagtgaacgataaaaggtccgatggtaattgtaaaataaaaggatgaggaaaaggcagctctgtatccctgattaccttgctgcaaaaagtttattaacatctgtgtatacacaaggaggatggttattttatgcttattttctcttagacttgaaacccacatgacaccagagatgttccgaacaccattgcatgaaattgctcttagcataaaacttctgcgtctaggaggaattggccaatttctggccaaagcaattgaacctccccctttggatgctgtgattgaagcagaacacactcttagaggtacttacaaatacaaacctacttgacgcagatattaatcataccatctgtcttgttctggcagataacacttacaaatgaatcaagatgatgaagatgtagtcaacagggctgtgataataatagtaaggcctccagtcttaccttagatagttagtatagtcactgttctaatgagcaatgagaaggaagaaagggacaatgtgagtctttaaaaaagaaaagaaaacttaaaaaggcatctcttaactatgtactaaagatcagaacataacttactcatgatacccacagtatttcatatgaatctcttacaactttttttgtttttttgagacggaatctcgctccattgcccaggctggagtgcagtggcgtgatctcagctcactgcaacccccacctcccaggttcaagccattcttctgcctcagcctcccgagtagctgagactacaggcatacaccaccacacccggctaatttttatattttactaaga

SEQ ID NO: 6823 - DNA, 1163 bp, Homo sapiens
tatctgggcccaatatggggaaaagggcactgatttctcaaaagttaaaagcaagcaggccaggcaatgtggctcacaccttgaatcctagcactttgggaggccagggtgggagggtcccttgttattaatagttggtcttgaaagagcggtgtcaggaaaagaggtttattttatcagaaaatgttgaagattaagagatttggtatgatggggaagagagaatataaaaggaaaaatatacttggtcataatttatgataaatatgtggccattagagcatcagagcatttttttctttctgattctgaagagagcagctataaagttctttgttaagccagtttcattgcaaataaaagtagaatcatagccataaagactgcaacccacagtcgacagtcctacctgagctgctggcaacaacattgtgatctagtctggatttaactgtctttgtgtatttcagcgtgggagatgctatctgtaccattgctgctgctacctgctttccagagcctttcatcaatgaaggaaagcggctgggctatatccatcgaaattttgctggaaacagattttctgatcacgtagcccttttatcagtattccaagcctgggatgatgctaggtatgagtaagatttgggtgagctgtctgtagtttctcatttgtatttagttctctggtcttagagaatgatttctcatgccaatttattttagaatgggtggagaagaagcagagatacgtttttgtgagcacaaaagacttaatatggctacactaagaatgacttgggaagccaaagttcagctcaaagagattttgattaattctgggtttccagaaggtaagacttcttccattcttaagatatctttaaagtgacatttatatagtacatgcaaattgacagcaaagtgtattttagtttcaaattttagaccctatgatttttatatattcccgactatttcttagttctcgtgaacactggtctagttcccagaatgagtactttgctgataaccttatagtggtttgcaaagtaatttattagcatttagacttgaagtaaattctaccacattaaattttaaatgactttaatttatactttcggtgtacagatgattaaaggactttatgacatctaaca

SEQ ID NO: 6824 - DNA, 1202 bp, Homo sapiens
ggggcggacgcgcagtccatggggcgcggtgggccggggagttgccccaggggccgcgggagttgctgagaggagacagggttgggctttctcctcgcccagaccccaccccaccctgccgaccccaccccctgctccttcctccccgggggcgcgcactcgggcacgcgctcggaagtcgggggtcggcgcggagtgcaggctgctcccggggtaggtgagggaagcgcggaggcggcgcgcgggggcagtggtcggcgagcagcgcggtcctcgctaggggcgcccacccgtcagtctctccggcgcgagccgccgccaccgcccgcgccggagtcaggcccctgggcccccaggctcaagcagcgaagcggcctccgggggacgccgctaggcgagaggaacgcgccggtgcccttgccttcgccgtgacccagcgtgcgggcggcgggatgagagggagccatcgggccgcgccggccctgcggccccgggggcggctctggcccgtgctggccgtgctggcggcggccgccgcggcgggctgtgcccaggcagccatggacgagtgcacggacgagggcgggcggccgcagcgctgcatgcccgagttcgtcaacgccgccttcaacgtgactgtggtggccaccaacacgtgtgggactccgcccgaggaatactgtgtgcagaccggggtgaccggggtcaccaagtcctgtcacctgtgcgacgccgggcagccccacctgcagcacggggcagccttcctgaccgactacaacaaccaggccgacaccacctggtggcaaagccagaccatgctggccggggtgcagtaccccagctccatcaacctcacgctgcacctgggtaagcggtgacagccccgtcccctgctactgctcgccagcagcccagctcccggaccggctccgtcccagtggccggcctcacgggcgcagacggccgcgtgtttgctctctgttccccggcatgggccacacagaaactcctttctccaacttcttaaatagatactgcttttaacatcccgtgagggccaggatgttccgcacgagtctctctgctttcctgttctttctgacttaacgggattctggctctctgattattctgcatttcggctgttaggattgtgatttcccccttttttttctgaagcgttaatcagaaactcccat

SEQ ID NO: 6825 - DNA, 1348 bp, Homo sapiens
gtgagactccatctcaataaataaatatatatataaacaaacaaataaattaataaataaaataaaagtttgctataccaccactccagatacttagcactcagtaccacatgattgttctaaatgctgttttctaattctcttctccagggtgtagacgtggatatctcgtttagtgtatcagagcccagttaagcaaatggctaattttctctggaatttggggtctagttactttttagtgttactgactttacacaaggtttggaaaacaagccagttcagtgattttcttttcctcactatacacaggtgctggatatttggatgatgtcaccctggcaagtgctcgtcctgggcctggagtccctgcaacttgggtggagtcctgcacctgtcctgtgggatatggagggcagttttgtgagatgtgcctctcaggttacagaagagaaactcctaatcttggaccatacagtccatgtgtgctttgcgcctgcaatggacacagcgagacctgtgatcctgagacaggtgagatgatctttggcagctcttagacctaacttctctttagcaattgtgtagaaagtgctcattgtcttatatacttgtacatttgcctgttttctcacgcctgccttccaaataggtgtttgtaactgcagagacaatacggctggcccgcactgtgagaagtgcagtgatgggtactatggagattcaactgcaggcacctcctccgattgccaaccctgtccgtgtcctggaggttcaagttgtgctgttgttcccaagacaaaggaggtggtgtgcaccaactgtcctactggcaccactggtaagtctgctcgcttcatctgctttcagtgttcccttctataaaaagacctaggggaaaggggcttcggagttgttttggatctttgtgtttggttcagtttcagtggttatggttttcctaataggaagctgaggctcactctccttgtttccttccatctctcttttgggtatcccctgattgtctccatctgtcaaccaagggctttcatgtcaccttgatctaccgtctcccctttaggtgatcaaatctcatcttgaggcttcaaaagcctttctatatctatgatagctaagtttgtatttccagccctggcacctctcctgagctacctacttgccatttccacttggatggtgggctagaagccttccacttgcctttccacatccctgttcacctttctgcaccctgactgagacctgcatgcactacatcaaatgtcaggctccatttgcattcagacagcagaaagcacatatgggagctcacagagaaggagga

SEQ ID NO: 6826 - DNA, 1248 bp, Homo sapiens
gcccttttggtatgattacgtgtaaacatctgcttctccttggcataaacacttgcctggaattgggcctcagaacagattggcttttgctttctgaattccttcatttctcctgtggaatgtagcataagtaattgactcagttcagagaacacagtgaataaacaaactataagataatgcaaaagaagcattagcatttgggttttctagttccttagagaaatattaaacagtggagaattgaaggtagagatgaatccttgaagtgcatgaaacgagcactgatagtttcataacttctctaattgctaagtaacctgaagtgtgtcccaaaggttgcacgttttactttaaagctcattttgacttttaaaaatgtcagttttctctgctaaacagacttagccatttaagatctcataaatagtcctgtttttcaaaaaaattatgacagtatagtcagcttatagtcagcttattgttatcagtctgaattaagagatatactcttccttcttttgctaattatgtattattttctccttattctgcagcctgtgactgtcatcctgagggatctctttcacttcagtgcaaagatgatggtcgctgtgaatgcagagaaggctttgtgggaaatcgctgtgaccagtgtgaagaaaactatttctacaatcggtcttggcctggctgccaggaatgtccagcttgttaccggctggtaaaggataaggtaagctgtcaatagtgcattcattcattcatccagcagacgttgagtggcaacttactgtgcactaatctctatagaaaaagtggtgaacaaggtagatgtggtccctgttcttaaagacttatgttccagttgggaggcaaataataaaaaataaataaataaacaaaacaaacactgagataagtgccaggaagaatacaaatggagaataactgggggaaactactttatgtaaggcctctctacagaattcatctaaggtgagatctgatggatacaaaggaatgagccgagtgaaaagtaatggtaggtttgttccaggcagaaggaacctggtatacagaggcctgaaagctggagagtggctggagcctgctgagtgcagagggtgtgttctgttttttaagacgggagaggttggtacggacaggttatatgggaacatgatgaccatagtaagaagtttagattttatcccaaatccaataagaatgcattgaagaaactct

SEQ ID NO: 6827 - DNA, 1184 bp, Homo sapiens
gaaatgatcacaaaattccaaatgaatgacgttttctaatatttgtagaattgttgcccatgttagtatatgtacatataataaagtaggccgggagcagtggctcatgcctgtaatcccagcactttgggaggccaaggcgggtggatcacctaaggtcaggagtttgagaccagcctggccaacatggcgaaacccatctctactaaagatgcattagctgggcatggtgtgtatgcgtgtaataccagctactcaggagactgaggtaggagaattgcttgaaccgggaggcggaggttgcaataagccaagatcacgccactgcacaccagcctgggtgacagagcgagactccatttcaaataataataataataataataataataaagtaagcattacctgaattttacttatgtccctatcagatggttgtttcatggcttattttttgttttatctgtatagtcataaacaggaagctgatgacattgttcgagtggcaaagacagccaatgatacgtcaactgaggcatacaacctgcttctgaggacactggcaggagaaaatcaaacagcatttgagattgaagagcttaataggaagtgagtataatttgaaagtggtttacaccccttcaggtgttctggtaagtaacactagttcaatgaaaaattaaatgctggtgcattcagggcatacattcatgcagtaagatttcctttgttaatcatgcttttgaaatggaaaagtaagtagagaagggcatgtgaagccacagagatttggtttgattcaattactgtaactacagagaatagtaacaagatgagccatgatacttaaaattgtgcacaaataaagaagaaaaaatataatagagtaagtagaggaaacataattgaactacaaatctttaaagggtgtctgaaataagaaagtatatggtaagccatacattatagaaaattttttcttttttttgttgtttttgtgagatgaagtctcactcttgtcccccaggctaaagtgcaatggcgcgatctcggctcactgcatcctctgcctcccgggttcaagcgattctcctgcctcggcctcctgagtagctgggattacaggtgcctgccaccacacccagctaatttttgtattttcagtagagacggggtttcactat

SEQ ID NO: 6828 - DNA, 1175 bp, Homo sapiens
gtcaaaactcatcaaactatatgtggattctgtgaacttcagtgggtgtaaagtatatctcattttttaaaaaagtccataaaatcttgatctgtgcagttcttttaaaaatatcattgagtattaggtgttacagagttcctaagcctaccttttcattagtttaaatgttttatccaaagtgtagtgatcttacttgcttttcacagaatgaagcaaataacataaagatggaagctgagaatctggaacaactgattgaccagaaattaaaagattatgaggacctcagagaagatatgagagggaaggaacttgaagtcaagaaccttctggagaaaggcaagactgaacagcaggttggtttgatttgcaggtcgcttcatttcttgaggcaacatttgaacagtccaaatgggtctgtgatgatgccgtactttcagagacagcagaccccagtgctgagagagcagcctaacagattttatgctggcaagtctcagggtggcacctctggagagccttgtctgtccaggagacagaagggatttgctttgagggttcatcctctcatctgccatgtgtttgcagaccgcagaccaactcctagcccgagctgatgctgccaaggccctcgctgaagaagctgcaaagaagggacgggataccttacaagaagctaatgacattctcaacaacctgaaaggtagaaaaggctgagataacaggggcaaatgcttccgccactagagtgatttttttttttaatcatgacttttaccatatttattacttcatccccaactccctactttttttatgctaaagtatttcaaagggaaatcccagagctcctgtcattttatccctgcatacttcagtatggatttttttttaaagatgttttcttattaggcaaactcacataaccaagatgcctatttagagaacttatataggtaaatggagattatctttcattttctctgccagtggcatctgattctttgttgttgtttttttttcttcaccccagatagaagagaaatgtgaccaattcactgagcaactgtgaattcttgtctgataaaacagtcataggttctataaatagagaagctttacaggatgctttacagggtactagttgaaaatatgggccaggcacggtggcc

SEQ ID NO: 6829 - DNA, 1190 bp, Homo sapiens
aaccttgtctctcaaaaaaaaaaaaaaaaaaagtagtagttcaaaatatggactctggtgtcagtgggccttggttcaaaaccctgcaccctgcaccacaggtcatgtaacttctttaatcctcaattttcttataaaaatgatacagcctattttatgtcaaagacacaaagctcttaactcagtacccgacacacagtaaacactaaataaattgcagcttttaataatggttgaggtagtggtaatgggatgctcagcgctctgcattttaaagcacattgttgaagtaagaattctatttccagaaacggaacatttctataacactaactgggagacctattctgtagagatgtgtaatttctaaaatttcagcccatgctctcttccattttttaccctgacttccattgttcataaaacaaaatccagttggaactccctgaaaggccccctttttacttgttgggagtttagctcaaatgtgtccttgaacttgtttcagattttgataggcgtgtgaacgataacaagacggccgcagaggaggcactaaggaagattcctgccatcaaccagaccatcactgaagccaatgaaaagaccagagaagcccagcaggccctgggcagtgctgcggcggatgccacagaggccaagaacaaggcccatgaggcggagaggatcgcgagcgctgtccaaaaggtgtgcgtttcctcttctccaagagtccctgcccatatctttctctggtcactttccagtttctttccagaccctcagagcccttgcagatttttttcctgaacttcagtaaaattgtcttaaaccatatttgtctttttttttttcttttgactaggcatgagagtaggtatccacattgaggaggggaactcagtaaaagggtgctttactctaaaatttctactatgtctcagtgtgaggtctggcttcagaggtctatagagcccattcccacaaaaaatcagactttttctaaataaacattcttctttgacctagacaggtggtatttatttcaatactatgtagtgtgccttatcaatataactttcaagtccccctttcaagtatattgccatatgtaagccactcctaggagagacttcccatagctgccattgctaggattctttgaagtcatcttcaagaataatgttttt

SEQ ID NO: 6830 - DNA, 2836 bp, Homo sapiens
ttgataggaaagtgtctgacctggagaatgaagccaagaagcaggaggctgccatcatggactataaccgagatatcgaggagatcatgaaggacattcgcaatctggaggacatcaggaagaccttaccatctggctgcttcaacaccccgtccattgaaaagccctagtgtctttagggctggaaggcagcatccctctgacaggggggcagttgtgaggccacagagtgccttgacacaaagattacatttttcagacccccactcctctgctgctgtccatgactgtccttttgaaccaggaaaagtcacagagtttaaagagaagcaaattaaacatcctgaatcgggaacaaagggttttatctaataaagtgtctcttccattcacgttgctaccttacccacactttcccttctgatttgcgtgaggacgtggcatcctacgttactgtacagtggcataagcacatcgtgtgagcccatgtatgctggggtagagcaagtagccctcccctgtctcatcgataccagcagaacctcctcagtctcagtactcttgtttctatgaaggaaaagtttggctactaacagtagcattgtgatggccagtatatccagtccatggataaagaaaatgcatctgcatctcctacccctcttccttctaagcaaaaggaaataaacatcctgtgccaaaggtattggtcatttagaatgtcggtagccatccatcagtgcttttagttattatgagtgtaggacactgagccatccgtgggtcaggatgcaattatttataaaagtctccaggtgaacatggctgaagatttttctagtatattaataattgactaggaagatgaactttttttcagatctttgggcagctgataatttaaatctggatgggcagcttgcactcaccaatagaccaaaagacatcttttgatattcttataaatggaacttacacagaagaaatagggatatgataaccactaaaattttgttttcaaaatcaaactaattcttacagcttttttattagttagtcttggaactagtgttaagtatctggcagagaacagttaatccctaaggtcttgacaaaacagaagaaaaacaagcctcctcgtcctagtcttttctagcaaagggataaaacttagatggcagcttgtactgtcagaatcccgtgtatccatttgttcttctgttggagagatgagacatttgacccttagctccagttttcttctgatgtttccatcttccagaatccctcaaaaaacattgtttgccaaatcctggtggcaaatacttgcactcagtatttcacacagctgccaacgctatcgagttcctgcactttgtgatttaaatccactctaaaccttccctctaagtgtagagggaagacccttacgtggagtttcctagtgggcttctcaacttttgatcctcagctctgtggttttaagaccacagtgtgacagttccctgccacacacccccttcctcctaccaacccacctttgagattcatatatagcctttaacactatgcaactttgtactttgcgtagcaggggcggggtggggggaaagaaactattatctgacacactggtgctattaattatttcaaatttatatttttgtgtgaatgttttgtgttttgtttatcatgattatagaataaggaatttatgtaaatatacttagtcctatttctagaatgacactctgttcactttgctcaatttttcctcttcactggcacaatgtatctgaatacctccttccctcccttctagaattctttggattgtactccaaagaattgtgccttgtgtttgcagcatctccattctctaaaattaatataattgctttcctccacacccagccactgtaaagaggtaacttgggtcctcttccattgcagtcctgatgatcctaacctgcagcacggtggttttacaatgttccagagcaggaacgccaggttgacaagctatggtaggattaggaaagtttgctgaagaggatctttgacgccacagtgggactagccaggaatgagggagaaatgccctttctggcaattgttggagctggataggtaagttttataagggagtacattttgactgagcacttagggcatcaggaacagtgctacttactgatgggtagactgggagaggtggtgtaacttagttcttgatgatcccacttcctgtttccatctgcttgggatataccagagtttaccacaagtgttttgacgatatactcctgagctttcactctgctgcttctcccaggcctcttctactatggcaggagatgtggcgtgctgttgcaaagttttcacgtcattgtttcctggctagttcatttcattaagtggctacatcctaacatatgcatttggtcaaggttgcagaagaggactgaagattgactgccaagctagtttgggtgaagttcactccagcaagtctcaggccacaatggggtggtttggtttggtttccttttaactttctttttgttatttgcttttctcctccacctgtgtggtatattttttaagcagaattttattttttaaaataaaaggttctttacaagatgataccttaattacactcccgcaacacagccattattttattgtctagctccagttatctgtattttatgtaatgtaattgacaggatggctgctgcagaatgctggttgacacagggattattatactgctatttttccctgaatttttttcctttgaattccaactgtggaccttttatatgtgcct

SEQ ID NO: 6831 - DNA, 2358 bp, Homo sapiens
tgtccaggcagaacagtcataagccaggaaatgaaacaaaggaaaacaggtgcctgaatttcctggggaaacatggcttgtttaaggacttggagttatggatggaatttatgggacccacgtgagcagacctgaggaaggctcgatttcttttgtttcttggtccactctgtcactctgctctggtcaagccccatttggtctacagcccatgagaaggaatgaggctggttctgcactctcagcatgcagtccgaaagcatgtgggagtggggagggaaagtgagatgaattaagacaaagaacaggtgccatagaagtagatttctaggaatgaagtggggcagatcttatctttgtggattacaggcactgtactaaaaacaggtttcctatttaatataaaaagaaagtgaatcttcttttggatagaatcatccattcccatcgccgcaccccctaccccccaaacacacacacacacacacacacacacacacacacacacacacacacacacgccctactcttcatttgctaggggaaggtcacagcacaactaaatccaggacaggacattgtgaccatgacccagccacagtcaataccagaaagatgattcagagtctgaagtggtgccccaggtgccaacaggataacctctaccccccgactttgtctctggggtcctgttccttcctgcaaagcccaatccaagactggcatggctcagaggttgtgagaaaggcatggactggaacaatcatgtccagaggggtctggagctttgtttcctgttcaccagcaaaaaatgtctctcccatttttctgaaagtggctgatgtaagaacaggcagaaggaaaaccctttttgtcaataactctgtccttaaggaatggtcctctgggagggctgtgctgctagtgggtacctcagtcacacacccccaaccccaggcagcctctagagccttcttgctttcattttccttgaatgtacataggaacaagggggaaagtctcttactgaagtgcctgaaacccaaagctagagcttctagagacgccgttcttcctgtctcagcttggccagcctttcaacaatgttctctagtttcaagctccagcttctcagaaagaattaaagaacttgctgttcaaattaagtagaaagtgagactcaataataactgaactacagcaaaaggcagagaattacagggagaaaaaacttgtacttaccagcccaattctactctcctcaaactgacacacacacacacacacacacacacacacacacacacacactcttttaggggactaagagagagaagcatgttattacattttactcatccaaacagtaatgcaaaaataaaacggtagaatatgaaaagctcaggatctctcccaaggctacctactgcaggagggccaacaggtgagatgggaagaatggaaacagggaccgattttgtagctcatacaattaggacaccttaggaatagcattgtagtaatggtgatgaatatgctctgccaaattcatccagtctgcaccatcttatagctgcccagcacactcgactgttcatgtggtctctttgtagtgtgagtttggagtgtcctattagcctgttctggttaggaatgagttaacggctctttccctcaaccttagtctagtcccagggctgaggattcagctggatccacatggtcttgagggttggcatgaggagggggaagcttttttgaatcgctttttgatcacataatctgccattttaagagtaagatttgctttatggaaatcaattcattaataaaaaatgatattcaagttgcaataccatttcacagtgaaatattttgagtacaattttgttgctagaatagtcatgggcaagagttttatgcaaaatgtttcaattatgttaataaataagacaatgctacaagagtcttgtgtcttggtcaagaactttctctgtgaattgcagcattaatcactttttcttcataattttacttgacaggagacaacagttgtaaaaatgtacttagaacaagcagtttcctgcctggttcagctgatgccacatgtgttatataaaagtatgtacagccacatccaaggatgataaagggaagaataattagcaaatttgtaaattgtgcctccgttttcttagttttgaaacattaaatcttacatcttgactaatttgcatagtccagtgttggttaactttggctcctcaatgaaattagtattttatgaaataaaattatatttgtgaaaatgaaaaacttgaacaactttttagcttgaaagatcttaactaaaacaga

SEQ ID NO: 6832 - DNA, 1169 bp, Homo sapiens
cagaatcttaactttctcctgtaggtcagccttataatcagttggctatcttagcttcttccaaaggagaccatctgaccacaattttctactactgcagaagcattgctgtgaagttccctttcccagctgcctccactaatctgcaaaaagcactttctaaagcactggaaaggtagggttgtttggttttttttttctctttccaagaggactttgtaacctggagccttaattcctcataatttggtttacagaaaataacggcctatgcttctcttatttctaaacatatagatttttcataatttgtgtatagtcactgaatttcatccaatcaatatctgattcagtcccagtaaaagagtacacaggctgttaatactgactcatcttgagtgtgttgcagttgaaaaatcagtcaaatacagctcttttgtgtatcaagtatttagcaagccagtgcctccttaaacagttgtagccaatttgctgcttatgattcatggaatttttttctttcatttcagccgagatgaggtgaaaaccaagtggggtgtttctgacttcatcaaggcctttattaaattccacggtcatgtgtacctgagtaagagcttggaaaagttgagccctcttcgagagaaattggaagaacagtttaaggttagatttcagaaatagagaatttttgtcttgtctaaatcaggaagcataacatttggaggaaactgactcccagtttttgtagttacttaactgtgtgaactattggtaaaaattatattcgaagtatgtgaaatctttgcatttatcatcccttcaatttaaactgaggtacagtctgtataaacaaatataatatagcagtgttttcacttgagtagttgccatttgacaaaaattatcaaagtggaaaaaaataaataactcctcagttttgaaactactactacttttgatggtttgtgtattcttagatatgattatgttacctgctttatagatattggcattctccaaaccaagttcattatttttattgtgcttgcattcatcaggattgtggtagtttgaatgaaaggaatgagagtttcatttaacagggatatattttactaatttgaagagataacattaaccttcattctatttatatatgtgaaaat

SEQ ID NO: 6833 - DNA, 1185 bp, Homo sapiens
aattgtgtattaagaaacagagtttagagttaaggcttttgtaaaaatgtggactttttgtaccataaaaaaagaggcattatcactttgaacagggaatgtgatttgtgtggtataaccataccctgtcacagattaaagaactaacagcggcttccacaactcataatgtatgtgaaagctctataaaaacatagtatgttatttctttgctcagaattttctcagcctatttcagttttccatgtttaaaactgacaaattattttcaccatttgttgaattaggagcatgggaaatgatctacagtggtagtaggtctctgtcatggaaatttgtcccttttgttgtatctttatcattatctagtgtatctttgaaagtacatttttaaaaattatacagcctttgaaatgctgaaataagggaaaaatacataaagtccaggacctatagataccattttcatggcttattagtgttctggtttctcttacataaaaataaagtctgaactctttctttaatttacagcatttggccctggttgatttctcttctgaatagtttccatccccatgaagaggacctctcaagtattagtggtaagggctaccctaaccttgtgttgttgatgtggttctccatcattaatggtggcttaatgccagagaaaaagaggtttttggtgatgaatgattgattttaaattcagtatctcagaagtgactgtgaactctacataagtgggtgggtggaagtagataatgttctcccagttcttctggcagcttattctcatttagcatcattcaaataggagttcagagagtgtaataccttcagattctttcattccttcctcctcattcttactattttaaaaaaagcaattaacatgaacattgctctgtcaaagtaatacttactcatcgtagaaaatttggtacaaagaaaaagaacacaaatctcccatacagagataccttttactagtcacgatagtatatcttcttcgggcctttttcttacgtgtgtacacacacacaggaaatgattcatatcaaataaagttttgtgcctgattttgaaatttagtattatattgttagcattttcttttgtcattaagcattttgaaaacatgacttttactggcttcataatattccatcctatggaagt

SEQ ID NO: 6834 - DNA, 2924 bp, Homo sapiens
tccatgatgcatcctggaccttctgctctggagcagctgttaatgcagcagaagcagaaacagcaacggggacaaggcaccatgaaccctccacactgaggccaaagtggcaacctgggaatgaaggctccataaaccatggcatgttgggtttgcaggactggcccacacagtcccctgcaggtggcagccctcttttctgtttctcgctgtcaagagggtgtaagtattccaccagcccgctgagtgtgcacgaaatgttcgcagtgcaacaaaaagaaaaatccatcaggaactctccgtccccccggggccctccggagggagagagagaggaactgctgtttatctcactcagttacttggtatcaccgcctctcaccttctccatcgtgcatgtccccagccacatgggaagtgaaagctgagaagggaaggcagatgggagaagccaatgggaacttctcagtccttttttcctctttggggaataaaataggaatccattaatgattgctttgctgactgagaatgtagttgaaattattcttaaacatcttttattattattactctcagtagtaaaatatcacactgaattcttccatacacaggtgtgcttctagtcagtgtgtagcaaggaaagccccgttcactgctcctgtgagaggttggtggtgacaggatggggaaccgacctcttcagccagtggaaatgttccataagggagagttcaaggcctgtcagaaggctctggtaggccttcctctggccaggagactccagcagggaatgcccttcactctgtaggtgctcgagccccaatcgaggatacagtgtgggtggtggtgctgggctggactagcaggtagactgctgtaggatttcaaattacgtttttgattcctgtacattttacagtcgcacagcaagcagtctcacagaaggcaggctagtccattcacagcctgacacgttctaataggtagaagctttcagtgtggttattttttctttggttggtttttgtgcccccattctacttcccaccctcctgccccatctccatcccttcttttacccaatgctgtatgctagtaattgtttttattcctaatgtgtgcaacatcacatctccccaagaagcaacagcatggggtccagcagttggggcccaaaagacagtctgaagaggaaggaagcagcagtatctgcgtagcccacagagggcccaggcccctgcccagctgcagtctcccagcctccactttcagagtgaaattcaaggcagcacggacatgtgcccatcaggcacagaagaaaacacgacgtcgtccattttggaagagacgaaagaaaggaaaataaactctttgtatgatatttattaggaggaaagaggactgaaaatgttcttgtgtagaaacagaaggacagcatttctgttagtcatttcctggaaaagtaatattttaaggggaaattatggaaacaatctaattgttcaattgctgtgctagtggtagggtttattttctgggaggtctctcctttgtgtgtctgtatgtttgtgtacacacacgtgcccatctgctgtcccagaggggaggggttgtgtgtgcgagtgtatggagttagtgtggaacttaagagctggaagacagctgtagagcaaagcacatccaggagccccagttgtcactgcagtctgggcaaccccagcaatgaaaaggggtgagataacgctcattgctcttcagagagagtggttggagccccccccgccccgtatgcttacattattgctcttttagtttgacatggtgtttgggttttgtttttttgaaaggtctgaaaaggtgaagccccctacccaatggcaatatgaaaccttttgtgcttctcttcagccccttccctgtgtccacctttctctcctcttcccaagcctttttcctactacctttacccagtttgtgtgtttgagctctgcattcaggcagctgcaacattccagtgtttgaactgtcactgattcttgcgccctagacaagctaaccaggtttaccatctcactcccagtaatacccagctcctatctaaagccccattctgcatgagaatttggtgtttggaatgttttctgactcttggggcgggattcctcgccttatcatcctcactgtggagtaatgagggggaggagaatctttatcagaaactggttttgtgtagtaaactttcttttgtggttttttgttttgttttctgggttttgttttttgtttttgtctgtgcaagacctgcagctgctgaaaatcagctttgcctttaattaaaccatgttctctccaaccagatctgtgtatcgattctttcttttctatcctaaaagatataaaagaagtattgaagaaaatccaacttaaaaggcaagaatttcaactactcacaggtcatccagggaaaggcataaatggtcagaacttgaatatttttcagggttaattttgcttttagtagcattccaaaccaatgaattacggaaattataattaattgtaatggaaaggcatgagtagtaagaaatcgattatcaaaattcttttatttaataaaagaatgccttatgttaaggaattaagagcccatcatttttatttttattcctattgtagctgttactgaggcagttcagagagtttatccttttggcctgtaaaaattcactgaatctgattagcagcaacattaattaattcttcttcttagctttggggtttcttttctttgagttgtgtccaaagtttccagtgattggtagcttgctgggtcttccaactgtgtgctggaagccagtggtatagctaaccttaatgcctgtgtgctcaccctgaccggctatcctttcacctgcatgttg

SEQ ID NO: 6835 - DNA, 1208 bp, Homo sapiens
ttgcctcctgattatctgtactgtgggtttaagtatgctactttctctcagcatccaataatcatggcccctcaatttatttgtggtcacccagggttcagagcaagaagtcttgctttatacaaatgtatccataaaatatcagagcttgttgggcatgaacatcaaacttttgttccactaatatggctctgtttggaaaaaactgcaaatcagaaagaatgatttgcagaaagaaagaaaaactatggtgtaatttaaactctgggcagcctctgaatgaaatgctactttctttagaaatataatagctgccttagacattatgaggtatacaactagtatttaagataccatttaatatgccccgtaaatgtcttcagtgttcttcagggtagttgggatctcaaaagatttggttcagatccaaacaaatacacattctgtgttttagctcagtgttttctaaaaaaagaaactgccacacagcaaaaaattgtttactttgttggacaaaccaaatcagttctcaaaaaatgaccggtgcttataaaaagttataaatatcgagtagctctaaaacaaaccacctgaccaagagggaagtgagcttgtgcttagtatttacattggatgccagttttgtaatcactgacttatgtgcaaactggtgcagaaattctataaactctttgctgtttttgatacctgctttttgtttcattttgttttgttttgtaaaaatgataaaacttcagaaaataaaatgtcagtgttgaataatttatttttctctgactttaacaattatgaatgtatggttaattaagaggaaaggttttctgcttctaccaccaagtactgtactcttaacaagaacagtttggtagggtttttataagactatatagatataagatgatagagaagagagtcatgaatgatgtcagagcactactgaagcctttggagtgattccatagccttctggatggcagctgaatacctatatgtagtatcactgcccaaagacctagactagaaagtgcaaagtagcttagcagctgcagtcattcactcccagcctccaaaattctctttctttcacctcaaatctatttcttgtacttacctactcacagcgacttctgtttgctttcgatcttcacctgactagattcccactttaaaacacttccaggcaattc

SEQ ID NO: 6836 - DNA, 1204 bp, Homo sapiens
tatttaacaattgcaagttctttagagacagagataagatcttatattgccttttaacttccactatacctagaagaattttatagattatatatgcttgatgaccacttgatgattggaagaaaatattaaataattttttcttctcaatttgacaattatattttaattttcagtatctagaaatgatggaattagatataggagatgccacccaagtttatgtagcgttcttggtttacctggacctcatggaaagtaagttgtttgtttatattgttttgttattgggactgtggtagagatttggggggttggattgggatatagcattcttaacataataagcaatcttttatgcatttgctgttaattttgcaatttatttatttacattgggaattactgagtaacagaagctactagaaaagcaaagacaggaggtagtgttacgagtgatatttgctcagctgagtattaggtagaagtttggagtttttattttttgtatttaataaacattattgtccattcaatgatgctctttcaggcaaaagctggcatgaagtaaactgtgtaggattaccagaactccagctcatctgccttgttggtactgagatagaaggggaggggttacagactgtggtgcctacccccatcactgcttccctcagccataacaggtgagcaggtgattttggtctaagttcctttcccgagtaaagcagtaggaaacattaaacatagtgatgtaatacttttaatgaaatttgggatacagggttcatagctttactcttggctatttgaggaataagttaaatatgagtgttgtattcggccattcttgcattgctataaagaaatacctgagactgagtaatttcttaaaaaaaaaagaagaggtttaagtggctcatagttctgaaggctttacagtaagcatggtgctggcatctactcggcttctagggaggcctcaggaagcttataatcatggaggaagttcgtgaagcaagagcaggcacatcatatggcaaaagcaggagtgagagagagtgttgagggggaggttccacacacttttaaatgaccagatctcacgagaactcattgtcctgaagacagcactcagccatgaaggatttacccctataacccaaacatctcccaccaggccccacctccaacattggggatt

SEQ ID NO: 6837 - DNA, 1128 bp, Homo sapiens
ctagagatggactgagccttgcttctcactggcagtgttgagctttggagatgggatggttgctatgccaagccttgtttctctgctcagaagaagtagagaagctattatcaattaaaagcatgctgtgatgtgactcctggaagtgacgtaggagtgagtggcaggttgtttgatttaataggtatcttaatcaagaattaagcttgcaacattggctttgctcagatgcagatggaagtgtgatcacaatcattttgaatccctcttcctcacttttttttctaagaaaataaacattttactgtttttatggatccttgtcttctcccattcatccagctcagtgttttaagatgatcctgggtgcagaagttgagccctcctttgcattgacactgataattagcctatagggctccctacccttccattaagaatctaccaagcattagcaaggctgaaagtggtctaagaggtgaggggacatcctatgactttttaggaaggcctgaaaccaccttgttacctttcattttgttagcaaataaaccatcctattttgtaactctcccccttcaaaatgctacatgagccttgccacttcctttttctcttacttccagcacactagacatagcaaaagtgtttgcctactcaaaaacataatacttttatgctgatgatggtatttggagatgtgaaagccaaaagcccctggcagtggtggggaatgttgactgagtgttcagcagagtttatttttccatactatatgaagagaatgatctcttctcaaagacagaagtgatatttttaacaaatattgtcacaagtaaatagcaatcaaaaggagaaaataacttttgtatttttttaatgtgtttgatagctttgacgagggttctctttgttactttcaggggagggcatcctattaaatgccacgccagcagtccgggtctgggtttgtcccacaaaatcacaggagcactgtatgttcctctcttttggagttgtgactttgaagggcctcaatattagccacactgccgcctgcagaaggtggagagttaagatgttctatgtcaatttgctcttgccgaaaagatgagcctcgattttaaa

SEQ ID NO: 6838 - DNA, 1205 bp, Homo sapiens
ttcagcagctccactgggatgctctaaccccagtgtgtggagttggggtcccttcatctaggttgacccaggtatagcatttttagcattgcctttccagtcttgatgattcattcattgaactcatttatttctggagcccctggtacactccaggcactgcgctaattgccagcaaagcacaactgaactaaatccaccttcaaggaacctagccataacgagggaggcagcatggaagtaccctacaggggaaagtcctgagtgctgtgggagcatctcaccgtggcagccagcccagttttggcaatcaggggcttcctgaaagaggtgacatcaaagcccggatgtgtcagaggactgagggagagtgttactaaaggactttcaggctgagaggatagcacaggactcagcccaaaggagggccagtgtggactgtccagggccagcctgcagtacagaggctggagcttggacttgtagagggagagagaagagcaagggacgtggacggggcagtgagccaggctagccacagagggttcccggggctttgctggggattcagggagcataaataagagctttaggtggtgctgtgtcctctgcagcccactgctgaggtcctccagacaggtaaggtgtggtcacaatcagggccggggtttccctgctcactgcggcagtgcaggggtgcttgctgagatgattcatcccagggtgtcctctgtcccttacccagccccaactcctcttcctctgccaaaagctatttgaattcaaggactttaacctgggccggatctggtttggagacaaaggggacagctctgggtcagcatgaccttctttagagccactaaggcgaaaaataccgtttgggaccaggctggcctagacccagggatgagaatgcaccctaaaataaatatacgggaagcagcagagggcttccctgtctagtgtgtgatcctaactaaaggcagctctcttggacagccttcccctggattaggtcacatacacctggtggccaagcctctgctgggtcccaaatacacacccgagtcctgccaaagaaaggagatttttaaaaagcacagacaaattgtatgcaagtggaaaatacccataggcctagacagctgtggagggaagacctcgtgggtacctggaggctgccagagctgggagctctgcag

SEQ ID NO: 6839 - DNA, 2939 bp, Homo sapiens
tcccccttcaaatgcagcactgcaccaccctgcaacacctcaggccagggaaagattactgagcattcctgcgaaccagatttctgttgtctctggatagacaagaaacaaaattcatttagtagtggagtggggaataggagtttggatagccttctaattaaaggaagctcgcctttcttggttttgggggttagaggctcttttgggaagatgcatccgagtattgtggcattctgattatgctgccttcacaaaacactctaagtgacctaagtggttatgaagcaaatgcatttatggtgaaaacagtctttgctcattgctttctcttgtttcatttagtgacaaatgatcaagatgacttgattttttttccttcttaacaatgtcttttttatttaaaccaaaggtgaagccagtgtactttctcagtgagttctctgcataaagactaatcagtgggaccaggtaaaaaggtcatataatacattgtggagattgcttacttaatacttctgaaaaatggagtaagggagaaactgtaatgttgcaatatgaacctcccattgggccttccatagggaaagctgtgactactctgaaatggaacctagcattatatccttgtagggtagattataaatcatttccagttcatttctcttagaggtgattacctctagccatcagccttactccatcccatgtttggtatgcaatttgagccacaaggctcgtatcgccaacagctatatacattttgttccatttttctgtcttacagagccatgatagaactgtggttagtgagttaaaattcctggagtaactactgtttttctcctttgaaacttaggtttctaaagttgcacctaaggaatctgtcacattttctgttgaatcatggtttttgtttttgtttttaacagatattccttctgatacggacttgaaaattagtgtatggtgacctgtgtttaaaaaaaaaagtacaatacaactacatatagctatatagcttaatgagacttccaccccccccctttttttttttggtttgttgttgttgtagtagtctggtgctggccacatttaagtcttaaaaatttttaaattttgttgttgatgtttgtagacagccctgttgttgaaatcatggctttattcattttatttattttttaaacttgcctgaatttgttctaaaggaatatttaagagacataattttcttctctttaccataacattacacaaaactttttcctaaaacacggttgtgaggtactgatgaggtgtaagtggagctgttaaaaacagcagtgctgtattgcagttatgtatattcgtgtacagtatgtttagatcccaggtaaacatattcttttctgagaggataaatacctgcattcagatattccaggtaaatataattgagtcagggagtagtaaatctgatggagaattcactttggggaggggaaaaagaatagtatgcaagacccttattggcttttaattatacctgaaaccaaaatggatatttttagtctctctgcatgtgagatttggtgtaacaagatagaactataatatatacagtatatggaaggatagatatagtgctttgttcattttaattgcaaagctgccaaaatagttgaagcttaattacttgacttgccttgatttataggactggggcttggagaaaatgagcagatgttcctctaagacatcgattacagaagccttatatacatggatttgattttgtatttgtagctgaaagtcactgttgtctaaaactaacttttctaagttatcaaaacaacctaatttcttttccaacaaggagaacttaatggcatgaaggattgtgtgacacattggaaaagccagcttactgccactctcttcctttggccattagagggaggtgttgcctttcattgacgcttagaagcaaattgttcacttgttaagaaaagtaaatccttaaaaaaagaaaaggaaaaaatttaaccaatttttcttaatacccagaaggaattatactcaatatttccctagttaagaaaagaggagataatgttcgtctaaaaaactccaacgttgtaattacaactctacattcatttacttacttgacatactgccacaaagtagtttttgagttcattaaaaattccaaaggcattagttgttttttttttttttagtgttttgttttttagttaacttttatagacattttagtaacttgctaaagattcaggggattctatgaaaccccgaatttagaaacatctggtctacctcagttaaatgttgactgcttagaaatatagctgaagtgatcaccacagccataaaattgtttaagaaagatttatataatgtttacaaatctggaatcaaggattttagctgaaatcctttaagagatattagagcaagtatttaattcaggtattttcaagttttaaaacttaacctgtttacctactaaaaataaaatagctagtttttttctgcatataaaagttcattgaaatgatatgcccttatttgcaatacttttcccataaagttttaagtgtgaaagaattgtaatttactagatatgtttggtatgggatattttgttaggcaagttttcttttttcttcttaaattgcaataggcttccaaaaagagtataattgtttcagaacaaattaactcttggcattatacgtctccctttttctttacagtattagtaaaaagaaaaattgtacactttctgattttaacttcactaatgtaattactctctcaagaagcttttaaaatttaaattaccatcacacaaccttttttatagtaaagccaacatttgttctctcaccaaaccccatgccaaattcatcatgaagaaagctcagcataag

SEQ ID NO: 6840 - DNA, 1423 bp, Homo sapiens
gtttctgaggaacaagaagagatgggagggcaaagcagcgcggcccaggccacggccagtgtgaatgcagaggagatcaaggtagcccgtattcatgagtgtcagtgggtggtggaggatgctccaaacccggatgtcctgctgtcacacaaagatgacgtgaaggagggagaaggtggtcaggagagtttcccagagctgccctcagaggagtgaaagggacaatttggctgaagtctttctctgaaaaaagccaaagggttataggggtacacttaggggttgcatgcaagctgttaccaaaaaatttttaagtattttcttaatttgaataataaaaccagaggaaatgcatacagggcatgagcaactgaggcaaacctttgtggacatgaattgttctacgatgaatttttgctttagtattttaataagaattacaaagacaatggcatacttggggtgagagggagctgaggatgtctgaggagggaatagtattgcagggaagactgagaaaacagtaggatgacagttttgagtatactctgcacttttcaattgtgcaatcttcttgtgcactttaaggctttttaattttgtttgagaatgcaaatgtatactgtaagtctacctttactatctactatgcctacttcaccatctcttaaggactcggcatttgtccacagtcagactgcaagagagggtaggtcatgaacagtcacccgtgctggctgtagcccccacagaggcaatcatgcccaatagattcaagagaagctaagcggaaatggagggtggaaggtgtgatctgtgggactgtctgggcctgttactcatcctgctatcaatttcttattaattaatcttgatgattcttattaattaatcacatttgcaggaaattcagatgaggcaagaaaattttattggcctgggtaagactgaaagcattccaaattaggcttagactgtgcaaagggcttagctaagttatcgagcttaaaacccgtcaattaaacaaacattatttgaacagttactgcatgccacgcactgtgttgggcttagtaataaaaaaaagaaaagataagtgcttgttctagcataaattaaaaggtccaagggaatttaatctggaagagaacatatgccaatttttaaactatgacagcttttttttttctctttccattcaaatagtcctggttcattcccagaagggcacaaaatgaatgaataaataaataaatgaataaagacaaaagccaaggtgtatgctctcaagttccaaagatgttatcaaaagctgaaatcatttgtttggtcattcagcaagctaattgagtctctgttatataccaagcactggggataccatggcgaaaaacaactttgttccttcctcctagaacttaca

SEQ ID NO: 6841 - DNA, 1488 bp, Homo sapiens
gtatcttcatgaagacccaaggctcaaatttactgtccttaaaaacaattctcataggattattcttttcatggtattttcttccataatatctcattttaaaaagaagttctttatgaacttagtgtccattgtcatgcaatgtttttttttttccattctttttccctgtaattttggaatttctggtcctgggaagaatcaaacaaaatcttaagttctatgagaacttggttcattgacatattctgctgaagaaagaaaaattaaattggtagtaaaatatagtcttcaagtatacgtttgagagtgcttttttttgtattagttctgctgtcacttcatttcctgtattatatgtgatgtttttccccattaaaataccagagataatggagatattttgcactttagccttgatgaaaagtacaagatatgttcaaagcttccctaatttttttcttatttgtagccacataagtttcaagaataacatggcacacagaacaatggaaaaaagtttgtttccattggaaaattatatcattttgggttgccacatcagtttataaatttggcgctcttttaattacactctgtagaaggttaatagagcttgagccctgctttaatatgtagtgaaagataattctgtagaaaaacgtcagccagtagggtaaagtcattctactgttcttaatttttatattgaggaacaatattgggtgtttgggagccagaaagctttgttgacagatcagaaataagattgacttgggtgttatatttcatctctctccagactctaggtatatttccaactttatatatcacagtatttaaaaagacatgtttgcattgagaaattaaccctaaagggttttcaatagggtgtagacctccagtacctttgtaactaaagtctgtctagtcattgtaaatatttatctgtcagttttgacagattggggccagcttgatgttttaaatcttcagcccggtatgaaaacttaaaggtatatattcaattttttaccattttatggaaaatatttaaaatctgtttttacagggttttttttttttttttttttttgtaatctgtgccatgaaatttgaaaaccaccaaaaatcaagggaacttttatatattcaattccttttctggtgtaatgttaaagttgtatagattattaatgcatgcccactgaatataaccctggttttgtgataaaactgcttagattttgttgatgacattagattagtagttgcattaaataactaaattcccattgtgattaattgaaattttgtctttaagcagagagttatttgtgactataagctttgtgcttagagaatgtatgtgtttttatctgtcagtatgggaggatataaactgcatcattagtgaaattattggttgtgtaatcctttgtgaaatataattctaggtatttgatagggtattgagtgtattttgtg

SEQ ID NO: 6842 - DNA, 1306 bp, Homo sapiens
atttctttttctcctagggaaaagttaaccattggatgccgccagctggttgagatggaatataccatgcagcagtgcaatgcatctgtttatatggaggccaaaaacaggggatggtgtgaagacatgctcaactataggatataagtactgatttgtaactttaaaggaattgcatttgtccttaagaataacagagtagttttcaatctggtcactcttttgggccaaacccaagagaattttaagaaatgtttcataggtataaaaaggtgatcgcctattactgacagtctcattgtagctctaaaaagcctaatgtatccactgtggaataaactccatagactcaactcttctggagttcacaatgcctccctacctctattcttgatagtgagccagtatctctaaggaaaggagagccgtatttttagtcatcctagggcaggagccactgtggcatctgaggaagacccagggtacagtattagcatttctttcaaccctaagtatgggcatgtgaccagagacactgccaaaccctaagaaatcattagggcatgatcatgctcaccatatttcacaaatgaaatcttaatgtgggctgttttttatgatcaaactgtcatccatgttgacctgatgaaaataacaccctccttcacctccctcagggtaatgaaagtagaaatttgactgaagctcctacttccttatacagcctttccttctgtgggcttgtcacttttcagtacatttctagtggggaagagcagggcgacccctctgctgggtttctccttaaatgtgaagcaaaataaatttatataatggaatttggtggcagtgactgatgtttgtctctagctaaaaccaactgtttagttgactttttagttataggataagttggaagtccttgtttactggaatatattatgcttttgttaacacattagattaaatagaatttggtattctattataaatgtttattttttaaagcaataaataacttatttttggtaagatttggctttttacttccaaattgtttctgatatgtacataaggtatgattataaaagtgactgtctgcaataaaagagaacttgttcaggatattcactagttggtgtagaacctgttaagctttgggtttgccagattagggaaccacaccaccagccgcacagatggggctcaaagtgctgtcagagattatgagcttctgggcaaatggggaagctttaagagggcatctctgctctctgcctctttccttttctttcctgagaagcca

SEQ ID NO: 6843 - DNA, 1345 bp, Homo sapiens
aaagagggtgggtgggtatagatgttgctaacagcaacacaaagcttttgcatattgcatactattaaacatgctgtacatactttttgggtttatttggaaaggaatgcaaagatgaaggtctgttttgtgtacttttaagactttggttattttactttttggaaaagaataaaccaagaattgattgggcacatcatttcaagaagtcccctctcctccacatttgttttgccaatttgcacattaaatgactcttccctcaaatgtgtactatggggtaaaaggggtagggtttaaagatgtagacagttgggttttttaagggccctttttcaataactggaacactctataacaaaggatacttatttaaatagatgacattgactatttttgtttttattaaaaggaagcttacatgcctaccaatatttaatcttttatgattgcctttttataactttttatattctcagcagagtgctttaccaattgaagtaaaatgtggcaggctggagttattgaagcagagtggcagtcttcagtttgcagagtaggggtctgtcttttaaactctgagtgcaaacttcagagttcttgccttggctgcagtttttttccttcaagaatgcagtactaacatttatttgagtggagttactgaacagtaacatagctgtgatttttggtatttgaaacactggttttaaatattttgacttgttgagggtatgttttatatagcaagacattatatagcagtaaaaaatggtgttttatcttctatataattcctgtttttattattaacaaaacagtcctaaatagcagccctcaattgtgaaaaaatttactttaaactacattaggttgtgaatgcaggttttatcagaactatgtttttgttcagtttatctgttcatatggataaatattggttgggatgacttggtgtctaatgtgtagtgctacacacctaacttatggggccaaaatagcatgtcctaatgcttgctgctgatttaaacacattaaaggtactttgcaggaaatccttgcaccatgggattaatatccaattgctgcttgtacactcattcattactaaaagttttgagaaatttttttttccagtaatgagcttaagaaatttgtggaaaataactcacctggcatcttacatctgaaataaggaatgatataaggtttttttttctcacagaagatgaagcacacaggaacctaatgggccaactgggatgaggtgactattctgagatgactattcagtggctaacttgggttaggaagaaaataattaggtattttctccaaatgttca

SEQ ID NO: 6844 - DNA, 1159 bp, Homo sapiens
ttgagcaggtgatatttaccaatctgtaaacttcatgtagacagatttgtataccttagatatataataaatatgtgcttatattttatatttattgatttcttccttaaatccaaattaagatttggaaaatatgaagtgttatagtgttatattcatttgttgtatctctacctattgccattatattgttaatttttttatacaacacgataaagctttgtgattatgttttagctagtaaaagtgtaaaattttaatatttccatgttttccaatataacttttagattgtacttgtgtcacaaaaagagggattaatctgcttgtaataatttccattgaagttgtagaatacccaacagttttatatccacaatgcctagatattttttataatgaactagggtaagtgaatacactagttttgaattcttaaaagatatattcaatttgattcttttttcttttacaggtgtgagccatgcaatgggagggagaggaggaataaacagaggaaatattaattaaatggtctgtaaacaataacaactgtgaataagattatcaaatctgttttagtgtaatgattgtcaagtttaaaaacatttttatatataaactggtatactcatgtcaatattctttattaataaaatgtttttcagtgtcaaaatttattattcatttcttcattagttgactcctcctttgctcatcagtctaaggacagttgtaccagactttggataaggtctgcccagaacgagtagtaattgctcttgctgttctactaggcacatcaatgttatagtattgatctaaatggaagagaaaacatttttttagttaaaaagaaaacaatgcccaaactaaaaaataacttatgttgactattatgctcaaagacaatgtttatcattttaatagagatgtttttactaattaatttgaactttataacaaaaagaaaaacaattgcctagacttttcagcttttttgatgtttcaaaagattgacatttcaccatctttttgtaaaatcaggttcagctctcctttatgaagtaaacattaaagagtaaccaagtttgaaaaataatttacttggggttattccttttaaaaaatacatgccaatgtcattcatattatgaaa

SEQ ID NO: 6845 - DNA, 1298 bp, Homo sapiens
gtgcctcgtttggtggaggacccctctagcttttcagggagagtatcatgtcaaatttatgaagaacctagttcttcaaggctcagggctttattcagccttgcctatcagtctgctgagtagttaaataaaatgtcaaatcagttggattttgttacaggcatttttttaaaatgatctctaagacagtgtcctaacaacttacttgattttaaaagttcttgaattatttttaaacagtgctgtagattatatgaaataaaaattttgcaattcatagtaatgaattgcatgatacattgaaatataaacgggcttctgttaactaggatctttagctttttgagattttagttaggaaaaagtaaatttttatgttggagtaagtatattttatattctagtaataagttaaagcatgaatgtacttagaactttgctcattgagatgtatgatgtatcataactaatgtagatgttatagtagtagaatctgatgtgaccatgtgccaattaagtgcataaatgctgttttaaatgtttgattataatattaatataatcgcctggttacttctttaggtgtaaaagatcagctaactaaagaaaatgaggagcttaaacaaaggaatggagccttagatcagcagaaagatgaattggatgttcgcattactgcgctaaagtcccaatatgaaggtcgaattagtcgcttggaaagagaactcagggagcatcaagagagacaccttgagcagagagatgagcctcaagaaccttctaataaggtgattagctaattctgcttaagtaacaaattgtttttctttgtacattttacttgaaagtgcttggtgatataggagcctttgtcagtgaattttggctaaaattcaatatatgcggagagaattaacaataatgacaatttttttgtggcatttttagtggactcttgtgggctaggaacaacaatcaagagctttctctttataggtccctgaacagcagagacagatcacattgaaaacaactccagcttctggtgaaagaggaatgtgagttttagttatttcatagtctgttatttttcttttaaagctcagggaatatctagtgatctttctgtttaggaaaaagaaatctgtgtattctattgtaaaaacatacactaaagagttgttttctctgcagaactgtatcatgtatttgccagcttgttttcaccatactttcagtcctatcagatgaagctttgtgacagagaaaacgtctctcatcttttagtttacagttgg

SEQ ID NO: 6846 - DNA, 1158 bp, Homo sapiens
atcgaaaaattaagtgacaaggtcgttgcctctgtgaaggaaggtgtacaaggtccactgaatgtatctctcagtgaagaaggaaaatctcaagaacaaattttggaaattctcaggtaaatcatgttcttactgcttcatttctgtggtataacaactatgaaatgaaactacaaatatataaattagagaaggagattatacacgattttgatataaagttcattcttttatttgtcaaagaactcataacttttaacatttacacatattaaacaagtgactttaaagttgaatctgatagtaagaactagagcagttttctcttgaaaaactaaatgcctttcagatcattttagagataaacattctaaagccagtgtctataaaagaaaatagaaatacatctcccattattatttattattaatgaaaacgtgtaatagttattaaagtcaatgatttttgtcatcttaccaaattacctacgttttgtaatgttggctttttaaaattcacataaaattttaatatctgtatttttgtagatttatacgacgagaaaaagaaattgctgaaactaggtttgaggtggctcaggttgagagtctgcgttatcgacaaagggttgaacttttagaaagagagctgcaggaactgcaagatagtctaaatgctgaaagggagaaagtccaggtaggtatactaagctttaagaaagcacttgttaaatcaaaagagaagcactcatttatatctctaccatttaacgtaatgtaaaatttaacttgaagtaagcattcttctaaacttgtaaattcattaagcatttgttaaacactaatatagtatagtgcttaaaagtaaaggctctgtaaccaaactgcctggtttcagattctagcttcataccattagctgtggccttgggtacattgtttaacttccctgctcttagtttcttcatctgtaatatttggataataatgaggtttaattgagtttgtgcacatgaagcatttagaagcatgtctggtatgtagtgggtgcttaataaattccagctatcttaatttattatagttatggattatacgtgtggatagtcattctaggataaagtgatttaaactgctacagaatatctttctcacccaa

SEQ ID NO: 6847 - DNA, 1404 bp, Homo sapiens
attagtaagaaatgacataaaatacgtgctttctcaggttactgtataactgttataatatatttaatatataaaattaagacttttgcttccagcaagtatgttagactagatattataaaacaactagatcctgaataaaatctgcttttaataggttcactggaagtaggagaattttcaagaaccatacttcgacatttcctctgccacaaaaaatgaacgcattttaagttaggagtcatgaatactgtattgaccatacaagtggattatggttgtctggatggcagataccaatagcaacattgtcatatgcagtttgcctcaaatcagaaacaagaagacatcggaatctgagatgctgccctagagaggacagttaaagaaggttcagtggtcctcagtttgcagtgctctagctcctggcagaagcaagagggaaacattcctaatttagttccaagattcctacagattattatcaagtagtagtattttatgactagagatcacaggcacaagttgaaacaaactaacatgacaagaaagctatagaaaaaataaacattgaactcagttcttcaaggtttcatcaccaacataaggaatgaagttggaaccacaggcagatctgaaaaagaaccaaatagagctcctaaaaatgagaaatatttattgaaataagaaaaaagccctcagacatgttgaatattttattagactcagctgaagagacaagtgaactaaactataagctggatctaaagaaattacccagtgagcagtgaggagaaacaaggagctagaaaacattggaaagttaagagagttcgagggaagaattataaagactaggagtcctagaaagagaaaatttagagaataaaggagaggcagtacttgaaagataacacaattttacaaatttgttggaaaaacatgaattcataaattcaggaagcacaatatataccaaacatatatttaaataaaatccaggcctagactcaaggtattgtaaatgacaagataccaaatacaagattttaaaagcaaccatggggagaaaaagatcagtgaaagcaagacagtcaaatacttagtaggcttcctaacagcaacaatgtacccaaaagagggtagaattctgagaaaaactattagcttagaatttgcaacaagcgaaactgaaacaaacagatgctcagatgaaaaacagatgttatcctcagcacaaattcagtaaagagactacaaaaggatgatcttcaagaagggaaatgattctaaaaggattatctgaaattgaaaaactagtaagcaaataaatgataaacataagtaaatttaaactgttgtttgtataaaacaattataatgaagtgtttataagaaattgta

SEQ ID NO: 6848 - DNA, 1220 bp, Homo sapiens
aattaattaactgaaggaactctagttaaaggagaagtcagagaagctcaaatttatatgaagtttaaatgaatttataagagatggaaactttctatggaagggcaatcaattatacttctaccaggcagaatatataataggtcagtggcagtaaaagcctagaatcacataacttgagaggatgttatctagacagtgcatagttttccactgaagtagaaattttttcctgcagtgtaccccctttcgataaaaaataatctgaaggaaagattgtgcttgatcacaaaataaagctggtctcattagactttgcctgattatttgcacaggtgaagtagcaaatgttaatttagcttgtagatgtttagttgtttttataaatgacattttcataagtaatgttagattggacttttaaaggcctctattatttgctaagtcaggggcaggaggcccttgcccaagaaactccctccacatgttttattgtgttaatttttattctcagtgggaatggaatctcattatttctaaaatcattttcttatgagaatggatataccatttctattttgagttggatgcaaagaataaaatatcaaaattagcagaaatgtagttagtgtggattgatgttttattttcagattgagaatatcagaaggaagcataattatctgcctttcattatggaattgttaaagactttagcagaacaccagcagttaataccactagtagaaaaggtaagtattttattggtagatacttaaattaagtttagagtctccaaaaacataaaatgtattttttattttttgcttgaatagaggtaaaatttttggaagcttgtacgtttttattcttttgcttttgcctcttgttttctactctgtaagaattagttcaattgagactgtaaaacaaaaataaagaattaccccactgctttaggcttccagattcttagtgtcaagacctcaggttatgctgtattaaaataaaatttaaaacacttcctttaagcaaaagtagatttttaatgctgataattgaaataatattttcctatttagcaaaaatttgagttgatataacagaatttaaaagtagaatggacattgttgggtttaaaaaaaaaatagcctgtactacgaaataggttttcttatttctaatttagtatccattccactgagggaaaactagcataa

SEQ ID NO: 6849 - DNA, 1154 bp, Homo sapiens
caatgtaaagactgtagatgattgagtgaaaaaaaatatgtggacattgtataccctgtttgggaatttaaatgagggtggaaactaatgtgagttgggttcagaatttctctacaatcacacaggtgaattgaagcttatgctcggttataaaatactaattgaatttgaataggtagaaatgagtctaggaggaaatgaataggagagggggacaagctctgttggcttaatcagctatgttttccatcaggatgattgatcttgttaccctaactggattggtttttggtaatattatgagttcattgagttcatttggtttcctagaattttcaactccagaagtgcagcaaatttctgaaaatagattaggatagaaattaaacatatttattctgtttatgctgagacttcataaaatataatttgaaaactgttcatgttttggggccattgtcaccagttaaaaaccattttttatttttttaaacacattgatatcttcacttttatattttataggtaattaataatgcttgtgctactcaagccatagtgagtgtgttactgaactgtacccaccaggatgtccatttaggcgagacattatcagagtttaaagaattttcacaaagttttgatgcagctgtgagtacaatcttcttattcctaaaatgtcatatttgtgaaagtttgtatattaataggctactttaaaaaattattttagatgaaaggcttggcactgagcaattcagatgtgattcgacaagtacacaacagtttcgccaggtaaagagactttatgttaaataaatactgtttctttctttgcttctttgagtttcactatttttttatttactgtagacagcaaatgtttgaatttgatacgaagacatcagcaaaagaagaagatgcttttcactttgtcagttatgttcctgttaatgggagactgtatgaattagatggattaagagaaggaccgattgatttaggtaatgcagttcctgttcctgatatttcacttttgacaggggaaaatctgttgggtatttaccctcattcagtgctgcttaaattttcaaggtaaaagtgactatgaggtaacataatataatgaaggccttaagctcttcagtgtgtta

SEQ ID NO: 6850 - DNA, 1172 bp, Homo sapiens
gattgggaaattttcatgtgaataaaccataactgctgtttcgaataattgacagtcaaactataatatggtgtgttaattgctatgttagagtatatacaaaatgttaaaagtacacaggtcatggaggagcacagccagaaggaaaagcataaacagtagtgatgttaaagtatatgggttagccaacagctagcaaagtgactagaacataatatagcagactggaggaatatttatttggatctgaaactgaaaagataaactgaggacagattgtatgccatgttgtatagtttgaattgccctgtagtgactggggatttacctatcaaatatattttaatgctgaaatgacattattttcataattaaggtttattgtgcttttaagtgtgcagggcaggttggaataaagtgagagaagctagacatctcttaaaatggttggagtccgagatgattggctaaactagtgggttaggaaggaggagttagattcaataagtttgctatatttaaatcaacagttgcatgtggtaatgtctgctcttcattcctttgggagcagaaatacatccataacacgctaaattaaaaaaggagttctcagggctgccaaccttacagtagaggttgagtggtagtatattactcctacataagagaaaaaaaatcaaaaggactgcttactaaaagttggggaaaaaaagaggcaaaaataactccctggtttctagcctgggtggctggtgaaacactcttacaagtgaagagcaggcttgatggacaagaaaatggattcagatttggacagacactgagtttgacatgtctgcagatttagtcatatattttacgttcaaaaccttaacaatatgttaaagttaactttcagaaatgttgtactaggtaagtttgtttttactccttcaatttcatatgtgcagaaaacttggagatcatgcatgaaagaatgatatataaattcatcttctgtacatgcacatatgaaaaatcagcagctattaataaattggcttcattagcagaagaacctgcaaacaattaaatggtggtagtttatgtcaccatcagatgcttcaaagagaaaatcagtttattccaattatttccatcattttcattttttcacccaatttatagattta

SEQ ID NO: 6851 - DNA, 2202 bp, Homo sapiens
cttcccagctaatctccacccaatgaatgatgatggtatagtatgtgcataatggaaagttaccttactgaaaaaaaaaaaagaaggaaaaataagatgggcccaaaggtctatctactaaactagctcttggggaaatagcttcaggatactgtagtttcctctatctaatagagaactttttgttaacagacactgtaaaatagttttgctttgttgaataatacgtgtgtacctaaaagaggtaagagcaaaaagtgtaattccacatcatgttacttgagaagtgcttaacgttttcttaaatgttttcattgggaaaggacagctttgataatgtccaaatactctgaaatgcactagaccatataactgtgatgaaatatgaaactcatctgtaaacttttataccaagggggtaaaaaaaaaaactaaggcatttgattaaattatgaatgagttttacaaattcctttcagagttttactaagatcacacaaataacagctttcttattcagtgaaaaagatattttatttctgatgttttatttgcacttgtggaatatgttaccattaatcagaaacatcatggcaacccctaagaatagactaagtttgtgttggctgagggattctatttggtttgcttttttttttttgctttgttatattttattgctacaaggggtgtgacttgataatgatttcctctgaattataataacatagccagatgtagtctcacactgtttttcatactcttaagtgtaaataatataaaatgtttcaagcgcttaactccccctcattcacaaagtataacaattaaaatctcaactataaccagtttagctttttccttacttttaaaataaaattttttacttttaactatttttttagttaatatttttaaaagtatacatgtcaatggcctctttgtccattattcattttgtggcaaaatattcttctttgatagtgtaaacaaataataaagcaatctaggtcctttaggtttgaaaggcaatttttgagtagcatattaccagctagccagtcactaggaatttttttcagtattatttgtatgtattaaacttttcattacactaaagtgcattattttattgagcaagtatccttcattgtgaggtttaacattaaagcaatctgttgaaatgccattatctttgctcataattttattatggccgtctaaggtagcttacacataaaacctgtttgcgtatctgttgttctctaaatattaattgaagatttactgaggatttgtaaggtccttctcgctgttatgtgaaaagtcaaactgtagttaatgtaaattatagccttttaggtgcttgggggttagagggtttatgttttttgggaaagggggactttagtagtctgaggatttctgtacatattttcttctgttttatgtgaaatttgggctctgggaataagaaaatattcctttcaaatttatttgacatattaatgctggttttgatatgtacccattccttcaaggcaactggtatcagtttttaagtgtgatttacctgagatatttttgttcagcaaagctcatagcaccctcacccccactccagacatgcattgcttctgatgttgttcacgtttttaaccctgtcaagcattgaactgaatatattagctacttttgacacattaaaatattacgttcagattgaatttaaagtttaaagaaactaatagaattacgtaatagttattgaattgtttaagtaaacccaagatcttaaaaattataacatgatcattttattcctaatagaaatgttaaatagaatatagtacaaaagtgcattaccttcagttgtgtactatttccataatacttttagacaaatatatctataagttaatattaaatccatcaaggatacaagattggatggatatgacctttctgaagtatttaggtaggtctaattaaatggactagggtaacatttaagaaagaaaggataagtaggagaagctaccacagaaggtaacttttcaaatcatggcatatttgagctggaagaaaccttagaaacctaaaagctaattttttaaatttttgttagagagctgaggtccaagacagagtgtgattttgaagtactataacctagaaatcttggtctcttcattcctgtgc

SEQ ID NO: 6852 - DNA, 1823 bp, Homo sapiens
gtggatatggatatgtggataaagacagtaaatgaaattaaaaccctgctgttttaaatatcattaccagatataattgagggaatattatatcaacaaacatattgaaacttggctttatttgtaacgtaaactatatataatccatacgtagccaaattagatttaaaatatacaattaatgaatagtactcaaagtgtttttgttgcactgttactctgaatatggactctctatatctggtatggcgtgactgggcataacttctgtaatgtatttcagttatatgtttttccttttattgccagcttctgataatgaaattttccaaagggatgagatataagaatcatcttttataaaaaccagtggggagtggggtattataatctagttctaaactgtccatttgctttatataaaggctttgatttcaataactgaccatttgatgaatatttaaattacacagaataatgtctacatagaataaacttaagtattcaagagccttaaagtgaaaaaatgaaccttttgactgccttaaaatactacttgctctgtaattcaggcatactagttactttccttggggtctgtttaaataatgccttaatagtgttctaatgtttctgaaatacagaactcaaagggtcttttagagcttttaattttacatagtgaatggaaatttaagtattacattttaaaacctgattgtacattggtaatttaaacatccaataacaggaaaatctagatacagtgatgtgttatacatacatgactgttaacatcagtaatattttatgatagtttaaggttttttattgttttctataacaagttatccaacaggttggactttgtaacatgatatccaaggaccaagttgcatatttaacatcgaatgaaaatgtagttgtacagttccaaaaataattaattttttaagggaatttttcaagacaaaaggcaaatattttgtttcaaacctacaagcaaattcattccaagaagtgaatatagtagtaaaacataaagactattgcaataaaaagtttccaggccagtgacttgtttaattacattcacatttttacattcactttgcctttcaaagcaggagtattttataaaactgaaataaaactttaaattgtcaagctggtgcttaaagttatgtaaaatctgatttaagtttatttcatttccaaggaaaggaccctgaaaggaggggacagggagcttcctaggtctgttgataaactaactgatgctttgtcaagtcttccaagttttcactgtaaataatacaactaacaatgtaattttgctgttttctaatagagaatgaatgaatatattaatgtattacatttgtttcatgataaaacagttttcactgatactgtgaaatcctttctctcctttctagccttgcaaaataccctactaaataaatcattttagacatggagtgcaggtggacactgtgtgaactgtttttggtcagttattgtagaaattgatagatgtaccaaataaactctatgcacattaaacaagtgtctgtctatctctttcaagaaatacgaatgttaaggttataatatgccttaaaaaatctaaagcctttagtaatcttgtatttgaacaaggtaaaatttaagttttgataattaatattgaccttttaatgtatctagttttatgtaagtattaaaagtatatgaagttaaagattctttacccatggaattcaattataacaaaatgattagatttaatgaaaacaaattatttaaagttttaaaatagg

SEQ ID NO: 6853 - DNA, 1163 bp, Homo sapiens
agaaatgtcaacttgtttttacatgcattattctaaaaattctaaaattcctatagtcattataacctaccataatatttttttcaggtacatggtaaagcataaatcgcacttgagattctgaattatttggctcctccatttctggaaattgagactcaagctttatgaatttatcaagaacttaaaaatgaagaaggtcacagattgatcttttataagaccttatttgatgctttgtgcttcaaggagatgatacctgtcatccatataagcaaactttttggcttacaactatttttttaatattagccttctagtctgtaatggaaattgtatattttgatagaagttttttctccattggttaaattagcattacttaaaatttgtttctttagaaaataaatgcaggttataaatgtgtgtatatttagagattataaggctctctgagccatcttctgatttttcattgctctataattctttttactgaaaatactatgttatgaatggtattaaattttagtctctggaacatccaaaaccaagcaaagggatgtgactattttgaatgaatcagaatgtcaacttgtatgtacactatatctacacttactcattatttaaaaagaataatgaaaaatctagatcaattcttcaatttgattgaactgttcagccttttcaagatttctttatttacaaatgattacatttaaatgaatgtacattcttctcactgactttggtgattttgaaacctagaatgatgtgtttctatctgtaatatctttccatttgaaaaaaatctcaaaacacagattaaaaccacaataggctgtagtattttttattttgggagccagagtatgatttgggggaagaatatgtatcagccctattgcagtataactttaagctccttttctctttagtccacttttgattgtaatttttatggtataggattttgaatcttctattttaggcttgtcagtcttggagttcttatcttccattatccctaaatattgataaactcccaggcaccaaagaaaacatttgcttaattgtctgaaaagaaacaagagaaaaacactggtatttttatgtctgtattcaatatggtataaaatataaaaactatattttaactt

SEQ ID NO: 6854 - DNA, 1615 bp, Homo sapiens
tttgttgaactaaagtatataaaattttttgagactagcagtatattttataatattacaaatacaacaattatttataaaagctagtcaaattaatggcttagaaagtagctgtaaactttgtgttttgaaattgcttgtttaaatgcaaaattatgagtaagataagtctttttaaattttttatttttaatttttttggaagtttattaaagcccttcatatacacatactttttaaaaaaagattcttaataaagaaattattggtttgtctggttaaagtccatatagaatgctgagaaataatttataaaataagaactatagaaatttgttctcagctgaaaagttggcagctgctctgtttctttaaaaaagtacaacatgaaaatttaattacattagccttaatattacttgactgaatttctactatttattcacttgtgtttgagattcacccagctattctaatgatagaaataaaaagtggagaaatgactaaagttgacttaagttaagaattggagtgggaattttgaaatgccatgtcctatatattctggcatatttgttggcacatttgcaagtatgttgatcccagcattgtttatatctgttggaataataactaaggaaaaattgaaaatgtataatagatgtataaagatttatatttagttagtatataatagataatacttgcaggttttttatgtgttttgggtttctgtgtattattttaggtaatctttataagggcatcttggaagttataaatatgtgccatttactgaaaagtgggaagcatttttatatgagtaaagctaatgaaataaaactagttttattgccaaaattcaaaaagtggggttcatgctatgtcgaatttaagcaaatgatctgtctgaggattttgtttgccattgaattccatttctgtccactttaaatttactaaaagctatttaacctgagtttgattataatgcttcataagtaatgcagttcatgtacatagagtaagtgctgtaagtgattttttaaccaccagttggtgctgtttctcaaagtggttcttaattagagtttaagtttgggtgccatgtgaactcataaaatattctactcattctttttgtttttctttgttttgttttctttgttttatttttcattctgtttgtttttctttgtttgtttttgagatggagtctcactctgtcacccaggctggagtgcagtgctgcgatcttggctcactgcagcctccacctcctgggttcatgcagttctcctgcctcagcctcccgagtagctgggattatgggtgtgcaccaccacacctggctatatttgtattttttagtggagacagagtttcaccatgttagccaggctggtcttgaactcctgacctcaggtgatccacctgcctcggcttcccaaaatgttgggattacaggcgtgagccaccatgcctggcctgttctgttcattctgattccagtttggtgggctcttaaattttaggttcaattgtaaataaaacatgttgccctattttgttttaagagcactagggacatttccattctccctttgtcctcaat

SEQ ID NO: 6855 - DNA, 1156 bp, Homo sapiens
agagggatgcaagccaggaaaatgtatattcacatcctcacatctgttataaagattcaatcatattatcgtgcttatgtttctaaaaaggaatttttgagcctaaaaaatgctacaataaaattgcagtcaactgttaagatgaaacaaacacgtaaacaatatttgcatttaagagcagctgcactatttatccagcaatgttaccgttccaaaaaaatagctgcacaaaagagagaagagtatatgcagatgcgggaatcttgtatcaaactgcaagcatttgttagaggataccttgtccgaaagcagatgaggttacaaagaaaagctgttatttcactacagtcttatttcagaatgagaaaggctcggcagtattatctgaaaatgtataaagcaattattgtcattcagaattactatcatgcatacaaagcacaggtcaatcagaggaagaacttcttgcaagtcaaaaaagcagctacttgcttgcaagcagcttacagaggttataaagtacgccagctaatcaaacaacaatctatagctgctcttaaaattcagtctgcttttagaggctataataaaagggtaaaatatcaatctgtgcttcaatctataataaagattcagagatggtacagggcgtacaagactcttcatgatacaagaacacattttttgaagacaaaggcagctgtgatttccctccagtctgcttatcgtggctggaaggttcggaaacagattagaagggaacatcaagctgccttgaagattcagtctgcttttagaatggccaaggcccagaaacagtttagattgtttaaaacagcagcattagtcatccagcaaaatttcagagcatggactgcaggaaggaagcaatgtatggagtatattgaactccgtcatgcggtactggtgcttcaatctatgtggaagggaaaaacactgagaagacagcttcaaaggcaacataaatgtgctatcatcatacagtcatactatagaatgcatgtgcaacaaaagaagtggaaaatcatgaaaaaagctgctcttctgattcaaaagtattatagggcttacagtattggaagagaacagaatcatttatatttgaaaacaaaagcagctgtagtaactttacagt

SEQ ID NO: 6856 - DNA, 1223 bp, Homo sapiens
ggtaatatatgagttataaatgttgtcacttttccagtatctagcactatttaatagaaaggggatgttttatattaaactatggtgaaggataaaattgaaatgaatgtaatttaatactgtagatagagactttaggtagtatcctagttagtagcactctggttatattatacatgtgactttagccaaaaggccaagaagctttggttgttataataatgaatacatcaactttttttcttttagaaaagaatttgaggaaatgtagtctatcactttaagttttatgtcagtacatgtttaatttcaagttgtctaatatttgctaggtaagataattcttggaagtgtctgagatgaactgttctaatgtaaacttttcagttgcaacaattaagcttccaggtaaattgaagttatgaaattgtgaaatatattctaccacatataatgataaaaaaaaattactgcaatctgacctggtagaaattacttacccagtttaatatatccccatatgtcttacagtgttaacttacttatgttattgatataggcggaaattggttttttaaggaattggtgatcatttgctgtaaaaagatgttgcattatacgctgacataacagtggtatctgctttttgctttttataatgttttttggaataattttctctctgaatcagaatactttggacaatctaatttaataattattaatattttaactgaggctgtgtgtaaacatgaataaaataacttcttcagtaacaattccaagagcatatgtatacaagtaagttgttaaagttagactggataaaatgctgttgtagaactgtaaacaaatactgtgaagatatgtatagaggtgagaacagcttttgggttgaagtacctgagaacattgcatctttccaatagacttcttagactttgtactcttagtgcatgcttcctgtattctgccttaattgtcttaatttgacttggagatgagtgaatagggatgagttcacaaatggtattgtaggtgcaacacaaatatctcaaactgtcccactgaacattagtcccgtgacatgctatgtaagagaaggcttctgtgttcaagtaagattgggaactacgtaattcacaatcggttttaactgcccaattctttagtaaagaaacctgttgattttgcttaacccagtatttccttaaatcatttta

SEQ ID NO: 6857 - DNA, 2145 bp, Homo sapiens
tttaaggggcagatttagagactcttttagaaactgagtgtctttatcttattatcagataaccaggctgcacagggctctctataatggaatgatgctccttttcaatacttagagccactgtactcagtttaggagtaactgaaggtgtggatgcatgttaatgggaatccaatttttactatttttatatgaataacagcgttctgtagaaacagtctctcccttctaaataaaaactatgtgactgctgttactagtgctattctatgcgaatatcctaataataggattcaggaattctaatgaattgtttcttaattaaggtgaacaagtagactcctgatcaagaggagaacactgtgaatgtctcataatcaatagaccttcattctcttgtagaaaatgtggattttcaggaaaagactgattattttcatgaataaattttcttatacaaattccattttgtttgacataaaagaccctgaatcttaagatatttgtaaatcagaatatttaagaatgtaaaatgaatccccaaatctagtttcctccaaagcacttcttaatgtaggaaatagtttttacaaaccctatgtcagtactaatgttcctgggtcaaacccagtaatattgttagtgtatgttgttacaccttatttaagaggcagagtggttttgagcaagtcagttaacgtgatttgatgaagaaataaggaattatatacatttagacagaagaatattttattttgaaaataggatttcgtgcaataatttttcttgcataacttagttcatataaatatgtacatctgtttttctggcagatgccttaaggtcatgtttttcagtatttgagtaaatctgtatgtagcaatgttctcattgatttcagaaaaaaatatattctttatattgttgccaggagaaatgtttttgtttatttaaaattattatggatattgtgttgttgtatcataactaactgcctcagcaacaataaatatgcaataagaaaatcctgtaccttagattagattgacaatactgttactttaaaagaaatatatacggtacaaattgctgattctacatgtgtacatttaacagatactcagttctgcaccacctaaatcaaaatggcatttgtatgctgatgattacatatgtggattgtagtatcctttgtgatgaatctttgataagatttataaagggcattgccaatactttttgactgtgtaaattaattttttgtatgatgtacagtttgtttaatcttagagcttctatagatttctactttattatacttgaatgaggcagaaaagcactgtggaaaatctgtagctctggatgcaacatgcagacataccaaaaaaataataataaagcaaggtactgaagagcaatgttaacagaatgctttatatccagaatgctatgtttttttcaagccacattttagttgaatgaagtaaagttattcaatcttttattttaaaatattggaaagtcacaaatgattacttctttgatatgatgaacctataagtctattcatctctgttatttcatttctcaaatgtgagccttgttgaggtccattatcaaatctacactttggttgattatatgatgtttaggacaaggcagaatttaaaacctgcatgtttagtgcatcacatgtcaagtcaccatccttctgacagtgtaacttccataacgttattttgagagccatttaataatcatatttgaaaaagtggatttcttgagtctgttgtagtttagtacttacagcagtgcctaaaacagcaactaatatgaactgcctgagtcctacaacataaatgcataaagcttttttatgtaaaagccacaggaggggttcaaaattgaacttttccaaagtttatttctcttgcgttagatgaaaaactatttaaaaggactgaaaaccctgagctttttgctcgtcttggtagcagatatctgtaaaaacctacccagaattgtgattttacttcattgttcttgcatccttgaggctacagtataaatcatctccaaacttgactactattgggaagatgtgtataaaagcatcgctttgggaatttttttaaaaatatgcaa

SEQ ID NO: 6858 - DNA, 2323 bp, Homo sapiens
taaagtttgaaggataagttattagtgttctgcagagcaataatgcctttttctattcatcaaatcaaggtcaaaattcatcttttcaagattaaaaagctctcttaatggaaatatttaatttgcttatataaagcactatagccatgttttccaaaaagtataaaaatatacacttacctttcattcagtgaaatataggaagtgctgaattacaatgtgaagttaatgacttctgtttacaaatgagacactctaacgagttttcagtctctctgtatgcctttgctatttaggggtccaccccaagaaagccaaatacaacataaaccgtcctgacaaaaaaaaaaaaaaaaatctttttttaactaataattctctatcaaaatgcttcatatcatcatctcaaatttactttttaaaataattgactttgtattttagaagttttagatttacagaaaaattgcaaagatagtacagagagttcccatctacccctgttactaacatcttacgttactatggtacatctgccccaattagtgaaccaatattgatattccatactttattcagattttcttagttttctcctaatatccattttccacatcaagatcctattcagaataccacactatattgagttggaatgtctccttaggctcctcttgcctgtgacagtttcttagactttccttatttttgatgacattgacagctttgaagagtactgtcagataaattgtagcatgctcctctcttggagtttgttgggtatttttttcatgattagactgggattgtgggttttgaggagatgatcacagaagtaaagtgccattttcatcaggtcatatcaagggtacgtactgtcaacatgatttgtgaatgctgacagggaccttgataacctggctgaggtagcgtttgtcactctaaagttcttcctgccctttccatgctgtcatttttggaaggaagtcactacatgcaggagtgaggagtcataattccccttctttagggcagagaagtatctacataaataactgggaattctgtatagaaaatttgtttcttctttctcaaattcactgttgagctttggaattcatctgagaaggaatcatgtactaattacttcatgatagactagattaccaggcacaatcagggaaaaaagcagtgatagtatggttaaattgttattagcattttcagtatatccactttatacatccccaatcatgattttttttacatttctttttagaaaagatgttcaagaaatcattaaagaaccccaataagactatattctaaatatttattgaaagaatataatttcagctaaaatcctagaagagggtttgaaataatttaaagaaaatgaccaagtttttttaaaacctacgtttcaaaatctaaatggatatgtgttatttgggacacttattcattatgattatataagaagacaattcttgtttcccttataagtatggactgtatacattaaggaaaacaatgtttaatccttattttttaatacagaagtctcaaggttcttgtcaaattttgcctttataagcttattacaaaattacaacttactttactgaagtttataatggaagaagtccatatagcaaaagagctgttttaaatcagaaggaaaaaaggttactctggttgttaatctgcttggcaaatattccttcataatttgtgaaaagaatgcaaatcagcattttaatatgaattttgaaatgaggtatggttttttgtttgtttttttcagaactcagtctgaaaaacaactgtgagtgtagcatgggtcaaatttggtttttagtccatttgctttatcaacatcacggcttcagaaatccaaattttgttctacttttcagccacctttcaaggtgtttggttataatactgtgttgctttgaggatatttagccactcataaataattgtctcaaggtatttaaaagtgatttgtgccttattttaatgcaaaattagcagttttattctattttaaaaacaaaggcagaaaaacaattctgcatgttattctttaaaaacatccagaataatactaccaagtatttgtatttcaaaccagtaaaattttgaatattcaaagtctgctcttaaacttagacttcctagtattatggtggttatagtgagaatgaaattaaactgggtgagttccgaaataaaggaaagtgttatattctacagtgcccatattttctatggtaactaaatcaaatatttgtaagttcctctgctttttgaaatt

SEQ ID NO: 6859 - DNA, 1168 bp, Homo sapiens
tgaccttacctaagagcttgttagaaatgcagaaattcagactcagaaacactatagaaccagaatctacacttttacatttttataagtccctaagcgatttatacgcacattaagatttgagaagcacagctttaaaatacttggggtggaagagagtgtgggctggggataaaagaaacaaaattggcaaatactgttaattgttgaaactgtgtgatgggtgcatgagggtataattgagtataagtcaagtatccctaaatcagggcctgaaagtctatgtgactgtgcatatgtattcaatccagtgatctgttgggttttttttttttttattggtttgagaagttagtaagtgttgagataaatataccttattgcttccctttcttcctgtcccagtttgtcaagttattggataatattcaaaaaccctgaatgcatatttcttgcaaaagtgtttcttatgaaatcacattgttgctttaaaatttgctaaagagacttattttaaactgctaatgccaatttattgtcaatctctctctccaggcacgcttaaaaaggcctcttaagagccttgatggtgctctatatgatgatgaagatgatgatgacattgaaagagcaagcaagtaagtaatggattttggtgtcctattaagtggaatggcttaacagcagaagtttttggtgataaagggtatttcaaagagtatgcactcttagagctcagatgttgcccttttacagtgttcttcagcaaaaggacccagtgctcctggaatgttatgggggatatcttgggacaggaaactaagatggaccttaaatatcttgttcttggaaagcaataatgtctacagagatatctgggatagtgttaaaggggcaatagaagcccatctaaattaggctcttactcattctgaagagaggaaggttaaatatcaggaatggtgataatagtcaatagaaagaaatggaattgagggtacagtagacttaagtctatggtgatatcagaagatgaaaatttaataaaaagtgttaaaaattaattttaatataagggaaataatatatgtttagcttcttacaattgatgtatgacaatgacaaaatgaacattcttttttcttcattaactatatctctgtctatg

SEQ ID NO: 6860 - DNA, 1209 bp, Homo sapiens
aggagttcgagaccaacccggccaacatggtgaaaccccatctctctactaaaaatacaaaaattagccggatgtggtggcgtgcacctgtaatcctagctactctggtggctgaagcacgaaaatcacctgaacccgggaggcggaggttgcaatgagccaagatctcaccactgcactccagcctgggtgacaaaaaagaaaaaaaaaaagcagattcttggggacatacactaaagatgacaattcaacagagcagctctaggttgggtcccaggaaattagcttcttttcaaatacttagcgggtaagaaagttgggaaatctgtgatctgatcatcctctgcaaatacttaccttgagtagggttatgtttcaactaataatagaatattatgtactttatgtggcagccgactagtattacacttaattattttaataaataccattttaaataataataccctttgaacttcaagactttctggtaagtgtgtaaaatgtttttcttcacattcactatgagctgtaacttacacaattatcttttacttgtacagagaaatcttacagaatattttgttgccgtggatgtgaacaacatgctgcagctgtatgccagtatgctgcatgaaaggcgcatcgtgattatctcgagcaaattaagcactgtaagtacttcacacttcttttaagtagcaggtattgagtgtttcacaaaaagacctaaaaacctttgcagatttagaaatgtgctatgtgtacttataagacaatatctacatacgtttttgatgtatggttttaatctggctcttgaagtacaaaagtctgatttataggaagccttctcagatgcattaagtcaggttaattattttttcttatcaggagatgagagtttttttttctttttaactctccagagttcattttagtgccttctaccatataaagaattcttaagagctattatgagatttttattattcacttgtggctttttccattggagccacttgaaagaaatcaaggggccatgataatagctgctatcctaacctggtaataggtagattcatctttgttgccaagtagtggtttgggagtagattgtataatagtttgatttagagcagctctttgggctgataataacttaaaagtcaaagtagcattttttataaatcacaggttttatgacat

SEQ ID NO: 6861 - DNA, 1321 bp, Homo sapiens
ttattgctatttgctaaataatagggtggttgatgtttacaaaagagatttcttgtgacttaccatagaaacccagcccaggaatcttagtagattttgatatatttggttagcaagctttaatttttccagtccacctcaactaaatgtgttttaataatatatatgtttatatgtatgtataggtgtgtatgtctctatatactgtatatatacacatacgtgtatatgtatatatgtacaaaataaacctttcagcaatatactctttttttgccttaacattttttccctattttaattttaattttagggtcaaatatttttaaccaagtcttaactttttgtatggcaatgtaattgttaaatctcatataaacccgctaactcatttaagaatctctcaaattcaacaaatcctgaatgtcagtccatggcattttttaatttactcaatatatttttttctgattttcattacaaattatatgttaccagttttaattatctttttcatatgtgatttatttgtattgattagcattcctacttcattgcccctgatgtaactggactcccaacaatacccgagagtgtaagtttcctattttctactttaattattcttatattattaattttgtttattttggtctcactgtttatgcgtttttatatagagaaataggatacattgtaattatctgtgtttgtgagaaataatgaagaaataagaaataaagatattattttcttttcttctttatatatctgcccctttaccttcttcttaatatctggttgtggataaggaaaattaaggacaataatataaggaaaactatttctatcatttgtagtaattaggtaggatcatatatatattcaattaggtcttcagcttcactgtatatgatagaagagatacctcaggagatggcttctacttgtggagaagaattctagcaatgggaaatgtcttcacacaaatcattattttagtgaaattgacatagtattttatattccttgtatataatgcttcaaatcgtagatgaactgttcttaatttcctgattttaatttaaagcaatacatatcttgcaaggtttgatggctattgtaagaaattttaaaaattgctaaaattttcattttatttagagtcctaattctagccatactagaactattttcagtattttaatagttattacacattagtattttgtagaaatgtttacatagacaagtagaagtaacaaatatgcttttatgattttggataactatgtgaaaatgaagtattcccttacgtaat

SEQ ID NO: 6862 - DNA, 1105 bp, Homo sapiens
aaggcacaatgtttcctaatgttactatattttagggtgtctcagaatcaagttggacagcactttacctttgtactgacagacattgaaagtaaacagagatttggattctgcagactgacgtcaggaggcacaatttgtttatgcatccttaggtgagtatttgtagtaaaaaaaattagatgcaaaataggtaactatctctctattgtactttgttatgcttgggatgaagaaaaacttgttttctttaaaaacaagttgaaaaataattttcctgattttctgtatacagaatcagttaagtttaaagatttaccattaacatagtggaactttccttgaaataatcgattttttaaagattagttttttgtagagttatttttgaaaactaaatataaagagatgtattcaaataatatgagtttcacctattaaatggaatacaaaaaaaaataagttaaattaatgtatgcccttttctgtcactgaaccagaacttggatttttaaaagtgaactgctgctttaagacagaggttgcaaactgatgaacctggtagaagcgtttagaggttttcgtttggctactgggtgttttaaaaattttaaaggacgttaaccttatgaatttgaggaagttttgtatatagttcatatttcgaattccttttgaaaagtgaggctatctactaattctgccatggcaacaataagctggaactgaatagcagatttttagttgtgtcatgagcttgctagtttccaaaggtcctatctgtcctgcctaattgcttacattatctgccttgattcagtaggtagtttagagtatgtctcctgcctgtggacttgggatctgagttgctgactgttaggaagaaagggttctaaaggttagcattcttgcaatatgtcctgatgaatcagaaatccagatgtagtctataaaaataggactccaaactattattataacatggatattggtcaaactggatttcttagaaatgcttataggaaaagaaataacaatttatgaaataacatattacaaagaaaactttggtataaaatcagtcttcctgttcatttgctattca

SEQ ID NO: 6863 - DNA, 1175 bp, Homo sapiens
cctttagaatttcctttaaaagtttcaaaggccaggatattgtgtaaagagcaaaagagcaagtttttgttttgttttgttttgttttgtattgttatttgccagttatcatacaggctggcaaggaatgctgagacctgctttgcagttctttgacctactggattgcctacataactagctacagaagtagctcaaagatacaggatggctggtgcatttgttgtttggcatacttggtaaggatgtacaaggatgtgtgggccccatgacagacagtctttcctgacagtccaacctttgcccatacacattcttggttgaactcaaattttcatatgagtataccaccccatcagcaattcagattagatatgctgtcaggtgctgaggaaaaattcatccagtttatctcatacaacacttgatgaggacaattatcaacagaatgaggccaacctgcagtattcacctcaaccatgtaccctaggattctggactcaacaaattaagtaaagtcccagacagtactagtagatattatttcagataatcatttagctcccttccttatgggaagtatggattgttccatctgagcagtggtattaattcatacatatcttggtcagccagcatgtagtttaggccagtatgttatgcattatgacttgtacaaaggaattttaagctgacctgctgatattccagagtttgcacagccccattgcctgtggtaactaaagttaaggatagatttctgaccatttgctctgtggcatgaattccactgtcagggaaaagtacttgcactgctatgtggaatgagaagcctgcatgtcctctgggtagtttagcctagatgaggcacatgttgtcttcaatatctaaacagtccaattatgtgccaggcttcccttttggtaggtggggactgcagggtaagtaatttttcctttattgtctcagggcagtcagcattgctcctgagaatttgactccgatggctagtccctatatctcatcaggattaatgaaccacccctgggccctcatgtgagtcagcatctcttccaaagccattgccaagggagaaaggcttgttccacatctcagcattgatgcaaacagcaggagaattcagatactcccgtggctgctcagtaaatctgttt

SEQ ID NO: 6864 - DNA, 2056 bp, Homo sapiens
tattcataatttcttcctctcagtaaactaaccaaaaatagttgtcttaatcaggttttattgtttttctttcttcacagctccgacagttagttaatatgtgcatcaacccagatccagagaagcgaccagacgtcacctatgtttatgacgtagcaaagaggatgcatgcatgcactgcaagcagctaaacatgcaagatcatgaagagtgtaaccaaagtaattgaaagtattttgtgcaagtcatacctccccatttatgtctggtgttaagattaatatttcagagctagtgtgctttgaatccttaaccagttttcatataagcttcattttgtaccagtcacctaaatcacctccttgcaacccccaaatgactttggaataactgaattgcatgttaggagagaaaatgaaacatgatggttttgaatggctaaaggtttatagaatttcttacagttttctgctgataaattgtgtttagatagactgtcagtgccaaatattgaaggtgcagcttggcacacatcagaatagactcatacctgagaaaaagtatctgaacatgtgacttgtttcttttttagtaatttatggacattgagatgaacacaattgtgaacttttgtgaagattttatttttaaacgtttgaagtactagttttagttcttagcagagtagttttcaaatatgattcttatgataaatgtagacacaaactatttgagaaacatttagaactcttagcttatacattcaaaatgtaactattaaatgtgaagatttggggacaaaatgtgagtcagacactgaagagttttttgttttgttttaatatttttgatattctctttgcattgaaatggtataaatgaatccatttaaaaagtggttaaggatttgtttagctggtgtgataataatttttaaagttgcacattgcccaaggctttttttgtgtgtttttattgttgtttgtacatttgaaaaatattctttgaataaccttgcagtactatatttcaatttctttataaatttaagtgcattttaactcataattgtacactataatataagcctaagtttttattcataagttttattgaagttctgatcggtccccttcagaaatttttttatattattcttcaagttactttcttatttatattgtatgtgcattttatccattaatgtttcatactttctgagagtataatacccttttaaaagatatttggtataccaatacttttcctggattgaaaactttttttaaactttttaaaatttgggccactctgtatgcatatgtttggtcttgttaaagaggaagaaaggatgtgtgttatactgtacctgtgaatgttgatacagttacaatttatttgacaaggttgtaattctagaatatgcttaataaaatgaaaactggccatgactacagccagaactgttatgagattaacatttctattgagaagcttttgagtaaagtactgtatttgttcatgaagatgactgagatggtaacacttcgtgtagcttaaggaaatgggcagaatttcgtaaatgctgttgtgcagatgtgttttccctgaatgctttcgtattagtggcgaccagtttctcacagaattgtgaagcctgaaggccaagaggaagtcactgttaaaggactctgtgccatcttacaaccttggatgaattatcctgccaacgtgaaaacctcatgttcaaagaacacttccctttagccgatgtaactgctggttttgtttttcatatgtgtttttcttacactcatttgaatgctttcaagcatttgtaaacttaaaaaatgtataaagggcaaaaagtctgaacccttgttttctgaaatctaatcagttatgtatggtttctgaagggtaattttattttggaataggtaaaggaaacctgttttgtttgtttttcctgagggctagatgcattttttttctcacactcttaatgacttttaacatttatactgagcatccatagatatattcctagaagtat

SEQ ID NO: 6865 - DNA, 3976 bp, Homo sapiens
aaacaggaattgaaatgctattgaaatgttgctttttttttttttttttttaatgcagatgtcaaaaaccttgaaaacttccagctggtagaaggtgtccaggaacaagtcaatgccgccctgctggactacacaatgtgtaactacccgcagcagacagagaaatttggacagctacttcttcgactacccgaaatccgggccatcagtatgcaggctgaagaatacctctactacaagcacctgaacggggatgtgccctataataaccttctcattgaaatgttgcatgccaaaagagcataagttacaacccctaggagctctgctttcaaaacaaaaagagattgggggagtggggagggggaagaagaacaggaagaaaaaaagtactctgaactgctccaagtaacgctaattaaaaacttgctttaaagatattgaatttaaaaaggcataataatcaaatacttaatagcaaataaatgatgtatcagggtatttgtattgcaaactgtgaatcaaaggcttcacagccccagaggattccatataaaagacattgtaatggagtggattgaactcacagatggataccaacacggtcagaagaaaaacggacagaacggttcttgtatatttaaactgatctccactatgaagaaatttaggaactaatcttattaattaggcttatacagcgggggatttgagcttacaggattcctccatggtaaagctgaactgaaacaattctcaagaatgcatcagctgtacctacaatagcccctccctcttcctttgaaggccccagcacctctgccctgtggtcaccgaatctgtactaaggacctgtgttcagccacacccagtggtagctccaccaaatcatgaacagcctaattttgagtgtctgtgtcttagacctgcaaacagctaataggaaattctattaatatgttagcttgccattttaaatatgttctgagggttgttttgtctcgtgttcatgatgttaagaaaatgcaggcagtatccctcatcttatgtaagtgttaattaatattaagggaaatgactacaaactttcaaagcaaatgctccatagctaaagcaacttagaccttatttctgctactgttgctgaaatgtggctttggcattgttggatttcataaaaaatttctggcaggaagtcttgttagtatacatcagtctttttcatcatccaagtttgtagttcatttaaaaatacaacattaaacacattttgctaggatgtcaaatagtcacagttctaagtagttggaaacaaaattgacgcatgttaatctatgcaaagagaaaggaaaggatgaggtgatgtattgactcaaggttcattcttgctgcaattgaacatcctcaagagttgggatggaaatggtgatttttacatgtgtcctggaaagatattaaagtaattcaaatcttccccaaaggggaaaggaagagagtgatactgacctttttaagtcatagaccaaagtctgctgtagaacaaatatgggaggacaaagaatcgcaaattcttcaaatgactattatcagtattattaacatgcgatgccacaggtatgaaagtcttgccttatttcacaattttaaaaggtagctgtgcagatgtggatcaacatttgtttaaaataaagtattaatactttaaagtcaaataagatatagtgtttacattctttaggtcctgaggggcagggggatctgtgatataacaaaatagcaaaagcggtaatttccttaatgttatttttctgattggtaattatttttaacagtacttaattattctatgtcgtgagacactaaaatcaaaaacgggaatctcatttagactttaatttttttgagattatcggcggcacaatcactttgtagaaactgtaaaaaataaaagtatctcctagtcccttaattttttcataaatatttctggcttttgagtagtgtatttatattgtatatcatactttcaactgtagacaattatgatgctaatttattgtttcttggtttcacctttgtataagatatagccaagactgaagaaaccaaatatatgtgtttactgtagcatgtcttcaaattagtggaacttagttcagggacatagaagagtcttaatgaattaaaatcattcacttgattaaatgtctgtaaatcttcatcattcctactgtagtttatttaatatctattgtaaattatgtgacttgtagcttcctctggttttcaagtaaactcaacaaggtggagtcttacctggttttcctttccaagcattgtaaattgtataccaaagatattagttattacttctgtgtgtacaaagaggattattttattatgtttattaatcacctctaatactcatccacatgaagggtacacattaggtaagctgggcgttgactcatgcgcagtctcagtcacccgtgttatcttcgtggctcaaaggacaatgcaaaatcgccgatcagagctcatacccaaagcattacagagaacagcagcatcattgccctccccagctgaaaaacaagttggctagaagatacatggagaggaatggtgtggtcaacagttaatgaaacggttctatcatgcatgtgtaatgtggatggagacaattataagatttgactataactatttggagggtctttaacattgccaaaaaaacaaatatgttgatttttattttattttattttttattttaagaggcgggatcttgatctcacatgttgcccaggctggccttgaactcctgggctcaagcattcctcctgcctcagcctcccccatagctgggactaggggtgcatgccagcatacctggctacgttgactcttaaaatctatgttctcttattttaaagatacagtgctccccactgaaaattaaacctaaaaaatgtcacatattggtatgttgttaacctggtagattaaatcatgagaatgattagaaagacgggcaacacagcgggttacatccacactgctgatcacaccaacgacaggagctgataagcaagaaagcgtcacagccagcgtctgttcacccaaggttgacaagtgaagtttctctaatgttgattgttagccgatttgtaacctggcatttacttagcaactgccttatcaattacaggatttgccggtaaaagcagactcaaatataaaggtttttggcttaacttggtttattatagttgctctatgtttgtaaacagacaatctctaatgtctgattatttgtatcacagatctgcagctgccttggacttgaatccatgcaatgtttagagtgtgaagtcagttacttgttgatgttttcttactgtatcaatgaaatacatattgtcatgtcagttcttgccaggaacttctcaacaaaatggaattttttttttcagtatttcaataaatattgatatgcccagcctgataatttttaaaagtttttatgttgtcctcattctatcggatactaaagcttctaaataagagacttgactaggagtgaaatcaaaagaatcccacaggaatagatacttttccctttagataacttctagagtggttggctgtccttccatggatacctgaagcattaaattcaatctgagcatcatctctacatgtgaaacaaagtattttatatcatttactgttataatcaataagcagaaaaatcttaatagcatctcacttttttgtagagcttatgttgtcctgataactttcccaagtgctttcttaattcacttggtcctcagaacagatccaggaggtattattattctcatattaaagccccttgcacaaaaggatttgatacactagtcagaggagtagcgggaatttgaacctaggcagtttgactccagaatcaacactcttaaacactacacca

SEQ ID NO: 6866 - DNA, 1245 bp, Homo sapiens
ttgcattctttcaccatttagtgtctgctgtgagctgggcgctctgtagtgtatctgtgcagtgtgcatggatgggacagggatctagacattgtaaagaagctgcactccccctcaagaactccagaaggaaagaaagcaagacagaaagtaagttttagtaatccaaggcagaacgaggtgagagcatctagacaaggcgccaggcaggcaggctgcatgaggaggtgtcaagtcaggagtgaggtggaagctgagatgggctttgcatgggtagaattcctgaaagtatagagtggagagaggcctgggagagggaacgagaacctgagcaaaactgtggaggtggacatggaagaaggtcatgggaacacatgtctcgtggaaatgtgttaaataaagcataaggaaggagagtagtgaaggatgtggccaaatgaagtccgacgggagcctgaggatgggagaccacggagaggtgagatttcccagggtctgaggagggtgaggagcagtttcatgagtgtttttggtaaggggtgaaaggtgaaaggagattctagctgcctgggctctggggtgggggacacagctgcaaatggcactgagggttttagggagacagggaatgaagtatctccacagtgccttgggcttcatttctcatgccgtgctgctgctggggcagggttggctgaagttgaaggggtggagaaggggagatggtggatggagacttgggttttcattgcttctgagcttcctgtgccctggcactgattttctcacaaaaaccgtattggaaaatgtccccaggttctaaagtgaactcataaagcccattaatccacagcataccacataatatagcattccacagtacaattggtatgaactcctaagaccatgtcatgggataggatgtctgtgggtaattcattgcaaattccaaatatgtaatcagctaggaacatgatggtcagctgggattcttttacatgaaatggttccactctatgcctggcctggagaacacctgttctattacaaatggcctgataaaatttgagttggtaatttttttagagatagggtcttgatatgttgaccaggctagcctcgaaattctgggctgaagtgattgtgttacctcagcctcctgagtagctgggactataggtgtgcaccacttcacgtggctagtttatgtattttttatggtttagactttaaaagacacatcaa

SEQ ID NO: 6867 - DNA, 1198 bp, Homo sapiens
ccaaccaactaaccaaccaacacatttattgagtttgtactacatgctagttactcagcaagacatcagagcaagagtggggaccaaaagcagatgctaccttcatgaaacttatagataaatcagagagatagatattattcaaataataacgtcagtaatgataaaatttcaatatgagcaagaggtgcaaggtgctaagaaagctcacaatagagaaattgggcctagtaagaaaaaacttccttgagaaaatagtatctgaagctgggatctgaaagatgagtaagagttaaccaactaaatgggagcagaatttgtgctttacagcccttgtgacaagagggagagttgaggctgaggaactgaaagaaggtcattttgatactaggaagagatgaatgctacacgaagtcaaaccatgtaggaagagtttgtgggctatggaaaggaatttattgtttgtctcaagatcaatagaaagcaattgaaatattttcgatgtgggaagggtggcatggtttgggtttcacatcactcctcttgctgcaacatggaaaatggatttgagatagacctggggtggatgcagagagctgggctatgggccaactgcatgaactctggtgagatatgatggagttcaaaccagagggtgacagtggaggtggggagaaatagacaaatccaagagatacgtggcatgcaaaatccacaaagcttgttgatgggttagatgtggggagacgcagatggcccctgggttggtttctggggctggatgatggtggtgccatctcctgtgatggggacactggcaaaagaccttggtggtttttgttctgactctggacaagtagagtttggagttgtttttttttgagatggagtcttgctctgtcacctaggctggagtgcagtggtgcgatctcggcttgctgcaaactccgccccctgggttcaagtgattctccttcttaggctcctgagtagctgggattacaggtgcctgacaccacccctggctaatttctttttgcatttttagtagagacggggtttcaccatgtgggtcaggctggtctcgatctcctgacctcaggtgatccgtctgtctcggcctcccaaagtgctgggattacaggtgtgagccaccatgcctggcaatttttgtatttttagtagagatagggtttcg

SEQ ID NO: 6868 - DNA, 2764 bp, Homo sapiens
cagtatgatttagattacaacagtcttgagcattttagttaggatgaaggtattattaaatcagcaatgttttaaaatgttgagagtataagtattagaaggaaagagctaaacctataaataatggagatgcagaaactgaaaattagtaaatatgtaatatattagtaaacttataagtatgaagggaaaaagtagatcataagacatttgtgttttgaaatttagtggctacagtgttgaggaattgggaataaatatattaaagggtagaataggtctttgaggctttgttttctttttagtatatgatagtattacaggaaatcataaagatattaagtataagcatggatttctctgtagagattatctgtactggcgagtctgtgattaggaaatgtcagtttttgtttgttttgcccaagtgtatttcctagatttggtctttttcttgaacaagagtgctaagcagaatctctgattctatattgaaatccaatttttgatttctttgcacaggtgacttattctctattctagattagccctaacagattgatttttttttttaacccatccacctgcctttatttcttctgtggaatgtctgtctctgaatatgatcattttaaaattaaggtttttttttacttttaagaagttaaggtatgaagtaggaaacaatgcttttggatttctgttgtgctactggaaattcagaataaggactaccataatttagcaattgctggtcagtatttttgaggtaatttaaaaatgggaacagtggaaaaacatctataatttttagcatgtttttaaaaagttgcaaactgatacaaatatttctactttagttttccgtattatgctcatcagatgagagaggcaaaagtttgtattcattcctgtcatctggcattttgtaattacttgccattagtagcatttaagcctgaactgggtgacagtttgagcaatatggcttcatgaggtcacatggaatttttaccttccaaattcataggctcttgttaagcagaagaacttccctcaccaaaaatagtttctgaacttctacttttagggtaaaacatacctgaagactatcattttctgagttttatggtctttgtgttttctatgatacatactgataggatttcatttttaaaatgtgatgcaagactcctttgttagtgctatgataggatccatgcatcatgttgcgtgaggttatgatggtaatgttccatgaatattttgttatgggatccctcctggtatttaagaagagggatctgtggtggtttaccaatctgcttgtaccctccatgaaatgataaacagttactgatagtgagggaaaatattgtattctcgttatttttttatatccttggtaacatttaaaatgaacattaggatgaacacagcatcttagaattctgttatcttatgcttgactgtatttgagtgtgactaatttaaatagactatatttaaattctttatgaatctttggcttacttatacaagtccagcgtaacattttttttgggtcacagactctgggcacccgatataaattgatggccccccgccccctgtacgttagcagagatatatcaacaaatgaaaatgtgcaagccagtctacatgctcacaagacctcctccaactttcaaataaattcttagttatggaccctaggttaagaatttagaagacatcctaaatattgaaattttattgtatagataagtaggaagttaaaacctaagaaaatcatcaaatattaggggtgcttctgaattgatttatctgcagtttaactacttagcatttatggaaggcagtttacaaaaagccatagaggtttatgataagctggtcaagtaattagttgaatagattttataattctttgcacttctcatctgataataactaccgtataggtagtagacttgacagtagttcagtattttctgttaacagagttgtgtttataacaattacagtcaactactgtggttcttcagttgcacagagtagcttttggcaaaagtgaaaaaacctacaaccaacctacatctttttacctaggaggaataatattgagttcttaataacagactatacttcattatagcctgtgtgtgtgactagctaggttgaaatgtactgtgcatgataagccttgtaaagcaagttatatgttgaaattagtatctttggaagtgtagatagatagctggagaaaaatgtaatgatttggagcttgtactccagaggggaaaatgtatttcccgtgtttatagagaatagaagaataatgggcaggggttgaatgtaaagggaattaagggatatcttagaatggagaagaaaaggaatagattttgaaggaaaatagcatacacattccgtactcagtcacatttggaaaatagggaatataaaatttactccaatattaactgttaaaagggtaaagaggatctttagttggaaaactgttctgattttgttgttctttcagttcagacttatttcagtactttggtttgttatgaactttagaactattgtggagcaattaataaataactcttaacagacaactgtggtgaatttctgtttacatgtccagtctaggaaaaagatggctaatctttgtgtttatgtattaaatcttttctttggtaactcataaaatcacacagtttccatcggttgttaagaattttaaataact

SEQ ID NO: 6869 - DNA, 1124 bp, Homo sapiens
ctctcttgatctcaactgtaacaaggctgtaattccatcaagcgattctactgacatctagtacagtgttgaagcccaagtggttggctggttccagtattagaactcaagttgaaattatatgattaactgaaatttggggcatgcattatttattatacatggcctacaacggttctgtctgcgctgttacgtattacctacacttctgggtttttttgttcttgttctcagcctctctttaagagttcttgggccttccttttccctctttctattttaacagttttaattttagaaccatttacattccagtaggtaattcactatgcgctttatatgccttagggcatccaaataaaaaacaatagggtaaacatccccaaaacccacctttaaaaaaaaaaaaacccatacagatttccatatgtaataaaaccccgtgttcttggatagatattaataaggttgtaattccaactggtgacataactcctgtgagggataagaatgtgtctgcttatagtaataacatcagaacctctttgtgaaattgcggcctttaatgtacattttaatgaaagggtgcattagtattgtacaggggtcttgtaaagtcatcaaaacttgctatgaactctaattgccatttgaagctactgattggcagtggctctactctaaaactgctttttagcaattgtatttttttcctgattatattttttaatgtactttgatgtttatgctgatgagttttttatgtacttttggtgatgtttcagtcttatgtactcttctgacgtcagaaaagtaccactggttgtttgcagtcttattgtgtaatcagcctaccgcaggcttccatgtataataaagtaattaatattgtgcaagtgtaaaacacttctgttataaaagcagtgtttggaaaataagaaatattaaaaatggttacaaagtattagttaatttccttttcccactttcctccctttagctttagcagctaaagggtcaccaacttgtcattgcaagattcttagaaaatgtacttaatcttaaatacgctgagtactaaaaagtgtttatttcttatttcagtaagtgcggtaagttctatt

SEQ ID NO: 6870 - DNA, 1171 bp, Homo sapiens
gatcctttcatttgcccttttcgaatttacagatactacttgtacatttggcataactagttgaaattggccattcgtaccatgaataaatctgatagtttccttgttaggaagagattgtaagtaaatacagtcattgcagtcagaacagtattagtgaaccttgtgtggtgttttcaagctctttaaaatggtacaatgtagcacatttgctttcatttctttttttatttttggcatttgaccttgtattctttctgaagctctatatgtgtttttattagtcaataatctggcaagtagcactttgcctgtgcagtttgctggagtgtagatgtacatatgaggatttcccgggaggtgcacttctttgaagaacttcctaaagtacctgtatagtagttttcatcttaatattcagtatttaatcttcagtttgtgctttgtaaactcatgacttaattggtcagaaactttttagtgtctttataaaattttgtatacatatttatactaaacacattgtgatactgtatttgaatgaatggtgaaaaaatatttgctattggaattatgtgcactgacaagaaatgttataaagagaatgcctttaataaatcttttcagcattagaattgcttcgtggtctatgcttttttattttactgattttctttgtttattttactcttcattcagaatagctctgccttgataatagctaggctagtgttgcaaatcaagttaataattaggaaacactaaacaaatattaatattgccataacaactatttttttttaacattgttctgcctctctttagttgattatgcctggaatagatttatcaccatgtggtatgtgtaaagagcatgagctttggagtttgacatatttttcacacgtttggagtgtgaatcccagctggactgcttagtaactacatgaccttagacatgttactgtcttcactcccattccttcatctgcagaaagaaaagtaatacccacctcatggactatctatctatgagcacttagtgagaaaaatgtgggaataactgctggcaagtagtagactgttagtgaatttattttctgtccttttcattaccagctacaaaacccttgttatgtatataagatcacacttggtgcaggcatatgcc

SEQ ID NO: 6871 - DNA, 1260 bp, Homo sapiens
caaagcaatctttgtgatattacttcgctattaaataaagaaaattggatgcaagacaatggagaaactttaaaactaaacaggaccaccctttattcttaaatttgtgtgtgtccaacagttgaattgaatgtctataaggtctaaaggtagaatgtgaatattgccacagagttcattgctctcagtataagattttactttattaatgcagaaggaatatggatatatttctttaagtctgcagatttttttattatggtgcagcttttttttaattatgtttttaaaattatacagttgaaaaatatgccatttcataaagtctgaggattttcgtcaaccttactgaaacacactggtgctttcatcatcagaggtcaaattattatgataactattccattaagtttgccaaacatttgtcgtggttaccagtgcagcctgtcaaattctgctatttgacacagctttggaaagatttagttcttggtttttccgttttgtattagaatgactgttacagttttatttggctgtttaaagccaaattcagctatttaattatggtttcatggacactgttgagcaatgtacagtgtatggtgtgcttacctgtccactctagagcattgcttacaggttttttgttttttaagatgctgtgctgtaaaatactgtcatacttgctatttcctggtacagtgtagtttttcccctttcatttgaataaaagcatggcaccaaatgactccttttctgtttcttgaataaaatgtagtttttggtaaaattatttgaacttgagataactcatacagtttttctatcccctaacctatgtttaaatttaataacttgaatattcataacaggcaacttgaaataattagccttttaaaaatactaacttagggcaatgttaaaaagtcggtaactttctatgcttagcacagacggtctacatagtatgatttataaatgtgcttatcttatgttaatcttgctcatactaattcactatcttttggtgaattgatagttatattgtaccagaactagtgctctatgtctttgaaactgaatggccagtgaactcactgatctggagtagccatgagaagctagttcttgaccattattttgtaagtttcactttgattttgctgattctacttactcagaacagagtaaagaaaaaggtgttttttaagaaaaaagagatctgataacaaaactataaaataatcgtcatgccta

SEQ ID NO: 6872 - DNA, 2359 bp, Homo sapiens
tttcggccttaaaactggcatggagcgcaggccctcccttgcagaaaattatcaaggaagagggagttggcagagtttctctgccccggggctggggacgcggagctccggggaaattgttaaatcagtgttctggcgccccctgttgggggaactctggaattacaggagtgggccttgggggggactgagctccatccctctcccccgccccacccccacccaaagttgcccaccctgtttttccgttgcatcgctggtcttgtgcttcccgcttcagtctgggagccaagagccagccccacctcccttcagaggacgcagtgacttttggactttccagaggtggttctgtgtttctgcccttggctcctctccgtcttgggctggggcacttggagccctctccatgtggcgcccagtgttggggggaggcaggctccagtggaggctgagtgaggcctggtcccttccccgtgccctcctcggagctgccacagaggctaagacggctgtcctgctggtgctggccctgctggatgtggtattgaagtctggggcagctgatagcaggaaggagacccccttggatgctggtctcctgggacctgaacagtctgtcagcaatggctggaaatccttcttcctctggccaccccgggggtgccgggcaacccccttagctctaagatgtggccacaaatctcttcccactcctccccgccaacctgaacagaaagttttgaccttgcaacctgtaagaaagaatccgtccgcatgactgtttacaagcgatagaaacacgtaagactctgtccccttgagctcccacccccgggccggggatgccccacctggggtgactgcactgtagctgcaaggcgtgttcttgcacgaagtgtgatcttatggccctgcgagaggtgctcatcatcatgcccattttctgctgtttctgatgggtcagctacctcacggcggggccagctctgctgtcctggcaagtgtcattgactctctaaacttgaagtccttcaggagccctgagcccaacatccatgagacaccccgagttgtgcttcatgagagttggattctctgcccactctttcagggatgtccaaggtccatgttagggggcaggcccccagctccactcactgcacaagcaccctaaatgttggaagcacaaaatggttgtgatttgagcacaatggcagggtcccgcaggcagacttgacaggcccaggcccgggaggatccccccacgttggctctgtccaaagtgagattgggggtgcctgtgtctgggacagggggctgcccttgctcagaccaggccttggctcatggcttgtcctaattctgggactcgtcatcttacttcttgcccttctgtgcccatcttaagactggaggctgagccttgtcaggcccagccacatctttacgccatgggaccaggagtaaagcgctctctaaaccccgcaccccaaatctctaaacgcctgagttcaggctgagtcctagccctagtgagcctgaagagcttggactgattcccagtctcctgggtcaagccccactttgtgctttcgaagcttatgagcgggttccctggatagaaggagtcttccatccccactgcccttgggcctcttcagcatagtcctgtgccagggccctgtcctcactatcagtcagttcagtatttgctttcacgtgagtggcggactcttctgaagcagccagaactctcaaaggcagcgcatggagttgccttgcgagatttccaaggaaggaggaaagattaacaggcggagcctggcacacccaagcctttgaggtggtcagagtgccaccttcagccccttgggaagggacagcggtgggtctgggagtggcctcaccctggattcagcctaggaatctcttcaccctcagctgtccagccctgctgcctgtctggggatgtgtggcctgggcagagggcagtttaaagcacaaaaccacatggggaaaacacaaggttgcggggactttctcatgtgcctgatgtggtggagggagacaccagcaggtggctgcagtgacgttagggaacataacacttctttgccctgctagctctcagctctggggggcatcccccgatgtggtctgggctgggagcaggcatatcccctggttgttgcctgtgcctggtctgttcaccatcgtgtttgtgtgggcagagcctgccctgcaggagcagtgactttcttcccactgtgtgtcccggacctgtggtatgtgtccctttgccatcccaaacaggcaactgcttgctgctctccttgcttggcatagcctcctggtc

SEQ ID NO: 6873 - DNA, 1203 bp, Homo sapiens
tgaggaacagtgtgcagcctccagctagttctgcccagggcccagctgtctcctgcccctgtcctgcagaaaggtcatgggattcaaaacccagaggggacccacagcctcagtttccacatctgtaaaacagatatggtttataggcatgtggcagccacctggggccccagtgaatgccctatgaattcagctgtttccttcctgcacagctctacaacgaggagatccttgacctgtttgacagcacccgtgaccctgacacccgccaccgcaggtccaacatcaagatccacgaggacgcaaacggtggcatctacaccactggcgtcacttctcgcctcatccactcccaggaggaggtgagcctctgctggaggtctggagcaggtccagggcatcctgaaagggcaggggctggcaccacggtagtcccaagccctcacttctgcttctgtttccagctgatccagtgcctgaagcagggggccctgtcccgcaccacagccagcacccagatgaacgtgcagagctcacgctcccacgccatcttcaccatccacctgtgccagatgcgcatgtgcacccagcccgacctggtgaggagcctgcagggggcccaggagccagcttgctgcaggggtatcccgggaagggcaagatgaggagccacagattcagaaatagcaaaccagattgaggctggcctctgccatttgttgatttttatatttttcttgagccttgttgcccaatttgtaaaatggcttaatgatctctgtatcgtggtgttgtgaggattaaatggaaatcaggcttgtgcaaatactgtgcacattgtcagatgctctgcatgtgcgaagggcaaggcgcttggccgtccaccgtgcctctcccggatggcagtactgtgatcaggggagccagtgaggtgggcgagggctgggtgagtcagagctgacttctgctgcaggtgaatgaggcggtgactgggcttcctgatggtacacctccctcgagtgagtatgagacactcactgctaagtttcactttgtggacctggccggctcagagcggctgaagcggacaggggctactggcgagcgggccaaggagggcatctccatcaactgtggcctggtaggcacatggtgggtcatcagccccagcacccacacagctcagtctcagacccctccaag

SEQ ID NO: 6874 - DNA, 1319 bp, Homo sapiens
tgtgtggcagtaactggagccccagcagaacctactcttcctggagtgcttcctttcccaggccccagggaggggcaggggccccatcctgcagatgctacagacactaaggcttccagcagacctggcacactgtgttcagctctgcagatgacaaggcaaggtcctcagcctgcagcacttggggaggcccagcctcccagtctggggaaggtaaggctttggggttcgttctttccatgtcagactttcaggatccaagacccttctggcttaccgtgccagatcttctctttttttcttcccactacaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctctgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttcttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaa

SEQ ID NO: 6875 - DNA, 1288 bp, Homo sapiens
ctgcagatgtcttcaacagtagagagtcctagtgagcctggggccccatctagtgccataccccactttgatggtcctgttaatgccctcccacattgtagttagggtttagctgagaagtggggtataaggcagaccccctgtgctgaggattgatccacattgatccctcaggtcttgggggcctgggaggaagcagattcctttaccacagtacgtatgcaaaaaatgttttccatgtttatggaaaaggctgggaagtgctggtgtaaaatgcccaagctcataatagatactcctttctccattgttgcccctgctctaactgctgttctttcttgccagcttcgttgttccctctggcttgtgggggcacggctgtgctccatgtggcaaggtggaaggcatggacgtgtggaggaggcgctggagctgaaggaatggacgagccctgggaggagggcagaaggctacgcagggctgaggatgaagatgcagcccctggatggtcccagactctcaggacatgcccagctcaggggcttcgagccacaggcctggcctcatatggcatgagggggagctggcataggagccccctccctgctgtggtcctgccctctgtcctgcagactgctcttagccccctggctttgtgccaggcctggaggagggcagtcccccatggggtgccgagccaacgcctcaggaatcaggaggccagcctggtaccaaaaggagtacccagggcctggtacccaggcccactccagaatggcctctggactcaccttgagaagggggagctgctgggcctaaagcccactcctgggggtctcctgctgcttaggtccttttgggacccccacccatccaggccctttctttgcacacttcttcccccacctctacgcatcttccccccactgcggtgttcggcctgaaggtggtgggggtgagggggggtttggccattagcatttcatgtctttccccaaatgaagatgccctgcaaagggcagtaaccacacagtttgctgagtgaaattctttgcccacaaagacccagggcttggagcatctctctctttatccttaatctcccaatttgcaacccattctgaagtctccagcctggataggcagagacactaaaaccccagtagacagggccttggtggtcctaggaaggagggcccatagattctggaccgagggatgtcaagctggtcagttcagtccctatgaatgtctcttctacaggaggctaccctgcccctgctaccct

SEQ ID NO: 6876 - DNA, 1228 bp, Homo sapiens
ttgggatccaagatctgaacatctagtatgattccttcattgtacagatgaggaaacaagaccagagggggaaagcaacttggccagcatcatctggcaaattgaggcaggcatagggctagaccctggcttcctaactcccagtccaatgttcttacagcagatgatgcttctataattttggtggcaggggcaatgggtacagggtacaaccaagagcctcttcgctattttactattgagattggggtgctgtggaggtgagggggtaccagtggaccttccttccctagcagtctggctgggcactaggagtgggggatcttcagcaggagggtgggtggtgtggctgggggtggaggaagaacatgcccttatctctctcctctctctgcaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcagggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttat

SEQ ID NO: 6877 - DNA, 1168 bp, Homo sapiens
tccttcctcgcgtttctttcccctgcgccctcggcttgcctctctccctcctccctcgctctctcccccttctctccccttcttcctcggtttcttccgtcctctctctccccctcctcctcccccgcctcctcctcctgcgctcccgccccctgccccctccccccgtgcctgcagacgcgcggatcgtccatgcgctcctcgcgggcagaatgctgggcagcagcgtcaagagcgtgcagcccgaggtggagctgagcagcggcggcggcgacgagggcgcggacgaaccgcggggcgccggcaggaaggcggcagcggcggacggcagaggcatgctgcccaagcgcgccaaggcgcccggcggcggcggcggcatggccaaggccagcgcggctgagctgaaggtcttcaagtccggcagcgtggacagccgtgtccccggcgggccgcccgcctccaacctgcgcaagcagaagtcactcaccaacctctcttttctcacggactccgagaaaaagctgcagctttatgagcccgaatggagcgacgatatggccaaggcgcccaaaggcttaggcaaggtggggtccaagggccgtgaagctccgctgatgtccaagacgctgtccaagtcggagcactcgctcttccaggccaagggcagcccggcgggcggcgccaagacccccctggctccgctcgcgcccaacctgggaaagccgagccggatccctcgaggaccctatgcggaggtcaagccgctcagcaaggcgcctgaagcggccgtgagcgaagatggcaaatcggacgacgagctgctctccagcaaggccaaggcgcaaaagagctctgggcctgtcccctctgccaagggccaggaggagcgcgccttcctcaaggtggaccccgagctggtggtgaccgtgctgggagacctggagcagctgctcttcagccagatgctgggtaagtcctgccgccccgccccgccccgcccctggctttctcctaaccagctgctggggaaggtgtggggaaagcgaagccccctccccttgcgccttcccggagggccctcctgttcacgatcaggctgtgatgggcattgcgcccagatgtgctgagctggcccacctccagatgcgcatggctcaagtgtaccttc

SEQ ID NO: 6878 - DNA, 1243 bp, Homo sapiens
ggtttttaagatactggtcagtttcagctcttttctcatttcccgtcctcttgcaggcaaacctgagggcaaagctacagacaagggtaagcttgcagtgaagaatactgggctccaacgctcctcctctgatgctggtcgggaccgcctgagtgatgctaagaagcccccctcgggcattgctcgcccctccacttcgggatcctttggctacaagaagcctcctcctgccacaggcacagccactgtcatgcaaactggtggttcagccactctcagcaagatccagaagtcctcaggcatccctgtcaagccagtaaatgggcgcaagactagcttagatgtttccaacagtgcagagccaggattcctggctcctggagcccgttctaacatccagtaccgcagcctgccccggccagccaagtcaagttctatgagcgtgaccggcgggcggggtggacctcgccctgtgagcagcagcattgaccccagtctcctcagcaccaagcagggaggccttacgccttccagactgaaggagcctaccaaggtagccagtgggcggaccactccagcccctgtcaatcagacagatcgggaaaaggagaaggccaaagccaaggcagtggccttggactcagacaacatctccttgaagagtattggctccccagaaagtactcccaagaaccaagcaagccaccccacagccaccaagctggcagagctgccaccaacccctctcaggtacccaatgtgggcagccgcctccttgtctgtttgctttgtcattctttcgcatatctctgccctccttggactagatgaggcatggcctatccaccgttgtctctaggcctttgcatggctctttcccacctctcccccatatgccaaggttctgaaagaatctagtttctgacagttctgaaagactgaatccctctttcaaaacttacctcatttgtactattctctgatcaatgcttaccctgtcttcagcacttgtatgggtgtttttactgtttatttacacatatatacctatttgcataaattcacttgtatctcccatgtgcatatgctggccccttatctaagctgaatgtgccccaagttgggtatcagatttccttgcattgtatttcacaacagcattaggataagcctctgtgcttagcaaataggcagaaaacaagactggataggatttctttaaggtcctatctgcctctcactc

SEQ ID NO: 6879 - DNA, 1222 bp, Homo sapiens
tcctaatgtccctctacctggatctgcttttttctagcttcgaagttccttcaacaaagcgttcagtataaaaaaggggcccaagtcagcttcctcatactcggatatagaggagattgctacacccgactcttcagccccctcatcccccaaactacagcatggttctacagagactgcttcaccctccatcaagtcctccacctcgtcctccgtgggcactgatgtcaccgagtaagtgctctttggctccctgccacccagcctgttaccagtgtaagctgtgggctagagttgacaggaggccattagaccttagacaagcagtacttattactgacctctccctgggcatatgagaccaacagatggacctttcttctcatgctgattgaatatcaatgggcaggagaagccaagaccaccaaccatgcctctcaatattctctagtaactctagtgcttcttcatgtagcctggcttgactcttgctatcttacaggggccctgctcacccagccccccacactaggctgttccatgcaaatgaggaggaggagccagagaagaaggaggtatcggagctgcgctctgagctatgggagaaggaaatgaagcttacagacatccgcttggaggccctcaactctgcccaccaactggatcagcttcgggagaccatgcacaacatgcaggtcagtgtctgggcggacagctgcaggaaagggaagaccaaggcttgctgtctgtccagtctgccaccctaccctgtctgttcttgccacagttggaggtggacctgctgaaagcagagaatgaccgactgaaggtagccccaggcccctcatcaggctccactccagggcaggtccctggatcatctgcattatcttccccacgccgctccctaggcctggcactcacccattccttcggccccagtcttgcagacacaggtacctgtgtgggagaagaatctataagggtgaagggaagaaaagggcttatttcactgttacaccattccacttgctttggtcagggcggtaacaatgccgaagccaagcagatgccagtgtcctaagacactgagttgtaatggtccttcaaccttaactacttttgagtttgggacctccattccttctctgtggcaaacagagttattttggaaaggataatgatgggaaagtttaggaaaggctgcgggtactcctaaaac

SEQ ID NO: 6880 - DNA, 1222 bp, Homo sapiens; identical to SEQ ID NO: 6879

SEQ ID NO: 6881 - DNA, 1158 bp, Homo sapiens
ttgtgtgccaccacgcctggccagttttttattgttttatttttattttttggtagagtcagggtctctctttgttttcaaagctgattgcaaactcctggcttcaagctatccttccaccttggcctcccaaagtgttgggattttgttgttgttgtttcccttctgtgggcaggacccagagtcccaactctcataaatccatctttttgcccccctttagatggccatgctgctgaaacttcaagaagctgccaactacattgagtctccagatcgagaaaccatcctggaccccaaccttcaggcaacactttaagggttcggcaatcactgtcacccccggacagcagaacgctggcatcagctatcttagctcctcctctcccctctcctctttcagagcactggctctccagccccaggaggagaacaggagggaggaggagatgaaagaggagggacaggttcttggtgctgtacctttgagaacttcctaggaaggaatggtggggtggcgtttgggaacttgtgccccctaaacacatttactggcctcctctaatgactttggggaaaagatgattctgggtctttcccttgacttcttgtttcaattacaaactcctgggctttctggggaggggttcagaaaacatcaaaacactgcagcagttcctaaatgattctcacaagcaaccctgagagagacagtcttgtgagggagatctgggggaggcaggaagctcctcagattttctcacagacccttcccaattccatcaccactgccaacaactcctcccccagagatctggctggagcccagaaaaagaagcatgtggtttaaaaaatgtttaaatcaatctgtaaaaggtaaaaatgaaaaacaaaaacaagcaaacaaacaaaaaacaatggaaaagatgaagctggagagagaggaaccagttgccaaggtagagagctgcccgctcctgccctctggatgacataggggacatcaacaagacggctgccaacctgagaagtcaccaaaccacaaaaataaccttacagccttcagggaaagactaccagctctgtctttctaccctctaatttaacaatgcataagagtcaataaaccctacttttttatttttggtttttattttg

SEQ ID NO: 6882 - DNA, 1747 bp, Homo sapiens
agaaaactgaaaacattcctctgtcttgtggccagtttggcctttcactgcactattctgatggtgcctgactgaatccaaatatcctagctggctcttactatttttcacaaatgagtattcacatataagagatgaacatccatgtgagatcatcccaatcagaatataagactcaaggagtttgacttggtggccaatacctgccttccaaagagatcctacctttgcagatttgctcctttcccattgccttgaaggtctggcaatccctgttctttcatttgacaagtacttactgagtactcactatatacaaatcattaggttaaaacagacacacacacacacacacacacacacacacacacacacacacacacaagacctgggcccttaagtttacagtccagcaggaaatgttaacctccattcagctacgcccccttgttatctagaccttcgggatcatctaagaaatgtagctgaaacccaaggagccagctagaaagaagcttttgattagatgtacaatacattgggggcagaagatctgggatcaattaagatggagcctgaaggactatggaatcttgcttgtcaggaatgggcaagtctacttcctgccatttctgaaagccccgcgggaccagcttctaggctgagctgcctagtaggctgaagcttcaggactctgcaggtcaaggatatgtgatgagcaccggcctaagtgtttgctcttcagattcctaagtagcacaagactttatcagaatctataggcataccaacctggatcactcttccacccaaccgaggagtagatgcatctgaatcttcatatcggtatattaagtccaaaagatggtccgggctgcccctcacaaaagcttctgcatccacgtggtaagctcccatggatgacagggttctgtatgatggagactattattgctattgctgctaattccatgagctgtgaagatccctaaccaactcagctgtaacatatgcaattctgtggtgggaagaggctgtgtgtccaaggatggtgctgaaatcactgccttaaggtctctgctgtgcagaatgaggaggcccccgagctggctgttctaacttagaaggaagagaagactggatgggcctgcttgggatctaggcctcttctaaaccctatcctaagctccagttccatggcaaggctcagacttttaatgccatcttaatctgatggttgagcgcttcactctattttctggtgctgcccagccagtgccttctgccatggatgttactggctacttgagaaaaaggagaggggagaaccccttctttcattccaactgcctccgaccccaaagggattcttggctctctggtaaccatggataccaccatgaattttatttggatcctcagcaggttgattctggaggcctcatgctatgactttttatttctcttcctgggatccaccaccctctactctcagctgactgctgcatttaggccaggtctccaattgctttcctccagaaagtgtgttcccgtctagtgaggtagtattgaagcctcggctttccctctggagcctgggaccctgtttacagttgcacatctgggcccctcactgtggggattgatcattctcatgaaggaatcacagttatatggcaactgcagaaggctgagcctcctcatggtgctataaccccttgggacactcatccagacttctctgaag

SEQ ID NO: 6883 - DNA, 1114 bp, Homo sapiens
gagctgagtcccttaatttctggatgaagaagaccaacaagttttgtccaatgtatttgtttctcagaccttgcctaggcactaaaaataaaatactaggtcattggaggctaatgtgggacctgatgtctgcgtgtgtgtgtgtgtgtgtgtgtgtgtgtgtctccctctctcacacacacaagagcagtttgctgttgctgtttcctaccttctgaggcttcaaagtattttttaaaatctatgctttgtggcagctctacggtgcttatctctgtctttgtgtcaatccttaagtacccatgtctttttcatgtctaaccattgggaaggtagaggctggcagggaagacaaatctgctacaagtccatgggaagaccctacaatgaaatgttcattggttggtatactgttttagtcttgaattgccaactttccaactgatctatccatattccttaagtactaaagacaaaatagagggcttctttttctctcttaatgtcttgccttctggttttcctggtttgcaagactaagtgtacctaatctcaccatctcttcacttctagctctctgaaacaagggtcacactactcagagggataaccccttacagtggtctgaggagtaactatttcctaaagtattctaaaagagtaggaagagagaaatggtagcctgctgcttctcacagacacctcacatcctcacttgggatggcatccacatagaaaccctgcatttaggtaaaatttgcctgactgaaggggactcagtcctccaaatcaaggtcaagaagatatctgcatgagaccttaagaactctttattgccattatttggagagggcgggggaattgtcctaatcacacatttaacacagggaataagtgctgaagtgacccagatcaccaagcgcagttcctcatcatactttatttttgctttccttattccttggcactgactaagctaaagttaagaagccgacttcataagccaacccctgtgatgggatggaaaaatgggcttttgcagagggtttattaatagagatggatatactactcacaagttctggctcatggctccactgagaaggccatagta

SEQ ID NO: 6884 - DNA, 1138 bp, Homo sapiens
gaacttgggtaaagcacaaagaaacatacagtgctagtaacaggtctcctgcgccctggaactaagtgtttggaggaaggactaaaccccgggggaggtgagtataaaataattccactaagatcacctcctcagtccccagaaggctgatggtggatcctctggccatctcctgtggggtcttactgctcctctgccatttctctatgcctgaagacacgaagatgatatcaaggcagagctaccatatcgcagccagtctctaggctactgctgtgcagtggctcccactttctaatgcttttttgtttttgctttttctaacaaaacaatcttttttcaaaatgaattccaacccctgctagcttccttccccgcctccatactgttttaggcagcaccgtttatgtgacagagtccgtgtttctcaaatgcatggtgttcctcaggtggagagtgggcagaagtttttgcaacactttttttttaagttattgggtgcaaaatcccaaaccaggatatgtgtatgtctgtgtgtttatgttttttatttgaccctcccctctttcaacctacccccttttatatctaatgtagaaaaagcgaaattgaatctggaaagcaaactgttgtatatagttgcggtaacaatcatgaagagagagccgggctgtcccctcagtaattcattttaaataacaaattatttaaaaataaaattcatgccagagccagctgaagaggccttccttcatcaccactgaggccacccccaatctgggccctctgtccatctggcatgtctcctcccagcaagattcatctgttcaatgccatttgcgtttcaataaagttatctcctgtactgtccactggttctctagctccctctctgcctggtttctgtctccatttatcttgtggcccattccttgattggcaaggccagactgcttgtggtcatttgcctaacccagaagtaacctgaaaccctaagctagagtctcctgactcccatggttgggggtgggaggaacccctgctcgcacattatggacatagaatccttcaccggatctcaaaacatccagcccaaacatcaaggctccggagtcctccatctgggttgctgcagtgt

SEQ ID NO: 6885 - DNA, 1650 bp, Homo sapiens
tgactgagattggaagaagtagagttaaaagtttttactacctttgagaagcctgcgggcatgttcacagtcgtcccatgccagccaggttctgaggctaactgcttgtgcccctgctgcttcacatggcattgtgggagttgctgatactggggaaatgatggcagatctgaccaagtggtgctgagaaaaccaccctcggccttgcagactccatagtttatctcaaggcagtgccagtcggatttggtgctaaaggcataaggccaagtcagcctctgatattggcacaaaagaatggtctcatgccagtagcattgaactgctgagcttgggaaggcttaaggctcccacacacagactgagaatgatgggggtccctctgcgtctgctaattagacaaacattctatatctagtgccaaaagtggtcctaaatcctttggcaagggtcctttctgctctcatgctgatttgggggaggactgggcatcctgcctcaggagaacttgagtcctgaggaaagggccctagtaacacttaagggctacccctggctaacagatactcggctgtgggtgagagcagaaggtcttggacccctcgatgtgcaggtacttaattgtgtttccagtgcattttcatatacattatcccatttaacctttataacaggttcacagagtggatattcccattctgttgatgagaaaaagagtggagagactgtgtccagtgtcagcaggaagaaaaaagatctgttggaggccagtacatgttgacagaaactctagaccatattttgtctcctgtctttggccaaagagaactagcttcagtctgaaaagggcagggctaagtggttacaaggaactaaaaagttcaaggtaagacaaatgaggtaaaaataaaaaagagcacttagctgctctgagacattttagtctcctgactggtaaacagcagctggggcaccaaggggctcccaggagtttgtcgagcttttattggagtgaactgaaaggaaaatggaaggaatgctataagactgaaaagaagttaaagccctaggaaggaagctgataacacaagttacagacgtatatgtgacattgatttgggagaatgaacctacaacaaatgacccaaaagcacctaaataagagtgacgagagtttaacagacattcattatggacttcagagaaaatgatgctaaactggtcttagaatcttctttaattttgttaactaggtaaataatctggacattttagtcaaagcattagacagacagagaagttggtaactgaccactaactaacaaactataaattcacccattgtgggttgacctggtaagttcccccagggctgtgtccttggcccctcctttgatattagtgacagatgactttttttatgccttacccattccacaaaagaatttgaagccatttacacaagagatagtactagtaaattaggagtgctgatcaaatttttagataataagaaacccttaggaaggatgacaatttagaatccaaatttaggatccaaacaaataccattacaaactataaaaatgagcagaatctaaatgtaacatttcaataaatgcagattgataataacatctgtgcagagtt

SEQ ID NO: 6886 - DNA, 1458 bp, Homo sapiens
caccatgttggctaggctggtctcgaactcctgacctcaagtgatccgcccgcctcagcctcccaaagtgctggaattacaggtgtgagccaccgtgcccagctccctggccttaaaagtcatgtaatttaatgatcagaccccagtcacagccataggatacaaagaagcaaaggcaaagagccctgtgtcctgggcacggttacaggccagtgtagggaaagagcttctgcttgccagtgtgaagaacagaggagtttaggaagtgtgagtcaggctcagcttagtcaggcagagaccagtgggcatgggttacctgggggtaacgcgggccaggtgggcgggctggcagcctggggcccatttcctgccaaagcacctctgaccatccttctcttcacccaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctttgtcttagctacctgtgtactgaaatttgggcctttggatcgaatatggtcaagaggttggaggggaggaaaatgaaggtctaccaggctgagggtgagggcaaaggctgacgaagaggggagttacagatttcctgtagcaggtgtgggcttacagacacatggactgggctgggaggcgagcaaaggaagcagctgagactgttggagaacgcttacaagacttcatgcaagcaaggacatgaactcaga

SEQ ID NO: 6887 - DNA, 1235 bp, Homo sapiens
acatgctgtggctctgtctctttcccagcacctgaattccgctactactcattcagggccatgtggcgcttgccagctctggacttcttgtttgtttttgagaaagtgtctcgctctgtcacccaggctggagttcagtggcgtgaccatagctcactgcagcctccaactccactcctgggttcaagcaatcctctcacctgagcttcccatgtagctgagactccaggtgtgcgccacccctcctggcatctctggacttctgatacccttaggtttggtttcttgggcctctctgctgccccagcacggccagtacttgcaggccttataagctgttctcttttctcctatcagacatcaccctacagtggcttattcaacactcgaagtcacggagaagctgagactccagcccttctccctcagaccagggaccgtcatcatctaaacctgaagccgagctccccgcccacccctgtcgtccccctaagcccacccctcctcacccagtgtgaggagggccctctggggaccccagagtcctgttctgctgaggtttgaactcctgtttttattgtaaaataaattgccccccattctggtcccctaacttctcacccttccccgctgcctttgtcccatcacccagccctgcctccctcccagcagccctgggccacagcccccgcccctggcttttccccggcccgctcttgtacctcccttttcaacactctctgttattgtcctgtgtgtacagtatatatatgtatatatattttaattttttaatttaagcaaagactaaaatcaaccatttgatgctgcaggggcctttcaggatctgggagggggcagtctggagagaaggagggagacgcaggtggacttggggcaagttcagatcagaagaggtgcaggctggcacctgcggcaggtaccagcctgggcactggtggccgcctccctgtcccgtgtgtttccaccgcccaatctggcttgtcctggcagtgcttgaatgccacaggctggcaggggcctctgggggcccctcccctcgacccccagcctgggtagagccaccaggtacgacgaccaggtaccagaaaccaccaggcacacggggcagaaagccagcgtccatgccccagcagccccctcctgcctgttcctggctcccagctcccgcccctccccagggcccccacctccacggcccacttcattttctg

SEQ ID NO: 6888 - DNA, 1200 bp, Homo sapiens
gtcccgcgggtagagggtcacgggacggggcggccgagaggcttgaggagggggtttgggcaagcccagccccacccagagggcttaacccctccttgccggaagaggaagccccggccctattgagggggaggggaggtatcccccggggtagaggagtcagctgaggcccttggctcaagcccagactcctccccaacttctccccgacccgcagtgtctagccgggggtccagggaggatcgcatggtaacgggagtttggagactccgtctggctcagaagtttgcaggagcaggtgctcccgacaagagaggatgaggtgtaggggcacggcccactggggccttgggagagtggctctaagggctttgggtcgtcaacactgaagtgggtgattgtaagtctttcagcgccaggggagtggtggggaaggagttaaaatctctctcaaaaaaggggaagatgagctccatgggtgtgagctgaggctgccgtaatggctgcggcctgcctgtcagagccaggctagacagggcttgtgggtcgaggaagcatgggacaggggctggggttgtccagggacctggccccagtcccaaagctgaggtttcccacaactgtgagttggccagatagtaaccaaagatactgatgagataggtcagcagaggaatgtatccagccggcctaggtacctctacctgtccgtgttgttgccccaccttgcagaagatgggcctcctcgacagttctcagcgtcctagaaggcaggggacgtcacttcattggacctgaggcatgaaggcagatggaaagctcgaggggcgggcatcctgtggttacacaattgaacactggcttcctttcccaaacatgctctgcaaatgacctctgccctttctcgacccagtgtctcctgtctcctgacctgacagggcaggatcttcaggccaatgctgcggttttggcacagtaattttcggagctaacacccctgggctctgtctgcctaggctctgcccttggggtcagagaccctctggttaaacttggcattgacttaggctcttggattcccagagcaggcacataacacctggactctgacctgactctgcaggcctaggtggcttgggttctaggcgtttaggtctgagaaatgcagctgggcctaggtatctcctcgttccccagggt

SEQ ID NO: 6889 - DNA, 1229 bp, Homo sapiens
tatcagacctttcttcttcagaatcaagtattctatttggatttagaatttaattatttaacattttaatatttcttcttaagtaatttagtttcgtcttacagcacaggaagatttcatgtggatgtctggttgataggagagttttatggaggcataatttaggcagatttatgcaaattttaatgcacactttattcttctattttcacacccacagcactacttaataagctccagtgtggcactgggaaagtttaaggctgcatgccttctttatgttacttagaaattctcttgccatccactgggagtgagaggatgggagttagtaatatgagtgtgaaagaaatcctgtttgttggcattgctctagtcaggaaatggggaagccttcagtcttaattattgaagtttaaggcacatagaaattaataatggaatatcttaactgagaccatattttaaactcaaaatagagacttcgctgtgtattgaatgccagatgcatgggtaaaatttatattagattgacagataatattgatcctggatcttgtctacgcaggtatttcattaatcacggagccagtgtaggtattgtcaatagtgaaggtgaagttccctctgaccttgcagaagagccagccatgaaggatcttcttctggagcaagtaaagaagcaaggtaacctcatggattggagggggccaggaaagattctcaaacactgccatttacagaaaataatccatttgctgtgcagagcatttcactatcacatgacaggagaggatttgatctgtctgcactgcattaatcattaatccagcatcatgtatcctcataataactcagacaagaataggccagatgtcaaaaggatgaccaatcattccttgtttttgccattcagaggttgcatacccatcatacaattaagagtgacctgatgaggactgtgtgtatgcacagtactgtgtgtatgcatggtattgggatacagtgtaaatttgagaattggctaaactgagtttgtgactttgcatcttttcccttgttgagagctaaaagtggtgctgataaagatatttattgtaactaatcatgagaattagtatgataatttgttaaggtgaggaagctaacttagaataatatattctaaaaatgcttattcttattttatagttttaggagaatcgatttcacagaataggatggaattt

SEQ ID NO: 6890 - DNA, 2439 bp, Homo sapiens
ctctctccagctcaaacttctttgcagaagttcattgtactacatgtaaaggacttacttaggacagtgcctaacttcatgtaggcactccataacaatagccatttctggctgttactttatctccttatttcttatttcctttatttatctatttaaagtattgttataggcatgtatttctgtaagaattctcaagtcctctttagaaagagggaataagccaacaggtaaaccaaatctttctttcctctagccttaaaaaggcaagagaaagtctttgttctcacttttttttttagaaatctctgctaattgtcttacatgtcacccaactgagaacttggaaatcaaactagaaggcttttcattctttacttctcatatttagtctgtcaccaagtcttgtctgtcattctccttaagaatccttcaattccatcttctcctctctttctgttaactcaggccctcctaactgggccttcctctcccctgccccacccaccattccaccatctacagtgcagcattagtgatctttcttatatgcaaatctcatccaatcactgactcctgcttaaaatctgagaatggtcctgcaagcaatgctgtcctcccttgttttgtaggatgtctctctctttttttttttttttaattatactttaagttttagggtacatgtgcagaacgtacaggttagttacatatgtatacatgtgccatgttggtgtgctgcacccattaattcgtcatttagcattaggtatatctcctaatgctatccctccccgctccccccaccccacaacaggccccagtgtgtgatgttccccttcctgtgtccatgtgttctcattgttcaattcccacctatgagtgagaacatgcggtgtttggttttttgtccttgtgatagtttgctgagaatgatgatttccagcttcatccacgtccctacaaaggacatgaactcatcctttttatggctgcatagtattccatggtgtatatgcgccacattttcttaatccagtctatcattgttggacatttgggttggttccaagtctttgctattgtgaatagtgcttcaataaacatatgtgtgcatgtgtctttatagcagcatgatttataatcctttgggtatatacccagtaatgggatggctgggtcaaatggtatttctagttctagatccctgaggaatcaccacaccgacttccacaatggctgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataagtgtcttcttttgagaagtgtctgttcatatcctttgcccactttttgatggggttgtttgtttttttcttgtaaatttgtttgagttcgttgtagattctggatattagccctttgtcagatgagtaggttgcaaaacttttctcccattttgtaggttgcctgttcactctgatggtagtttcttttgctgtgcagaagctctttagtttaattagatcccatttgtcaattttggcttttgttgccattgcttttggtgttttagtcataaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttgttttctaggaagtctcttattctctttagattctgcccagatcatccccttgcaacattttattcctgatactcctcagatttcctctccagagctatctctttgtggcaatttttgtcttaaattttaattatcagtacttaatatgtccagctcccttacaagatcttgcttcagaacagagcatttggaataggtaaagaagggtaaagtggtggctgggcacggtggctcatgcctgtaatcccagcactttgggaggctgaggcgggcggatcacctgaggtcaggagttcaagaccagcctggccaacatggtgaaatcctgtctctactaaaatacaaaaaattagccaggcatggtggcgcttgcctgtagtcctagctacttgagaggctgagtcatttgaaaccaggaagcagaggttgcagtgaccactgcactccagcctgggtgacagagcaagattctgtctcaaaaaaaagaaagggaaggtaaaatgggaaactggttgaatagaatgaacaaaatgagcacatgaaccagtacactattgacc

SEQ ID NO: 6891 - DNA, 1126 bp, Homo sapiens
cataagtgtcagctcattgttttcgtctcccacttatcttcccccttcaaagtgattttctttataagaaaatttgggctctgaatactccattctgcctcacttccttgaccttgttttcctctcttcgccctgacacctgcttctaatgagaaatgaagtcagtgcaaggaggaatgagaggtggggaggggagattgttgagagatggactaggaagtggaagcaggctggaaagacacatatggcgaaagtcaagtatctgaggccacttgcaacattgtgacaaagaagatggaagatagcagcctactgggctgtgagaatagtggtgaatttgattatttccagtggttagatttagcagagagatttactttcttagaaattaataggggaaatggcacttaatagaggtttaatggaatgaagtactttcaacccattgatgagagtcatggaagtttagagtggcaagacccagaggtcattaggtccagctttctattattgtgtcacagggacccctgctaccacagctttcacccatgggcatggtcaggtagcctctggtggctatgcatttattactcaaaagttgggcaactctaataacgagagagtttttcctcatatcagctgaagtctgcctgtggattctccttgtagtccagatctactatctgcaactctttaacggcacttgagatatgtgcagtgggtggtctccccctcagtcttactttgagctgctgttactctagtcctttaagtcattcctcatatggcatgcttttcttacctgtcacatcttggccatcctcctctagacaaaaccagcctttaaaatatcatgtccaggcctggaaagaatacaaatccagtgcaaaattaaaccattagttcttgatgataacctagcattaatacttacagtattttctttttgtaggagttttatcccttggttcacttgagtgtgcaagtcattaaatcctcatcattttagggttgccagtgatattcagtgtttagagtggttcattcccttaatatatactacctctgtctgttaattctttcctaacatgacatgtagctctccatggtcctccctctgaaacac

SEQ ID NO: 6892 - DNA, 1490 bp, Homo sapiens
tcgcccaggctggagtgcagtggtgtgatctcagctcactgcaacctccacctcccaggctcaagggatcctctcacctcagctcccgagcagctaggactgcaggtgtgcaccaccatgcccagctaatttttgaatttttttgtagagatggggttttgccatgttgcccaggctggtctgaagctgctgggctcaagcaatccacctggctgggcctcccaaagcgataggattacaggcgtaagggcccacgcccagcctaccatactgattttcaaggcagggtctaacccttcataagatgtgagttcttccaacccaataagcaggcagctttgaggacaaaaaggcaacattaaaagataagaccctagaagtcagaacatctgtattccaaggccaccccttctccttttagtcatgtgactttgggcaggtcaccctccctgtctgtaaaatgaggttggactggataatctttatgtgccctttccttttggcttaaaattctgtgatttattcattcttaggaagatcagcatatttattgggatttctgcttcaaaaattctttctaacctcaaaaatccaagtccagaattttttgttttcttctggatttaaactgtttaatatgagcacatcaaggttgacttctcatcctttttgggaagtgaatttaatattgagggtaattgaatgatgttgcaatggctttccctcctgctggcttggtaagaatattaaagcctgcagaggtggaaattggagctcatggagaaatggatagaaagcaatttgttgcaggcagcctttggacaagttgttttaataggaaatagacctgctgcttcataggtttcctcaaccacctttcctcagctttcttaaaatgggatctacattggctcttcacacccaaatagcagactaatcgtttttctgcttagcaccgtctggttcattgtcttgaactctgccttacagcagcaagaaaattttcctcgacaagaacctcaatctttagttccattgagctccccctctggattttggacttaccagaagtaggaggttctgataccattcaagatggtctttccttcaaagcaggtctgaagaggagactaccaaagcagtgtttacaaacccagagtccacacaaccatattgcatagaacagcacttggctttcacaagcctcctacaggacctggtgtaattggagtgaaagggcagagaccctggaagtggaggtggctgtgtgctgcgatgggaagaaggcagaaggcccaggggctttggacatagagcagggtggaagctgcaagtactgggaaggaagagagtttcacagaaacaaagctttgtcacacagaaatgagttctgtctcactggtgacttcatccctcaggctccagctgagcagagattttaatcagcttccttaatgggtattgacactgctcaggaagcagtagaccct

SEQ ID NO: 6893 - DNA, 1242 bp, Homo sapiens
aaaatgaggtctggcatatacttgattacaaatgaaaactcagaaaccaattttatttattaaatcatatcttttgtttttccccctcccttctaatcccccaaaggacctatttgagctgttccccaattcatctgcttattttggaccatgaatctgccagagtgatattttctgttatttctcctccaaatttttccctgatgtttccaataaagatttacttgggtggccccttaaggtgacatcaggatgctcttatgtccttccagaataagcatacacttcactcctctccctttcatctccctctgcattcttaattccttgcttttctcacttggagccgagggtgctttagagaggtggttttccatgaatcagccaagattcctgtagaagttgggtataccaaccaccaccaccaccgccccctattccagtttcaaagctcctcggctatgctaatgtcccctcagagatgaggtttgacttttaggcccgtatgactcctccatagcctggccaaggagaccatgagtagccatgtctggtttactctttatcctgagactgtttatagcttaaaacagaagtgtgtcttcccagcacaaacctaatcaatcagtgtatcagtgcatctggtggcaacagctcagcccattcaaagagcaaggattcaggaaaggcacactgatggtggggagcctcttaagagcctctaatgttctcccaaaaccagagttgagagtcggagtgccagtcgtcggggcccactattcctgaataagggacatgcaagggccagaagtagcttgactctcgcctaaatatctgtgcctttgcctgtcctttctcccactctactgaaacccggaacagattcccgcttgccttctgatgaagagaggttaggtaaagagagtttggaggaaaaaagacaccaggaggcaggctgcggggtaggagagggttctgagaggaggcagcaatccagaatacctccttttctagccagcatcccttgaacttttgaaaggttgtgcctaccactggctggcacaccagggcaatgatttccctgcagaaggaaggaaagaatgtttcacccttgcatccttcttggagaagctacagcctgtgctcagttgagtggttcacactcagactttggctttatggttttccttcctccttgtctttgccctgaccttgatcaacaggggtgaaaagaaccaccct

SEQ ID NO: 6894 - DNA, 1194 bp, Homo sapiens
aaagacatttcaagttatttgcaaagagtcaactgaggactttgtagaaattgttacttttcaaattcccacttcccagggccagcctccctctcgtcattgggctcagactgtggctgttccctaagcccagctctactggaagggaattcaagaatatagtccccaccaccaccccgccccgcccagcctcccagacaatgttccccggcaccaccacactccccacagttccacagcctggcatgtgttctcaggagatgtgtgggccccagcacccaccagagtgccaatctggtcttcccccaaccccaggagagaggggacctcagccccttttggtgcttccctgaagggagattctgggttagaagccagagcctcaggaccatctcaccaccctcacccaccatactgaccctcacaggcagctcccactccctcacccccacctcagcgcagcaaaaacaaccagagacaccccccacccccaggtttctttcagctcatttctttaataaggagacgcagttcattacaaaataacaatttgacaagagatcagacaagaacaagagtccacataagggagatggagagcattgccaagcagaagtgggaatgagagggccgggggcaagggctgtacatgtgtccttcctatggagacgaaggcagggctcctggtgggctgaccttggcgaagctaggctctgccaggccctgattttgaagttttcagccccagggttttcagaaagcagcaaatcaagtccttagatgggcaggagtcagggcagaagggtcactatctttgaagaggcccccctaaagtcctgatcgctaaggcaggtgggatggaggaactcctggtgccccatgcacactgctcccatcacctcaccagacagatgctctctcaactcttgcctcaatttgtctctgctgtgggtgtggagagtgggagggccccagagagagctggaggaagcaagacatgtcttcactggtccaagcacctgattccagcctgctctgaaatggtcccctccaccttccccactctttcagttcccagcacaaaggtccctgggacttctgtgtgcaacttctgttgtggtttgtgcagggcaagcctgcctcgccacctctggcctcctcgaatgcgccctgcctgattcccttcccgttctc

SEQ ID NO: 6895 - DNA, 3286 bp, Homo sapiens
ggtattggttggttaattggaagggtaatcacgtctttaacattcctttttccagtgatcctttggtagcattaacagtgataggggaaggaagtatgttaaacccaaactggttgtcttatacaagactgggaggggagtggttaagatgcagtatttttttcccgtgtagattgggggatcatctgatttctaatttacatgttctctttagcttcattagttttagtaataggtgacccataggcgaaaattgaactttcctatcttccacccagaatgactgttgccgagggaagcgagatggaattaacagtcttgagagaaaactgaagagacgcctggaaagagagggcctctccagtgagcggtgggaacgagttaagaaaatgcggacccccaaaaagaagaaaatcaaactgagccaccccaaggacatgaacaatttcaagttagagagagagcgtagctatgaattagttcgttctgctgaaactcattccctgccctcagacacatcctattccgaacaggaagactctgaggatgaagatgccatctgcccagctgtgagctgcctgcagccagaaggagatgaggtcagtgaggtttgggccatagaggacgtgctttcccttaactcagaaaccctgtaagctagacctcatctcgctgggtctttctcctctgcttatctgctttgagctgatctgaatggattgctcagcccttcccccactgatatctgtgctcttaccatcgttcctgggtctcctcccttttcttgaagaaactcttgttcttccctttttccttttcttgctcttccagctttcaccttcccggcgctaagaaggtgggagggatgctgatgtgatgccctttggcttacttatcacagggcagcgctgtcttaaccccaaagcagacacgacttgaagaatgactttgactcggttgctttggctagggggccagctacactcatttggcttagctgttgtgccagaggtcccagtggtgggacagtggctgttattggcaaacggcctgaatttcttgaggctggcctgcccaattttgaatccattttttcctctgaaaaccccatcttcctgctctttgtaaccaggtggactgggtccagtgtgatggcagctgcaatcagtggtttcatcaggtctgtgttggtgtctccccagagatggcagagaaagaagactacatctgtgtgcgctgtactgtgaaggacgcaccaagccgaaagtaaaaacacaaaaacagatacccccctacttaatgtaattcaggactccaaccaagaggatttcttcaaatctcagcaaagctacaggactggtactcaagccagcctgtaaacggtgctatttctattccttatgggatcatttttccaggactctttgaagaaaagaaaaaacaactaaaaaaatttttgacactttttgtattttttccttaagagctatttgtggttgttgaggtttgaaaagctgactgttttttttgcaggggttcccaccaatttggaaggcattgaagcttgcaccttttcatgtacagcattaaaattttacctctctctgggatttaccagcttaagagtccaactcacttccagtgcccaaaagggcacccaccagaaattccagtaaatcctcatttgaggaagctctcccttgtttactctgttaccacattggggaaatttttaagtttttcactttgggagtttttgtttgtttcttcttttcctttatccacttttcttcttcctggtagactaggtttatttatctgagcaataacttctatgttggtttcagtggctggaattaaaacaaaacaaaacaaacttccaaacagtgtgttggtgctttagcgattgattgatgtacagaacacaaatgtctagtttctagtgtcactgatgaactagtgatgtagaaaagagacttctctgtaagtaattgccacagctgtattttggctttctccctgtcccttcctttctcccctattttttggtagcttgtatcaaatgttacagtttatattgtggaataaatccttcgtcctaacataacactaaatgctgattatttagagccattagagcacagcttcttctgcccctctactgttgcacagccagaaggggctgcttgcttttgcctctgcccaaccaggttgcagtagcagtggatgttagcctgcaaacaacattaggggattcttcttttgtgtcctgctctgtttggtgggccatatgcctacagccctcactaacaaagaacccctctgtcttcaaggactagaacctatctttaaagccgtgctcttttaaaataagctttctcagaatgttggcaaatcacttcaatcctcaaatcagtcttccttgtggaatgctgcctttattatatttgaattgacaggggaacttggtttagggttaagacgttggaaggaaatctaaggaaaattaatcctcacagaggtccgggtttagtatatgtcttgagaggagacttgtgaattcccagactctgcctcctggtttcctttctcatttctttctaactgtagctatcattactggctgtggatagcccatagctattttccttgcttttcttttttaaaggggtctgttctgcagtggagaagacattctggtgaccagacttttgcttaccttttcctattctgttgccaatttttgttttccccacattctatagccataaacctgaagatgagtaaaactggtgggtctttaataaaacaacaacaaaaacagcagtttgtgatatagcagaggtttaaatgtaccctccccttttatgcacttcaaataattaaatctctttaagaatgacttctagttgtctgcagttttctgcagttgttgtgatgtttctcttcgtctgatggtggttctggggccaatagagaagaatagtctccagagtacaatttggaatcatcgtggtttggccttgttagtattcaaattcttagaatcccctccatcacccccgactttgagataggatgccaactgtcccagtcctcaccttccattgagaaattaagcttaaaaggagaccctgctgctaatataaagccactgcctttagagagcttttgccatcttagtaagcacaacccctacccccatccccactagtttttcttcttcacctgtgggtggtggtacacagtccctgacaatagcatctttgaggaagtcagatctttg

SEQ ID NO: 6896 - DNA, 1159 bp, Homo sapiens
gaaaggacacaactcttatattaattcatggtcaaaggagtgtttcccctagctcctttaataaaacactaaggaagataggaaagtggttatggatgatttctgacaggtcctcatttgatttactcaaaggggtacatatgtgttcatcgtattttaatcttcaataaggagaattagaaaaggattaaaaggctgtatgatctgttctcacactgagaaagtggcttatttcccagtggccttctttacatctctgaaatcagtccaagtaaaactggaaagattaaaggcttggtctttgggaagatatgagttgatttggccagttctgaaatgccaggagactcttcagtaggggaaaatcaagttgtttttttttttttttcccctggttgcctgcctgggtaatgcaagctactgtcattggactaatgggagtatttttaatcctgaagagattttattataaaacgttttccctccattaggtatctcaacctcctggcacaacatcattttctttgcctgatgactgggacaacagaacctcatatttgcactcccccttctcaactggacgaagttgtatccccctccatggtttgtattttgttattacgttgagggctggatagtaatgagtgatcttgtattactaggtttttattatagatgatcaagtaccataaaaaggactttatgctgaaatgtaggatataggctattatgtatttgcaaaatagggaagggatcctatttgaaggcttataaatgcaaaggaacagagaggaagactttatatccattgtcctcagggatgaaagggttcatgccacaccagctgataaacaccaagcttttaagtcagatgctaagtcatgggctctcttgttgcttcattacttaggagacttgtggagaatcttagggataatccacatttgctagagtcctgatccttagtcatagcatctcagtgtatgtctagtaatgtggttagagctccttgatctactcagactgttgacactgtggccatcagtctgtttctgtgctttctgttagaagtcatcaaggcagaagtacaatctcttctgcattagcaataaggtaaatgagaagaggattcagtgtataattaatactagtaatcaga

SEQ ID NO: 6897 - DNA, 1301 bp, Homo sapiens
gtgatggatctgaaaggggatagatgtggtgattggaaatggttttttaactgtgacagattttttgagaacttgtttactatgtgccaggcaaagagtgtcctatcccacatctcttacttgtcatctcaccctgtaaggtgggcactattatcacctccattttacacatgcagaaatttagccacaatggaatacatggcaccaggtcactcacagcttagtatgaggcagtcaggatttgaatacagatgatctactcaggatcccatgctcttaaccactaggactctgagttttaggggaaggccaagccatctcggacatcatccttgattgttaactctttttcagatggcaactcttggggaagctcgcctaagggaaatggaagccttgcagtctctcagactcgccaatgaagggaaattgctgtcgcctctccaagatgtggatataaaaatctgcctatgtcagaaggccccagctgcccctatgattcaatgtgaactctgcagggatgctttccacaccagttgtgtggcggtacccagtatttcacagggcctgcgaatctggctttgtccccattgtcggaggtcagagaaacctccattagagaaaattctgcccctgctcgcctcccttcagcgtatccgagttcgccttcctgagggagatgcacttcgatatatgattgaaagaaccgtgaactggcagcacagagcccagcaactgctttcgtcagggaatcttaaatttgtgcaagatcgagtgggctcaggactgttatatagcagatggcaagcctcagcaggacaggtgtcagacacaaacaaggtgaatctggactttccttgttgggttattggaatttgcaaagctctgtacctttctctcgaacctgtagctttggtgttgctattcccttggtgtgatcactttactgttaacagcacccactttacctgtagcttcccacttcaagaccatgcaggtataacatattcttttaatttcctctgctcctattagaagttgtttcccaggcactctttctatagagcacatatttagcttttcacagatacaaataattttttcatttatatgtatgctgacccatttatattttacatatacgtatatgatgtatctttaagtctttgcttgactaaaaagttttttaccctgcttcttctcatgtaagtcaattagtagaaagggaaaacacttcctgccttttatcgctttttgccctttaagggaaaatattttttggaagaagtgtttgagcactg

SEQ ID NO: 6898 - DNA, 1147 bp, Homo sapiens
aggcccagcacagtggctcactgtaatcccagcactttgggaggccaaggtgggaggattgcttgaggccaggagtttgagaccagcctggccaacatggtgaaacaccatctctactaaaaatataaaaattagttgggcgtggtgatgggtgcctgtaatcccagctacccgggaggctgaggcaggagaattgcttgaacccaggaggtagaggttgcagtgagctgagattgcaccactgcattgcagcccaggcaagagtgatactccgtcttaaaaaaagaaaaaaaaaacaacactaccaccaccaccaccaacaaaagacccaaactaggttctctgtttgtgtaatgaaggaacaaatgtcacttctacccccaatatcattggtcagctggcaggttagtcagcgtttgtgaatttagcatgttgagatcatggagtaatctgaagtactcaatggaccaatctgaattaagcttttcctgtttttcatagaagtgttcttttctctaaactgctgtaatttttcttgacttattaggctggaggacgtgtgccagtgttagacacactcatagaacttgttacacgaggccgatctatccccgtacatctgaattctttgccaagactggaaaccctagtagctgaggttcaggcttggaaagaatgtgctgttaatacattcttgactgagaattctccatattctctcttagaggtaagtttacaaccagctcatctgcaagaccttagatctcctagtttggtaaaacatgcagttcatcacatacaaagatgacatcacagattaatctatattctgtgagttgttcttcccgtaaagccagggagactcttctaattttctggtgaagcaacctttaaatgttttcttggttgatttagcataacagtatctaaagaagaaaattttttcctattgggtgaaattcctctgtgttgaaattggactcttaaacttggccgtgcttcgcccacctgaatttagtaagcctgataaatgatctcccccattttttaaaagtgctttaactgcactttttgtattttctgtaaacttgcttgtgcatcatgactgggatcaaccagtatatatcacatttttaacttgttactt

SEQ ID NO: 6899 - DNA, 1256 bp, Homo sapiens
caaagataaatagggcctaggctaggaattttatgagtctggtgttttgtttgttttttaaattttttcgagacagtctcgctctgtcacccaggctggagtgcagtggtgcaatcatggctcattgcagcctcgacctcccaggctcaagcaatccttccacatcagcctccagagtagatgggactacaggcgtgcaccgccacacccgactaatgtttatatttgtttgtagagatgggatttcaccatactgcacaggctggtctccaattcttagactcaagcaaggcttggcctcccaaagtgttggaattacaggtgtgagccatctacctggcccagagtctggttttagggttggtaaatgatacgtgttaagacccatagtgtgatgtttggtaatttgataataatgggtcagaggtgtttggaaatagaagaaagatgaatgttatttttttctttccgtgttttgatacagctgccattaggccgacagtgtgtggagcattatcgcttgcttcatcgatattgtgtgttttcccacgatgagatgatctgcaagatggcttccaaggctgatgtattagatgttgtagtggcttcaactgttcagaaagacatggccattatgattgaggatgagaaagctttaagagaaactgtccgtaaattggtaaggcttatggaaatccaactgcatgttgtcattgggtattatttagtaaaatttttacgcactttaatatcattttaagcagtctttttaaagcctattttctttgaggccattgtaatagatgtatagtagtatctcgtggttttaatttttattcactatcttatttgccacatgtacatatgtctctttgaagtagctgttcaaatgtcttgcccctttaaaaaaaatgttttgtagaaacagggtctcactatgttgcccaggctggtctcaaactcctgggttcaagctatccacccaactcaacctcccaatgtgctgggattacaggcgtgagccaccacacccggcttgccctttatttttttaaaacatttggtttttgtaataattctttatgtattctgcataccagtttttttttttttaaatcagataggtgttttgctaatgttttctcccagtctgtggcttgtctttgattttcctaccagtgtctttcagcaagcaggagtttttcattttgatgaagtccagtttgttaattattttcttgtgtgaatcatgtttt

SEQ ID NO: 6900 - DNA, 1164 bp, Homo sapiens
aaaacacagggacactggcgaccactgctatatactgtgttttttgtgttggttgcctacattgctctcagacaggtccagtgaaaagaatgaaaggatggactcaggtaatgtatttgaaagcatctcaaagtataaagcatcattgaaacaacaaaccttattactgtgctgttgtcaactgtacagtgctatacgtcattcagacacaactaaccattattactatacagtttatgttacattttttgaaacacagaaatatctcccggtcataaataattgctttccttggctcccttttacagttgtggcctggctggtgatagaggaacataaattccttttagacagtagaggtttcctgaattgcctaagatcaattatagaacattatagacacaatttttccttaggatgctgttctttgattcccatcactgagcttaattggtcacagacagtttgtgaggaaactcattttttctattccttgtatttccagatggtccccacagagcttgttgagaaagaattttggagactagtaagcactattgaggaggatgtcacagtggaatatggagctgacattgcctcaaaggaatttggcagtggctttcctgtccgagatgggaaaatcaaactctcacctgaggaagaggtaggcatataagtggcttggaaattgaggtatttattgaaattctgtttggttggcttgaagtaacttatgattacttttagcaaatccttaattaccagatttttaatgatttcaagaaaagtagaaagagcctacagaagaattctagtcctaactatgtcactatgttgtggtcataggggaaaattacttatcatcctttgccttcagattttataaccttggtttctccttctgaagaaaacctgaaggcctgagaccaggtctatttattttcaaactttaatatttttgagtatttttttccatactagcgaactcttaggaagagttctgtttctatcttggtaggaaagtgtgatttttttttttttttggtagttttctttgaaagtattacatatgatcagaaaagtacatagttatatgtatacagactgatgaatttccacaagctgaacacacccatgtaaccagcactaactaaaacaagaaat

SEQ ID NO: 6901 - DNA, 1160 bp, Homo sapiens
ttggtaatgtattacctggtatcttttttttttttctcctgagacagggtctctgtcacccaggctagagcgcagtggtgcaataagggctcactccaactttgacctaccaggctcaagaaatcctcctgtctcaattccccaagtagttggaactacagacacgtgccaccactcttggcctataaccttagcatcttgttgttttggaacctactaaaaactaggtctttaaataacaaactttaaacacatgacagttgagaaagctaggagattccactttagatttggtatgcatgaggtattgtgaaatatccttcatagaaagtgaaacatttttatttaaaatatcccttatagaggttgaagcatttgtagcaggatgtagagactagattatgtctcagatccatttcatttctagaattttagaaaatcaaataatagctcatgttcctttgttctgtacccacttttattgctacaggtggacctgtatgtctgtcttttatgtggcagtggcaatgatgaagaccggctactgttgtgtgatggctgtgatgacagttaccataccttttgcttgatcccacctctccatgatgttcccaagggagactggaggtgtcctaagtgtttggctcaggtaataattaatagtagaggtaacactagaaaaatttttttagggcatttttctttgcctttgagttttattttttattttattttattttattttttttagacaaggactcactttgttgcccaggctggagtgcagtggcacaaacatggctcactgcagcatcaacctccctggctcaagcagttctcccacctcagccccccccacgtagctgggactacaggcccatgccatgatgcctggctaatttttgtattctttgtacagagggggtttcaccatgttgcccagggctggtctcgaactcctaagctcaaatagtcctcctacctcggccttccaaattgctgggattacaggtctgagccatctcacttggcctgcctttgggttttagatttggcagtcgacagtaatgaggcccatgaagaaaactgggatggacctgaataggaaagaggtcttagaagtgagttccacaatgtatgtgggtagttaagaggcagaa

SEQ ID NO: 6902 - DNA, 1208 bp, Homo sapiens
tgaaactatacagttgtaaaatctagaaaacatattggattccttatttttttttattccgaacacttgttaaaaatgagatttttaatatggaaaattgttttgggagcttataaggggcctttctaacaatatggaccttccattaactgacagtcgcaagcacaaataactccaagtggttcattgggaatgccttgagactgttatggcctgttgtaacctgatgatgtcagcaatgaaaaatcaaagcaacaccacctgttaaaattttttttaatgttttaaacctgtatagatgtatgtatgtggttggtaactgcagacttgtctttatttttatttagatttttaaaaattgtaggcctgttgtctacataaatagttgtaaaatgtaccttacaaaaatccagtgaaactctctaagattaaaaaaggagggaatcctttcagtccttgcacaccggggaacaaggtcgtgaaaaaaaggtcttggtgaggtgccgccatttcatccttcctcggtctctgcacctttcgcagagcttccagcagcgctatgttgggctagagcatccggaggttcacagcctctgtggtccgtaggagccactgtgaggagggccctgggaagaatttgccattttcagtggaaaacaagtggtcgttactagctaagatgtgtttgtactttggatctgcgtttgctatacccttccttgtagtaagacaccaactgcttaaaacataagggtgtttcagttcctccatttaacagatatgaagagtattttaagaggtgcagcctctggaagtagatcaaactcgaactcatgtggcatgctagatatgtttgtcaataaacttatgatgtgaaaaaaaaaaggagggaatttatcagtacagttgttatttctagtgtttgcagaagccaaacctgaccacagacactaaggacaaggagtacaaaccccatgatattccccagaggcagtctgtgcagccttcggaaacgtgccccccagcccgacgagcaaaacgcatgagagcagaggtaagagcctcatgaggttaatttaaaaggaattctcaagccctaataccaatggctgtctggcactggatttctctcatgtgtgtgctctttgtagttttgaaccttgttaatctcacaaagggatgctgtttgtattccagcttttacactt

SEQ ID NO: 6903 - DNA, 1209 bp, Homo sapiens
ccttattgtaaagtggaaataagagtacctatctcatagggttgtgtgattaatcatgcgatgcaattagaacagtgcctaggatatgaaagtgccccaaaatgttacgttattattattattactactattgccttctcatgaacatgctatgtgtatgttcaagctgttatctctactggaaaatccttctccgtttccaatactctttccaaaaccccctcctgggttttactgcacctaccattgtgtactgacgtgattgaatgattggcttatgggactgatcctttctaccagacttaacttcttcagggcaggaactctgatacatagtaaatggtcaataaaagttggctcaactgaaaccctaaggataaactccatccacagcggaaggcgcggccccgcccgattcgggggcggggcggggagccgcgcgcggagggtgggtcgatgggggtggggtgggactctttttcctcgccgtggcggcggaggcgcacggcgtgggcttgcggcgagacgtcgtcgtcggaggctgaaaaagcccaaggtgctgccgttgcccgtacaactcggacttgctgttgctcgagccgcgtctgcacgggtctcggaccgagcggagctcgcagcctcggtcccggagcccaccttcgcctcgcccttgcccagcctgcggtgatggaggcggccaccacactgcacccaggcccgcgcccggcgctgcccctcgggggcccgggcccgctgggcgagttcctgcctccacccgagtgcccggtcttcgaacccagctgggaagagttcgcggaccccttcgctttcatccacaagatccggcccatagccgagcagactggcatctgtaaggtgcggccgccgccggtgagtcacgccagcaccccggatccagctcgtggctgggggagggagcggggacgcgcgggtccggggaggcccgaggcgcggggggcggggagccggtcgccccgccggcctcgtcaagtttggggctgcctagaaggtcggagttgaggccgggggaggaagacgggggcttctccagggtgggagatgaggagcgtgggagaaccgggggcttcggcggtgccatgggagggccgggtcgccgcggggctcgggcggccgggtgcggaggttcgggttcggttccggatggagtgatggcaggagccgggggtg

SEQ ID NO: 6904 - DNA, 1253 bp, Homo sapiens
gggagagagagactcatctgacacttcttttggaggtcaggatttgtatatcagaattgaagttagaattaagtgaattaaactgaatttgattgtgagtgaacctagaacagcactgaagtattacataacctggaagactgagaagggtatattatttgaaggatctttttatttccccgaggtctttcgcactggagacagcataaaagagtgaacaaatgttgggatgagagaagatgacatcaatgtgggagttcagtataactggggataaactagaagaacctgtgattttacagtcatcttattacctgccagggctcatctagccatggcaatgtttgccttgaatgggggtgaaagcctttctttgttggatcaaatactactacactattacacttccacactatttatttggggatgggctgggagtgacagtagcctagtagttcagctacctgattactgccccattcttttagaagcacatgtctgccaaggagtggtttgtactgctgtgtttggtacatctagtcttttttctgctataagttttccttacctgtcctttagtgtagattttattcatcacaggacagaataatcaaggacaaccaaaatccttttgttagtttcagtacctcagctatcaacatttctgagctaccattcaatgttcctctgtgtcatggagtgaaattcttgttttgtgggtattaggagtgtgggaatgtgataacctaaacaacctttgctctgaaattccatttttccctctttccctgagttgtattgacctacagagttaatttcctttgtatttttttaagaaaatattaaaaatcaacggtctcaaatgccgagagtttgtggctaaccaacattgcctttagtagatatttgggagggaaagatgtagggatcagccgtagctcctgtctcttcaagctgttcatcttgtgtgtttgccaactagttccgctatttctatgttagacacaggtaagaggtagccactttacactttggagattctcatcagtaaaatatttacctgatttgccatattcattagcccctctgacgcttggagttacttgaaaaaggaatacagaaaagatcttgaattcacttagcacgcgcttgaatttcagggtttcagtcacaccagtccttttttccatttgctttgaattgtggcatgtgatataaacagctatgcggaaggcctgcaaaactgaaacagt

SEQ ID NO: 6905 - DNA, 1683 bp, Homo sapiens
gcccaccatgcactttactatcgctgagggctttgtcaaggccaccacagtgggccagatgggctggttcttcctcatggctgtgatgtacatcactggagctggcctttatgctgctcgaattcctgagcgcttctttcctggaaaatttgacatatgggtaagaaatgaatcttccagcaggtcctgtgatggtgagtgaacagcccaaagttaaagggctgaggaaaaggtggtatgagactgggatcatatagtgtttggaggtacatatatgtgcattgaaggtaaatcatcaatattaacattttggtgtatctctgacaaggactgtgtttttaaaactttctaaatataccactttaatgttattaacaaatttgtttaattaaggataaactagaagaagcaaatgctttctcctacttgtttcttattcctccttgcattatcctaaaggctcttttctttttattcctacagttccagtctcatcagattttccatgtcctggtggtggcagcagcctttgtccacttctatggagtctccaaccttcaggaattccgttacggcctagaaggcggctgtactgatgacacccttctctgagccttcccacctgcggggtggaggaggaacttcccaagtgcttttaaaaataacttctttgctgaagtgagaggaagagtctgagttgtctgtttctagaagaaacctcttagagaattcagtaccaaccaagcttcagcccactttcacacccactgggcaataaactttccatttccattctcctagctggggatggggcatggtcaaacttagccatcccctcctcagcaaggcatctaccggcccctcacagagacagtactttgaaactcatgttgagattttaccctctcctccaaccattttgggaaaattatggactgggactcttcagaaattctgtcttttcttctggaagaaaatgtccctcccttacccccatccttaactttgtatcctggcttataacaggccatccatttttgtagcacacttttcaaaaacaattatataccctggtcccatctttctagggcctggatctgcttatagagcaggaagaataaagccaccaacttttacctagcccggctaatcatggaagtgtgtccaggcttcaagtaacttgagttttaattttttttttttcttggcagagtaatgtaaaatttaaatggggaaagatatttaatatttaatactaagctttaaaaagaaacctgctatcattgctatgtatcttgatgcaaagactatgatgttaataaaagaaagtacagaagacacttggcattcaaagatttcacatgtatggtcttgattatttgcacacaactccaaaacattaagtaagacctgtgataatttcagattctcctgaggcacaaatttgaatcataggcattgacaggctggcacatgcaggccaataaatggacctaattgaattcctagcatccattccccaatacagctttacttttttatgtaattgttgcatggattatctttttacatttttaaatttttttttttcatagagccatttgaaaagaacagaccatcttgttagagaaatcagtatgctatagtagtgttcaataattaggagattctcagggctgggtg

SEQ ID NO: 6906 - DNA, 1099 bp, Homo sapiens
ctttagagttgtgaattgtgctacaataaacatacatgtgcatgtgtctttttcatatgactgcttttcctttgggtagacacctggtagtgggattggtggatcaaatagtagctctacttttagttctttaaggaatctctatacccttttccatagaggttatactagtttataatttacattcccacaaggagtgtataagcattccccttttaccatatccatgccaacatctgttgttttttgactttttaataatggcctttcttgcagaagtaaggtggtatttcattgtgcttttaatttgtatttccctgatgattagtgatgttgcctgtagctctctgattcaaaaacatcaaccatcaaagtgtacacattcccttttttcttacaggttttttttattttaccctcctgcaggtttcgtgctgtttctctttttgggaatcttgaccatgctcagaccaaatatgtacttcatggcccctctacaggagaaggtggtttttgggatgttctttttgggtgcagtgctctgcctcagcttctcctggctctttcacaccgtctattgtcattcagagaaagtctctcggactttttccaagtgagttaaaagaacaccataggaaaatactgtgcactgttgtcacatcttgagatcccagtgcttactgggtgataggagctcatatcactcctaaaggtttcttgatatgccagaggaaaggctctctgttctgtggcgatagtggggtgatgaagcttttctcttaaacacttcatgaacagacttactgcatcctcttcaacagatggagagaccaattgtggaatatattttctacctgaaaagcactatcttttgtgaggcttagagtgccagtgcactggctgctttccaagaccttgtacaagcgtaacttactattagcccaagccaaagtagggtgtggtaaatagtctatgcttcattctgctggtgctcctacccagcagtcaagtaaagcttatctttgctgcccatgcattgctggaagctccagatgtccatcatcgtgtgctttctctcttgcccagccgtgagcctgag

SEQ ID NO: 6907 - DNA, 1267 bp, Homo sapiens
ctttctccagagcctttcagggccctccccagtctcatggcaccacacccccttgccagcatgtatctggagtattaagtactttcttctccccatacttcagattgggcctacagcaagggctttgtgactgccgacatgatccgggaacacctgcccgctccaggggatgatgtgctggtactgctttgtgggccacccccaatggtgcagctggcctgccatcccaacttggacaaactgggctactcacaaaagatgcgattcacctactgagcatcctccagcttccctggtgctgttcgctgcagttgttccccatcagtactcaagcactataagccttagattcctttcctcagagtttcaggttttttcagttacatctagagctgaaatctggatagtacctgcaggaacaatattcctgtagccatggaagagggccaaggctcagtcactccttggatggcctcctaaatctccccgtggcaacaggtccaggagaggcccatggagcagtctcttccatggagtaagaaggaagggagcatgtacgcttggtccaagattggctagttccttgatagcatcttactctcaccttctttgtgtctgtgatgaaaggaacagtctgtgcaatgggttttacttaaacttcactgttcaacctatgagcaaatctgtatgtgtgagtataagttgagcatagcatacttccagaggtggtcttatggagatggcaagaaaggaggaaatgatttcttcagatctcaaaggagtctgaaatatcatatttctgtgtgtgtctctctcagcccctgcccaggctagagggaaacagctactgataatcgaaaactgctgtttgtggcaggaacccctggctgtgcaaataaatggggctgaggcccctgtgtgatattgaaagggttgttgtgtctggggtccttgtttccaaatccccgaggacctagggaggaagggtttgccaccatgcaactctcccaggtgttccaaagaacctttgagaagttgtaccatgtgctgaaatgtgagctgccagcagactcagtgatcatctcagcagctgtctcagcagagccagagctccgcttctccctggaggctctcgaggtgggggaaggagaacacacattagaggggacatttttgagcccagctgcccctcacagtgttcccttgataggccactcttccccttcttccttctcttggcctatccttcaccatatttatccttcag

SEQ ID NO: 6908 - DNA, 1203 bp, Homo sapiens
agtattgaataagcaccggagaccctgagccaccgagtagcggagggaaagggtggcgcgcagaggggcccagccccgcctctgccggaccccgcccccaaaaggccccgccgccgccacctcctgctaggccccgcccccgacagacacccccccccccccccgccaggccccgcctcctgcccccccagccgcgaggtcctgcctcctgcccggccccgcccccggcctgccccgccctccgacccgccccgcggcgcattgtgggatctgtcggcttgtcaggtggtggaggaaaaggcgctccgtcatggggatccagacggtaagaccctcattcagtatcctccactgggggacccctccccatctggttctggccactcagctccggaccaggggctgtcgctgccgaccccgccccgcagggctctgggcccaccgtggatgctggggtcccgatcccgcacatccgggctcgggactccgccaggttacccctctgcccttggcatgcctccgcgctggagctcgggatcgccacccctgggacggtcaccacccaagccccgggctcttacccagcctggcggtcacgctgcctcctctacccacagagccccgtcctgctggcctccctgggggtggggctggtcactctgctcggcctggctgtgggctcctacttggttcggaggtcccgccggcctcaggtcactctcctggaccccaatgaaaagtacctgctacgactgctagacaagacggtaagttggggaagaaagggccagggtgaaggaggggaccagagtgctcctggcatggagggtacagcacccacggtggttgggatgtccaagggacgtggcagcgccaggcgcgcttggtgaaacacttgtgtcctccaccctccagactgtgagccacaacaccaagaggttccgctttgccctgcccaccgcccaccacactctggggctgcctgtgggtaaggaaagtgtggaatgggctcctttccctggtatcctcagaaggtgactcccctcctgggatctcatgaaacacgctgcttcaaccggtttgctccacacaccattccccttcccccacttggctctgcatcctccaagctgtgaggtgccactgggcccctctagagtgtggcttccatgacccccatccagctttaacactcaacagtct

SEQ ID NO: 6909 - DNA, 1124 bp, Homo sapiens
cttatgtatagttgtagtggtgaggagtaggcaaattatatgattagtaaaagggctagtttttgatgctaggtatggaagtgtagtgacaattgtaaactgtcaggctgtggtgggaaggaatgttgaagtagaaaggagtggagaactcactgtgagatctgactggagaacctggtggctcttcgccagtataggttcctccaggacaggttctttttgagcagctaaagcataatataccgataccaattcagagtttgctcttttgttcagtgaaaaagtgaggacttcaactttaaaaatggatggagaactgccggattacaaggcaaagacgtaaaagtcgccaagaggtcaagtagcactggggacaggctatctactggccagtggaatagtgcagtaaagttcatacagagaccaggagtcttagaaaactgacctagagcaggagagacaggtcacatattggtaggagtaatgtgtcatgtttcaggcactacacgctggatgcttccctgcctttgcgtctgcgaccagagtcaatggagaagctgcgctgtctccgggcttgtgtgatccgatctctgtaccatatgtatgagccatttgctgctcgaatctccaagaatccagccattccagaaagcacccccagcacattaaagaattccaaagtaagtgagaatttgtgttggggtttgactaatgaactcttgtatggtaggcctgttatcatggcttgtctccagcttccttgatggggaggggtgtaggtcccaggctgctaggggactaatgtaaacttcagggctcagagatttcacttctccaagacctttctgctgtgctggctggcttatcttaccttaaagctttctggtgcttttagtgtattccttattctttttattttaatgtatttgcatacattgtacattggaccactctagatataatggttttgatggtttgggctaggaagagcataactcaaatggtagacgtatgctgtaatttttaagaggggctttaaatcacagtacagaggtataacatgaacatctcactatttttctctttctaatgcaaccttgacatcagggattcccctttattgt

SEQ ID NO: 6910 - DNA, 1124 bp, Homo sapiens; identical to SEQ ID NO: 6909

SEQ ID NO: 6911 - DNA, 1849 bp, Homo sapiens
tttgttttataatttagagattaatcttgtggcctagccagtataaattagtctggactatttcatttcagagtgagctcttggaaaccaaggttgtgtaagttggatactgaatttgcttttccatttcagtttactatcaatgtgagcacggacatgcggcatcatcgagtgagactggtgttccaagattcccctgtccatggtggtcggaaactgcgcagtgaacagggtgtgcaagtcatcctggacccagtgcacagcgttcggctctttgactggtggcatcctcagtacccattctccctgagagcgtagttactgcttcccatcccttgggggcagcctcgagtgtagtccattagtaatcagattccagtttggacagggtggctggattgtatatctcgttagtaatgtacatgctcttcaggttctagggctcctgttaggggagggagaaatgttgaatcaagagggaaaacaactactatgatttataaacatattttaatgtaaaaatttgcatttaaaaggagtggccctgttttctgtgttaaaaccccatttggtgctattgagtttgttctttattcttttatcccagtgaaaattgttgatcttgctgtagggaaaaattaaactctttgaatctccaaacaaggaagtttcagcattcccttatggatcagaggaaccttagaggcctgaaattgttgcttccagtttagctgcccctcaaattcaagtgaatattttcccttctccctttacccttctccagaaataaagcaggtgacagggttttcagaatcttaccatattgacttgtgtatcttttttaaaaaataatttgtgatatttattgcatacattttcttttggcagttttggattttaggtatttttttgcatgaggctgataatggtgatgatgactttatacccttggtactatactaggaactttacatagtatctctacttctcacagtcttgcaaagtaggtgatattattcccattttatagttgagaaaacggaattagtgactgtacctataacaccagtaaatgcagagccaagattctgacccaggtctttttgttgtaccataagtttaaaagatgagtctcatttttcttgtggtagatggtggtaaaaaggagtaggcagagtgtacatagataaaaaaaagtaaaagggtaagtaaaaaattgattgtggtatatgttattctaatcagccaaaaaagtttagaagattgatgaaatgatcttttaaatatgtatttctgaataaaatgtaaaaccaagaaagttatttcaggaaggatagtgaccctttccttgaactgttagaagggcatttattaggctaaaacgtcattaacaaaatgcattgcatgttgaaaccagcctcttgaaccataagcacttagcgactttgctctgccctgtactgtgctgcttctgctgtcatcctgtgtgcctacagaagcctggtcttccgtccatgcagaaatgcttatgtcctcctgttgtttagatgactcctattgttcaggtgtactctgagaagagaatcacgtttttctgttttgctaaggagaaaaccttgctgcttgtctctcctcccaccctccaccatccaaaattaaccagtgagctggatattacctggatattgccaggaggtgggcattaagacagtattctttaaaagtgaaaatcttgtgaggcaaactgctaaattcacatttttgtttttttttttttaccatcttccctaggaatattcctagaaagcatctgcttaattttgctgctaacagctaaccttatcccacg

SEQ ID NO: 6912 - DNA, 1849 bp, Homo sapiens; identical to SEQ ID NO: 6911

SEQ ID NO: 6913 - DNA, 1162 bp, Homo sapiens
gcattgatgaatttcgtgcaggggaggaactcatcaactagaataaaggaacctttggacccaaatgcataattagacctttctgcagctcaggaagatgtgaatcagaagacagctagctggctgaggaggaggaggagggagagcacgcgaggaggaggttggggaaagaggaaggagaaagaggaatttgctgagacagggagaggtctgtgtgtgaaggaaaggggtggtctgggaacggggaggaggaacatggccacctctgctcagaatatgggagtgtcagcccagagaatgaggtccagctccttcttccccagtccacaggggtgaggggagttgtggagctggccacagacaggggaagctgaacggtttgatcaggggaagaagcattttgggtgaagccttatgattttcgatgctctccacacacgttggcacctaaacctgagacagcacctcagattggtttctggattacccaaacttgttgcctactgtgcactgtgggggggtgaccgggacttaaaagaattctaagattctgcctctggccacgaattctgaagggttctagcatcaattcaaggagatgtttagtagaagacagaactctgcatgttcccctttgtggttttgtgcaagtgaatgcacccagagaaggaggctcagagacacagctctcagtgtgtggatttccacacccctgacccaagccagggtcatccttctctctgagccttgtagcccacttgtgtttggggctctgggtttcctttgcaccttggcttggaggaaggacaggttctgtctaggattctagggtcgataacttgggtccatctggctggaaaacacccccaaggctgaggctcctggggagactctctgaactggggatgacccgcttgatgccattctctgagactgcttggatgcagggacactgagcagaagctccaggaataatggtcccgtcaggccatgggttgtcctctgccaaggagcctcctgctgcttctgttccccacccctgatccaggcaagggaggagaggcagaggggctggctgacacacacatctctttccttgtagttctgctaacagactccgaattcagtatgcaggagcctatggtgcctgccaagctgggga

SEQ ID NO: 6914 - DNA, 1217 bp, Homo sapiens
agaaaatagcttctcctacagtgattcatgtcccaggtccaggaaatccaatgttggtgaaggcagccactctcttgcttgtccccaaatcacctaaccctcatccagggctattttggtgggcagggactgcctcctcccggaattcctaagatccgcccagctgccaccattttcattgctttccccagcagcatgatgggaacccaagctgagggatacaggtcctgatttggtaggaatattattcccaagaaatacccgctcctcacctactccctcatcctaccaaggtgcctgaaaatgttcaagacttatgttcagggtgggatgatggaaccgagggcttcatcaaagtgagaggaaaggaaaagcatctggcatgtgtttcttggataggggccagtgcagtgccatcctacaggtggctggagcagctgctttgcaacctgatcaccttgagttctgagcagggactaggcttgcaggtgagataatgggccagggcacccagtccagaaggagcaatggcacctgggcagtgccagggcttaaagcccgctgctccttttcggtagaggagaggcccatcactggtgtggtggggtgggctctcccttaggcttgggcaaggcagccacctgcccttgctctcccttagtgttccctggcctccctgccatcaggttgctgggagtggagatggagggattattgagcagaaaatgagttggatggagataaacagctcccatccctgggtaatggatggtaagatgatggagattcctaagattggtggagttgggcaatgcatagccatctgactccttcagggtgctcttgatgggctggctgtaagggagactcagtcccagcctctcccctctacaactcctgccactgttggccatgtcgtaaggcagcagctgtgccaggatagctgggtccattcagagcaccttgagaagtgttgcagggaggtgttaagaagagaactctgtgcaaacagtgatggaaggctgttgtcttggtgtatcccttgcctcatagtcaatatattttttttttggcgagtcaccagtgacccgagccctccacaccagcctcctgtatctcatcaggtcccttctcagtactgtatttgctcagtgcatcaggaatgggtgtatgggtgtgtgtgggtgggtgtgagtgtgggtgtgtacgtaccaata

SEQ ID NO: 6915 - DNA, 2035 bp, Homo sapiens
gagcagcccctccaagaactacgtgatggcagtctccagctaggcccttccgcccccgccctgggcgccgccgtgctcatgctgccgtgacaacaggccaccacatacctcaacctggggaactgtatttttaaatgaagagctatttatatatattatttttttttaagaaaggaggaaaagaaaccaaaagttttttttaagaaaaaaaatccttcaagggagctgcttggaagtggcctccccaggtgcctttggagagaactgttgcgtgcttgagtctgtgagccagtgtctgcctataggagggggagctgttagggggtagacctagccaaggagaagtgggagacgtttggctagcaccccaggaagatgtgagagggagcaagcaaggttagcaactgtgaacagagaggtcgggatttgccctgggggaggaagagaggccaagttcagagctctctgtctcccccagccagacacctgcatccctggctcctctattactcaggggcattcatgcctggacttaaacaatactatgttatcttttcttttatttttctaatgaggtcctgggcagagagtgaaaaggcctctcctgattcctactgtcctaagctgcttttcttgaaatcatgacttgtttctaattctaccctcaggggcctgtagatgttgctttccagccaggaatctaaagctttgggttttctgaggggggggaggagggaactggaggttattggggttaggatggaagggaactctgcacaaaacctttgctttgctagtgctgctttgtgtgtatgtgtggcaaataatttgggggtgatttgcaatgaaattttgggacccaaagagtatccactggggatgttttttggccaaaactcttccttttggaaccacatgaaagtcttgatgctgctgccatgatccctttgagaggtggctcaaaagctacagggaactccaggtcctttattactgccttcttttcaaaagcacaactctcctctaaccctcccctcccccttcccttctggtcgggtcatagagctaccgtattttctaggacaagagttctcagtcactgtgcaatatgccccctgggtcccaggagggtctggaggaaaactggctatcagaacctcctgatgccctggtgggcttagggaaccatctctcctgctctccttgggatgatggctggctagtcagccttgcatgtattccttggctgaatgggagagtgccccatgttctgcaagactacttggtattcttgtagggccgacactaaataaaagccaaaccttgggcactgttttttctccctggtgctcagagcacctgtgggaaaggttgctgtctgtctcagtacaatccaaatttgtcgtagacttgtgcaatatatactgttgtgggttggagaaaagtggaaagctacactgggaagaaactcccttccttcaatttctcagtgacattgatgaggggtcctcaaaagacctcgagtttcccaaaccgaatcaccttaagaaggacagggctagggcatttggccaggatggccaccctcctgctgttgccccttagtgaggaatcttcaccccacttcctctacccccaggttctcctccccacagccagtcccctttcctggatttctaaactgctcaattttgactcaaaggtgctatttaccaaacactctccctacccattcctgccagctctgcctccttttcaactctccacattttgtattgccttcccagacctgcttccagtctttattgctttaaagttcactttgggcccacagacccaagagctaattttctggtttgtgggttgaaacaaagctgtgaatcactgcaggctgtgttcttgcatcttgtctgcaaacaggtccctgcctttttagaagcagcctcatggtctcatgcttaatcttgtctctcttctcttctttatgatgttcactttaaaaacaacaaaacccctgagctggactgttgagcag

SEQ ID NO: 6916 - DNA, 1192 bp, Homo sapiens
ggcggaggttgcagagcgagactctgtctcaaaaaaaaaaaaaaagtctgttttattgtcctatgaaaacataggtatttattaaaatgtgtcataatttttggctcagaaaacataataagtgaggccaatgagagatgcttttcataattttaaggtgcctatgggctgagagtccccttaggggaggacgggccaggaaacaccacctgacacttgctctgggccaaagccctcagggctgttctgggtccactcccctgctgccataaggacatcccctctgctcctggcttacccttgctacagggcttggaactgcttatgcccctgacgccttgaccgtgtgtataccttgattgtatatatctgtttctactttgggacttgagttttctggctccttccttggaatagctttccgcacaccttcttgtgcaaactgccattgttggtcttgttatctgactcagatctacctctgggactgccagctaagcctggcactgatagcatgcttctgttattgtccctgcctgcctccagagtcctattttgccaaaactcatggctctgatgaacacttgtggagaaaatgtggggattattggggtagaatacaaggacaaagctgccgattctctatttctggtgggttgtaagaaagttcaagactgacccctctgatttccaatactcttgcttatgtaggtaggtcttcttattgcctcttggaactctgacccatttcctgtttttatttcttaaactgggtcaaatgtacttctgttctttctcccctacgtgtagctcacaatctggacacatagatggaaacagctcatttatctttagtgtttgcagtttcttttggagcccagcatggctgggcatggtctgcttggtccttttgtccattccagtctttctggactcatttcccccttcttctgctccctggaccacacggtccaggaaaggattaggtccagtttattgtgccatttcatgcagcacatatgagcatggcctagtttccagaaaagtttcctactctggaaacctgggctgctacaagattgagcaatgtgtttgctccatctgggcacaactttctagcctaggtacccagaggctcagctggcaacaggagtcatgtctactagctcccatctgtctgaggcagaagaat

SEQ ID NO: 6917 - DNA, 1155 bp, Homo sapiens
acatggtccctgggagctgccccttgctaatctcagggcctcagggccagctgtcccattccaggaggccattcctaagacagagcagggctctggggctggaaacagttatgtgagcaatggagcatcccatcttggcccaccccaggtgtggggaattttcaggcccagttgagccaagccacagaatgaaggcaaaaaggcaaaacatgttttggaaggtggctggcagccccaactgtctgctccatgggccagggctccatgaaaggctgtggagttaccgaagtggtgcggggcctggggaaaggcagcccaggacagtgatggctctgctttcttagagaccctcagaaatgaaggctctctaccccactgtgcctcattcccccagtcatggtcagcctagcacttcaagctaaaatgaccttgttgggaagttcttccttccatctaccttgcctctctcatgctggaattcaggcttctttctatttagatccttgttggaagacagagaagcccttttccatcttgagtggaatttggatttgaggacagctttgggctccttggagacaggtgctgggtgaagggcaggtgttgtccttagcactattatgccattagcattactcatctgccgggctcctgctgaatgcagtagctctccgggcgggcagccaccctccctcctgttttttctggagagagggaaaaaaaggggaggtggggaggtgtggggaagtgtgggcagaaggaggaagggaaagacacagagagataaggggagccagcgacctctaagtccaggtttctggtgggctcccgttgctgtctctattcacagggagggtgggccaaggggaatttggttcctgaggctgttacactctgattgctgtggacctgagaccgtttccctctctcctccttcctccctcctcctcctccttcctccctctctggctctttctcttcttttcctctccctgccttttctttctccctcctgtcttcgtgcctcccacttttctcccattcctccatctgccaaccctttcctcccctccggctgtgcactctaagctccctccttgctctctgctccttcttcttctctcctctgtctttgggctactctagcggctgagc

SEQ ID NO: 6918 - DNA, 1164 bp, Homo sapiens
ttcatcctatgtagcagttgcaccagtcaaatcttcccccaccacttctgttcctgctgtttcatctcctcctatgggcagtgagtgatagtctattatgatgcatgatttgctaaaatgaccacaagagagcacgtggcatccactttaaccaaccatggttatcttttccttttggtttttccctttgatattttgacttaagggaagaaaaagacaaaaatcctactctaaaaccagactgtgtgcccttgtattttatttttgtaatgtagaaaagctattaaaccttaactgttttaaagacaataattctgttttctgattgttcctctgcattgctcatttcttccttttcttgagttttgttttgttttgctttgccttttttgtttgtctgtttgttgctttgctgggatatgttgttgttcctctcttctcctcctgctcctttgagtctgaactctacctcctaagcttagatgtgaggttaggccagaggaaaacccaagagctttctttacatgggggcaaagtttgggatcttttgaggaaaggtaggaagggagctaatgtgcccatgggtgtgttttgactagtggacctgtcataattgagccagtattaaacttggtcaataataatagtccatttggccaccactgtattgctgactggcaattttagcataaaagttgtagctggctgggcacgatggctcacgcctgtaatcccaacactttgggaggccaaagcagatcacgaggtcaggagatcaagaccatcctggctaacatggtgaaaccccgtctctactaaaaatacaaaaaattagctgggcgtggtggcgggcacctgtagtcctatagctactcgggaggctaagacaggagaatcacttgaactcaggaggcggaggttacagtgagccaagtggagagccactgcactccaccctgggcgatagagcaagactctgtctcaaaaaaaaaaaaaagttgtagctataggtgaagaaaagaaagtagttcagttcaaatgtatatggttgaacatccccgttattttacttttctgggactccggtttaaaaatcagttaatcttggctgggtgctgtggctcacacctgtaatcccaactttaggaggccgaggtgggcgga

SEQ ID NO: 6919 - DNA, 1280 bp, Homo sapiens
tgaagtgaacctctacctgaccatgaagaggcaagagcacagacttacaaggatttcaacttaagcttgacttggggtttgtagcgggacccagtcaaaccccattcaggtcatggtagaatctactccttggtagtcacttgtcatttttaaagaaatgatgacaatcctcttggcatcaccccaccccacattctccccgatgttcctctcctgaattctggattttgtcctacaagtctgtgccatttataagctaagttgagggttcagagggagacaaatatccccaagtgaaatatgttgcggtagagatggaatgtataaaatccgccagtagtgtgattgtttttcaatttttcccactttgaaaacttacacctaaaggcctgtaggcctctaactctttctgccctttcattcaaacctctccaaagttctttgtcttttgtcttcccttcctttccttttttttttttttttttatgatgattaagaaaatggaaaggatatggatgaattgtgtaaacttagatccttctcccttttggcccaaaagaacccttgatttagttccagaatccaaccagtttctttgttaaaagggtccttttgaagcaattaagtgctggtaagaatatttctctgttgttgccaggttaccttctgcttttaaattgccatcttgtaaagtgtatgtggttcttaagtgccagggagatcagccttgcccatgaaggttgcatatgtgtggtatacagtttttacctgaaagcctgagctttctcttattcctaaagtggtggcaaaagaatgaactgggtatgaccctgcccccttactgggcttggatattgaggaccagacgctgccaaatctaggacaagacagaccatcaaagcagacttttgtgggctcctctttggggtgaccactgctttcaaagccatctgccaaggctctccagggcaggacctgactggtggggaatgagtgttcagaagccttgggagaggccaaagagccattctagcatgatctgagaaaaccttcctgcagaggccagaaaccttgagcttaggtgcctggggaccagcttcgacattctctccagtttctgattctaatttttgccacgtgtcacaacttttccagtctctgagaaggtcccagcctttctcaaatattctgattttgaaaatatgtatccaaagtgggaggcccctgtgacattttgccaacttaaacgagaaaaagaccccccgcacccggcacactcc

SEQ ID NO: 6920 - DNA, 1312 bp, Homo sapiens
tttgtgcaaggatcttatttgtgatgccttccctcccctagaaagattttgtgcaatatattaaatggggacagaattctaaatggataaaacaatggctggttctagccctgagtgacagtcttaaggctagatccttcccatagtatcatctgtcctctggaatgactctcctgtccctaaaggggttaagagagagatcacctagaaatccctctggacacttgtgggttctttagggtttgagtttcttcttccccttgagcttcagagaggagagttggcatggttaaatctgaatggttacctcactgctgaaaacccagaggggcgtggcacactcgcttgtgtggaaaagcctctaaatgcatcccttcctttctttcctgcttcctttgccttacaattgaagcagcccgtggtaccatcacagtatgcagagacttcctcacctttcatatctagggaccacccccgatgcattggtgagggtgggcacttataaatgcctgctattgttaagccattccagcctcttcctctgaatagaccagacgccctttcacttagttcagtgccagtccttttgccttcccaaccctgctgttaggcctgctgttccctttgctcttgattaggagagatggaaggagatgagctcccataactgaattggcctttggttcatgttttctccccatatgtatatatgccatatgtgaatatgccatatatatgtgccaacaaatctatctacgttgttcttttcaaattagcacgcagataggaattttgagtttcttcttcttttagtaactagtataacaagcactggtatttttgtacaaaaaagaaaaacaaaagattgactattgtggtctgcatgacataaacaaacaaatggtgatatcaaagcaacgtataccccagtccagtgtgtgttgccataatttgcaattcagcttaacagtgcacccaatctatatttgcattttgatattatttaagctctatgtacaaggttttgcatgtatttatatggttcttagggaaaaaaaatgctataaactgcaaatctgaaattcaaatgtgttgttccactgagaccagaagaagaagaggagttttaaaagggataatttgttggagccaataaagctttttgctgatgaacagaaaccaatactgctgtgcactgagaataaaaactcatgcccacttgtaactgtgctgtcctcaatgcgtctccacttttgggtaatgccactgattgtctgttgaagttgagaagggaaatgccgcaaccacaagg

SEQ ID NO: 6921 - DNA, 2003 bp, Homo sapiens
gtgcagcattgaaaggccttaggctttcttcctggtagattgaactagtaattggttttaagtaaaacttcccccaccatgggaaattttattgctctgaaatcaacgaaatgagaaaaaagtacactggctggcattcctcctgcccctgtttttctgtttccttaaaaaccctgatgcttaattacaacttggcaaaaagaaaacccgtgaaattgttttatatttggaaatttctaattgcctcctcatactggtcagctttataatttcaaattgttgagtgtgatagtgttaccctttagaattggatcttatataaaagggaaatattagaaaacaattaggaaaatatacttttagtctttgaaatgcctgttttaacctttataaaatattataaaaatagattgtgtaggtactttcaaataatttatgggtaaaaacagactaaaatgtttgcaagaattggaaaaggttgaatgggaattgtaatgagagccctttgaacatgcttggaaaaacccagtagacatttcccaaagattgtttctgtaattttaggtaatctttttaaaaacatacttaatgacccattatactgtattaactgtgcggttgttttggccactgaattcttaatgaaaactaagcagtcggtatttttatgtgttaggaatcattggtgaaatgagtgaattgatctcattttaagatccctttctactctgaaagtatgtttctgagattgagtaggaggccagaaaatgatgacttttagtaaaagtctattaaaagtttcagactgaataactaatgtgagatcccaatttttcctttttttcattttagatttggggatattccctgcccaaaaaattcctggaaaattgactagtattaagtgtgagtaaaaggtgtccacttttttttaagttttgattttagttttgtcttggatagtatttggcaagatttagcctagaaattatgtagtatttattacataagaatcaaaattgctttgttactgggctggtttcaaagtttagaactcatttctatgtatcaaaatcgggttttttttggttttgattttttttttttttaaattcttaaatggtaaatatgccattgtgaaatgaaatctcaactccaaaagtttacccttttactaactggagtaaatgtatacttacaaagtctttagctgtagccattagtagtaaagaatttggacctaggctgcgtaagcaagcctttccagggccactatttaatggcaaaccagtgatactggtgttgatacaaaataagaaataaattttcccttagataaagctttctgtgttttgacagtgccagtttagaatggctataatgctgctctgccttctacagcttgctgcaccactctgtagttactctattaccatacgtttctatcttttttggttaaacactccctgatgacgatgatggatatatatacatacatccatattatacataatgatatatgtgtaaggatttaccttcgtctttattttgtgggctgggcaaaatttagtgtaacaataacttcatgatactttggtataagagtaagttctttatttttataatgaacccaaatctaaagtcttttatagtgcattttaaaaggggaaacttatccaaatgttatatttctatacatttttgtgtatatgtgtgtgtgtataagccagttagtatatatctgtatgtatattatatacataaaacactatatttttacatacaagtatgcttttattatacagataataaagatgggggaaggtttctgtttttttcttaataggtgaagaaatcttgaagaccagaaattggatcttactgaaaaactgatgtttttttgttttttttttaaattatattgttcagctatggaagatggagttttttttcatgatcctttaactctcaagttcatctttaaatgaactctttttttttgt

SEQ ID NO: 6922 - DNA, 1257 bp, Homo sapiens
ggcttggtggtgggtacctgtagtcccagctacttgggaggctgaggcaggagaatcacttgaaccctgggaggcagaggttgcagtgagctgagattataccactgcactccagcctgggtaacagagtgagactctgtcttaaaaaaaaaaagaaaaagaaaaaaaggaaaagaaataaatgttacccttttgatccttttaattgcctgcttaaatgatagctctctgttggactgtcttgatccaagaatagagagatcataagtcagtaagagatgaacttcaagtataatgacatgtttttctcctgtgaaaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacaggtaacaagagaacttggtctctagtaccacgtccccacataatattccagaggagtgttccgtgggatcttcctaggagttgtttgacaacctttctttactcagataacgttgaaaacactgaattaaatgaagtttttcagtagtgctatgtagacctatgctattttgttttattttatttttgagacagagtctcactctgtcacccaggctgcagtgcagtggcatgaccttggctcactgtagcctccacctcctaggttcaagtgattctcctgcctcagcctcccaagtagctggggctacagacatgtgccaccacaccccgctaatttttgtatttttaatagagatggggtttcagcatgttggccaggctggtctcaaactcctcacctcaagtgtgatctgcttgcttcagtctccca

SEQ ID NO: 6923 - DNA, 2391 bp, Homo sapiens
ttgctcactttgtgtccgtgagactaggtgattcagccaactatttttaaaacggcagttttctaataatcttttttttcttacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcctttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcagcttacagattccaggtcccttttgtatatattctttattcttttgcttttttaaaaaataattttgtttcatatttaaagcacttgtattagtcaatgtttcgtgttccgcattatttgaaccatttgcccttacagaaagagaaatacttgtttgtgttttaaataaaactgatgtaggaaagtcttgatgttgtgagctaagtaatcttacatcatcatatcagcctgggatccatcttgacaagagaccccagacagaatgctattggcctttcgtgtaagtgcccgaatttcagttattatttggcttagaaacctttcatctggatatattgccaaatttacaagtgtgctcaattttagctgcatatgctttaggtaagaatttatattattataatgtgaggattttttttctgacacggatacttactccttagtgttgtaactcaagcaatgccattaagtttttaaaaggagggagggtttaaaagtgatcttaggg

SEQ ID NO: 6924 - DNA, 1184 bp, Homo sapiens
agtgcaatggtgccatcttggctcactgcaacctccgcctcccggattcaagcaattctcctgcctcagcctcccaagtagctgggattacaggcacgcgccaccaggctctgctaattttgtatttttagtagagatagggtggagtctttaatatactaacagctttaagaatggagttataatatgctgtatttcccaaacttgacatacgactcatttccaaacttttattacaaattcagcattgggaaatgttgtatgaggcctattgagttgacttagtccatagaaatgatatttgtcatgaaatgtcatctacctatgttagtctcttgaaaagataaatgtattctaatggagccagaaagcctttcactatatggacacttgaaaatgttcacatatttttataagaaagcattttcaaaatattgttcaaaaactggatacaaaattctgagagtaaaacatctgagtgtgtggctattaatagctttttgttgtttttgtgttgcaggtcggatcatgctaaaaggagataatattactctgctacaaagtgtctccaactagaaatgatcaatgaagtgagaaattgttgagaaggatacagtttgtttttagatgtcctttgtccaatgtgaacatttattcatattgttttgattaccctcgtgttactacaagatggcaataaatactatgggattgtttgtattaaaaaatttacattgcttcttactattcagcagtagaaactttttacacagtaacaccattcgttgctggtatttagttttctgaagggtcgcagttgccttgagcacttggtattcgcagagcttggacctgtagattttgaggcagattaggaattctgcctgatgggtaagcttccagtattgggaggtggagaaggggagggttcagaaaaataaataagagttattgcactaacaaaagtcttcatcacttgtagttctggatgctggaataccagagtttctaacctaaatatgttgggtacattatttaatggggtcagtattgctcaacactctcattgagtcactgtgaggtctttgtgaattttatcgctaagatcagaatgtgagaagtatttggatatagggaaagaatgaagtgcctttcaagtacattaaaaatcagttaagagttta

SEQ ID NO: 6925 - DNA, 3441 bp, Homo sapiens
gaggaacaggcgcggctgagccggcagcacctggagaagtatcctgactacaagtacaagccgcggcccaagcgcacctgcatcgtggagggcaagcggctgcgcgtgggagagtacaaggccctgatgaggacccggcgtcaggatgcccgccagagctacgtgatcccgtgagcaggcccccccgcaggcagccaggagactgtgtgtacatgtgtagctctcatgagtggctgggtgtcagtgtgtggcctgcctttgtgtgtgaccccaggggtgctgtgtgtatgcgtacgtgtgtgtgttatctgtgtatagctgagcctgcacgtgcgacccgactgtgtatggctatgtatgtgactgtggtgagcactcagtggctgaggatgtaggaatgtgactggaggactggccacgtggacctggagaaagtgcctgtagatcccacggccgataaactcaatagaaattcagaggtgctagaaatcaaagtattcatcacacagaaaggttcctgacttgactaaagcaagcaccctagtctattcctttaaacaggacatctcccagggcatttaaaatatacaatttctgcctggtatagtgacacacgcctgtaatgccaacactttgggaggctgaggcaggaggatcccttgagctcaggagtttgagaccagcctgggcaacatagtgaaacctcatctttaaataaaattagccaggtgtggtggttcacacctgtagtcccagctactcaggaggctgaggcaggctcaggaggatcacttgagcctgggaggctgacgctgcagtcagctgtgattgtaccactgttctccagcatgggtgacagagcatgaccctgtctctaaatataagtaaacaaaacataaaatatacaagttctaaaaactggattcacacatgatcctccaagaatattatctgttgaacacatctatggccctaggtctgcaggtcatctgcagggtcgtaggtgccagtgaatttggccatcagaaagcaggctgggggcagggtatataagtcacagccaagagtgtgtggagtgggagtgcatgctctgaggaggcctggaggggagatgggtttggggttgaatcaagtgtgcatccatcaccgttccccttctctgccccacagcccgcaggctggccaggtgcagatgagctcctcagatgtcctgtaccctcgggcagcaggcatgccgctggcacagccactggtggagcactatgtccctcgtagcctggaccccaacatgcctgtgatcgtcaacacctgcagcctcagagaggagggtgagggcacagatgacaggcactcggtggctgatggcgagatgtaccggtacagcgaggacgaggactcggagggcgaagagaagagcgatggggagttggtggtgctcacagactgatcccggctgggtgggcctggccccttctcctctggggaagaccttgtcccaactcgatgggcacagccagccaacctaagactatgttggtacttggacttgttcgtgccccagagatgggcaaagctgtgcacttgcagatacattcatgaggggagaggcgccctcccttcctgaggagctgttggcctgggtgggcaggaactgcagtatggccatgggctgagcaggctgagcacctcagcctttagggcttatggccaggggacactgtatgactctcctctcctgcaggtgtctatccacctggggtatggcatctaccgacctgtctccctggggtcacatgctttgtttccattcttgtcctggctggaccagccactgtgggaccaacacccctcccacactcccccagactgctcgtctatcaccaggatcgctttgtactttgtgcaaaagggtctggctgtcccttgctgttttcatctctgccaagcctattgtgcctctggctgctgtatgtgtgcgcgtgcacgtgtgtgtgtttcatctgttcattcactgcacaagatatttattgagtgcccactacgtgccaggcactgttgctgagttcctgtgggtgtgtctctcgatgccactcctgcttctctgggggcctctttctgtgcttctctttgtccccaaattgctacctctttgtcagtctgggtgtctcaggttctgtgtgtccttgtgtgcatttctgtctctctctgtcctcgtctctctgcaaggccctctatttctctctttcttggtgtctgtcctttgccccctgtgccctctggattctctgggtctatgtaggcccctggtctgccctgggctcatcagccttcctgacctcctcctgccctccccttcactccctccctggctctgccagtcggttcccacggagccatttttagctctgatcagcatgggaatgtgcctcggcctccaaggggctttgtcctggtgcccccgcccctggtcccaacctgatcccacgagggagttgggacaggaggattgatggtgctccccttcctgccagcgtcagaggccctggagaggggctgtccatggcagctggtctttattcctccctcatgagcacagggtcgggggggtccccattcttggaagaggttgagaagactcctgggcttcagcctctcccacccagccctgcccctcacctgcctgccctcccctcccccactctatactagggactggatctcagcctctgatcagtttcacaaagtttgttccctaaggaaatcaaatcccattgtcacctaactctgaagatctaaatagcccttggatcagtatgggaaccccaaatcccacagggccagatgtggagtctgtgtctgcccccgtcttctctccatcctcaaagcccccacttctctccaggctgtttctttttttatgactgtaaacatagatagtgctttattttgttaataataagataatgatgagtaacttaaccagcacatttctcctgtttacactcgggggatttttttgttttctgatgacataataaagacagatcatttcagaatctggcccttgtgcaggggaggagggaggctggcctaagtccagaattcccaaatatgccaccagcctgggcaccactgtcccctggtggcagcctgcaggagcttcaggcctggggcctcagaggaattggcttaatgcaagggaatcccaggccaagcttgtgagtgacacatgccctccacagagcccacgctgaatgcccctaccttgacgaggtgaggccacccggatcctaagaaagaaggcagtagtaagagcactgtaataggagtcatgaagctcggggtctctctagaactggccacatggctggggttggggagtgggagccaggtctctcctttggggcctcattgtcctcatctgacaacaagattaaacct

SEQ ID NO: 6926 - DNA, 2285 bp, Homo sapiens
aaaaaggagatggagccggggacaggcggatcgcggaaacggcttggccctcgggcgggcttccggttctggccaccctttttccctcggcgatcgcaagcaggctcttctaagttcccgacgcctcttggcccggaaaactccgggaaccccacactgctttcctctgcccagcccgagactcgggtcagttactggacgaaactgctctcccagctccttgcgccgctccccggattgcttcagaaggtgctaatttggagccaacttttcggtggaatgtttccgaccagatggctagattttgctggagtctacagcgccctgagagccctgaagggacgggagaaaccagccgcccccacagcgcagaaatctttgagttcgctgcagctcgactcctcagacccctcggtcaccagtccccttgattggctagaggaggggatccactggcaatactcgcccccagacctaaaattggagcttaaggccaagggaagtgctttggaccctgcagcacaggcttttctcttagagcagcagctgtggggagtggagctgttgcccagtagccttcaatcccgtctgtactctaaccgggaacttggctcttcgccctctgggcctctaaacattcaacgcatagacaatttcagtgtggtatcctatttgctgaacccttcctacctggactgctttcctaggctagaagtcagctatcagaacagtgatggaaatagcgaggtagtcggcttccagacactaaccccagagagcagctgcctgagagaggaccattgtcatccccagccgctgagtgcagaactcattccggcctcgtggcagggatgtccacctctttctacggaaggcctaccagaaattcaccatcttcgcatgaaacggctggaattccttcaacaggctaacaaggggcaagatttacccacccctgaccaggataatggctaccacagcctggaggaggaacacagccttctccggatggatccaaaacactgcagagataacccaacacagtttgttcctgctgctggagacattcctggaaacacccaggaatccactgaagaaaaaatagaattattaactacagaggttccacttgctttggaagaagagagcccttctgagggctgtccatctagtgagatacctatggaaaaggagcctggagagggccgaataagtgtagttgattactcatacctagaaggtgaccttcccatttctgccagaccagcttgtagtaacaaactgatagattatattttgggaggtgcatccagtgacctggaaacaagttctgatccagaaggtgaggattgggatgaggaagctgaggatgatggttttgatagtgatagctcactgtcagactcagaccttgaacaagaccctgaagggcttcacctttggaactctttctgcagtgtagatccttataatccccagaactttacagcaacaattcagactgctgccagaattgttcctgaagagccttctgattcagagaaggatttgtctggcaagtctgatctagagaattcctcccagtctggaagccttcctgagacccctgagcatagttctggggaggaagatgactgggaatctagtgcagatgaagcagagagtctcaaactgtggaactcattctgtaattctgatgacccctacaaccctttaaattttaaggctccttttcaaacatcaggggaaaatgagaaaggctgtcgtgactcaaagaccccatctgagtccattgtggccatttctgagtgtcacaccttactttcttgtaaggtgcagctgttggggagccaagaaagtgaatgtccagactcggtacagcgtgacgttctttctggaggaagacacacacatgtcaaaagaaaaaaggtttgtttcttgtcttttaacatgcctgatatgttctgactgtttttatatgcttaaatatagcagcatgactttggaggcttaggagtgcatgtatttttgaggaaggcctctaaattcatatacttggattgagaaatatgtaaatgacccttctcctcctgtccctcaccccccaccccaatgcacattgttgctgtccaaaacgaacataccagtgtgtagatgttagcaggaaagtgccatttttatttgggttggtagttctggactgtttccttacaagcttcaatttttcacactttttaacggactattaaactttgtgtgtacacgatttaatttttctagagatt

SEQ ID NO: 6927 - DNA, 1158 bp, Homo sapiens
gcgattctcctacctcagcctcccgagtagctgggattacaggcatgtgccaccacgccaagctaatttttgtatttttagtagagacggggtttcaccatgttggccaggatggtctcgatctcttgacctcgtgatctgcctgccttggcctcccaaagtgctgggattacaggcgtgagccaccatgccccgccccagatggattttacatttgctcttttgtgtttcgctccaaagggttgtcttcctcgccaaaaggagggagggactttgaatttgatatgaatctttaaaaccagaattggctggatatttcccatgattgggaaaagagtgaaatgaggacattctgtaaactgtccctccctaattccaaggatcagaaactccccgttttgctgactcattccataactggagaaagaagctccattgaccgaagccacagggcagcatggaagtttaaattttctctaaaattaaaatgccaaggataaagctggctgcttccaggagggggaagaggagtggggagtgggcggtgaaacttttccagatgaacggaccataaatgtgttactggctttgtgcctgtagctcattttattatgacctatatgctcctgatttaaagagatctgtgtactgtttacttcccacttcccagaatcccttgtatctcctttctcgggaattgtattttctaataaatgacatttgagaaaaaaatgaaactataattttatttatttttttgacacagggtctctctcagtcgcccaggcttggagtgcagtggtgagatctaggctcactgcaacctccacctcccggactccatccatcctcccacctcagccttcccagtagctgggaccacaggtgcacaccaccatgtctggctaatttttttttattctttgtagagacagggttttgctatgtttcccaggctggtcttgaactcctgggctcaagtgatctacccgcctcagcctcccataatttttaaaagtaatttttagtagagccaaggtcttgctacattgcgcaggctggtcttgaattcctgagtccaagcaaccctctcaccttgtcctcccaaagtgttgggattacaggtgtgagccactgcacccagctgaaactatcatt

SEQ ID NO: 6928 - DNA, 1270 bp, Homo sapiens
gaggcctctcagcagcacagaccctggtgttgggggaccactgccctctggtggttctattgagcgtggtgccctcagggcatccgcaggaggggtagcagattcggtgcccttggcccatgcattctccatccaagatgtccctgagttgggatcaaagataggatttgggctctggttcccaaactttgattcatattggaatcacctggtgatctgtggcatagactgatgcctggcttccccagccatttggacttaactggtatcaggtgtgacccaggcatggcgagggggttcactcagcccctcaagtgggtgtcatatgcagcaaagcttgggaaccgctgaattgcagtgtgtgcagcactcccttgagggtaagggctgcaccccctggctgatgctgttctctctcactgccccctaccctcccaccaccttctcctttccgtgtgcccaccaggctcactgatgctgacaagaagcgcctgtgggagaagcgatattactgccactcggaggtgagctcgctccccctggtgctcgccagcgcccccagctgggagtgggcttgcctgcctgacatctatgttctcctgaagcagtggacccacatgaaccaccaggatgccctggggctcctgcatgccacgtgagttgtaacatctgccttttctgactatgtgttcttgtagaagccagggcacgacactgcccatcagtgatctgagccagccctggggaaaatggtaaagtgggtgtggatattcagggattttccatttctcctttttgctttttctttctcattttcccttcaatgttatattgtcatttttcaaacatacaacaaaattgaaaattgtacagtgaatacccatgtgcctaccacctagattctattgttagcatttgctctgtgtgctggattgtgtacatttcatttatccatcactgtatccatccatctatccatcttattttttatgcttttttttttttttttgagacagggtcttgctctgtcacccaggctggagtgcagtggcatgcatatggctcactgcagcctcgacctcctgggctcaagcactcctcctgccccagcctccaagtagctggaacaacaagtgcacagtgcacaccaccacacctgactaatttttaaaatttttttgtagagataaagtctcactatgttgcccaggctggtttcaaactcctgggttcaagcaatgctccctccttggcctcccaaaaatgctgg

SEQ ID NO: 6929 - DNA, 1261 bp, Homo sapiens
ctactaaaacatacgaattattgagaattgacccagaatatgtggtaccagtgagattgcctggacaaccttgtgatcacctattatggtttgtattgccttgctttgatcttaagggttagaccactatgttaccatcatttgcaatgctgttaatcaaactattatcaggcactatgtactagagcaagtaattctatagtttatacatggtaggagtgtttaaaataccagtaaatgcccatttagaaattcttttagcacaaggtcattgttcagatgcttttagagtcttttttttttcctgtcttctcatagaagacaatgcttttagagtttaaacttgataaacgatgatctgtttgtagtgtcattacttgctaatgaagtctaaacaagggaggagatttgagctctgccactaagacagatacttgatttctggttctttctttcttagaacaggaatttctttttacctattttataaagaagttttaagtattctaaagatagtcttagttattacgtattgtgcatagttatcattcttttcatttgacttctatagatgaagacttaattgaaaatttagcccaagatgaaacatctaggctggaccttggatttgaggagtgggatgtagctggcctgccttggtggtttttaggaaacttgagaagcaactatacacctagaagtaatggctcaactgatttacagacaaatcaggtaaatttcacatttgaagggaagtggttttttttcttttgaaagggtaacattcttggttactcttgaccacacattatattctctaagaattcttatttactcctatggcgttaaataccatctgtatgcatgtgatacccaaatctgtatctctagtccttacctcttccctaaatgcccaacttcagtttccagatgcctatttaactaacaactctacttagaggatttgacattgaacaatttcaaaatggagcctttggctgtgcgtagtggctcatgcctgtaatctctgggagtcccagcctataacactgggaggccgagacaggaggattgcttgagcccaggagtttgagaccagcctaggcaacatagacaccatttttacaaaaaattaaaaattagccaggcgtggtggcgtgcgcctgttttactatagtaataactgattcagccccctccttcctcacttcctgtcattcttctttgttcactacatgcgttttggatatactaggctcct

SEQ ID NO: 6930 - DNA, 1281 bp, Homo sapiens
gtatttaatagtgtgcaaaataataaattgtctctcatgaatgttgtagaaaagcatgtcatgaaatattcatagatgaatgcagaaggttagttctatatggagttcagaaagtgtcaggacaaaaggtttgggtgaccatcagtatttctcatatttctttaataaacatccttgaccattttaagggaaagaatatgtcagaactaatggaatgttttgtagcttcttagagtgtcacctgtagaagggaatttagggaatagattctatttacttgagcaactacaagtccttaccttttaaactcttcagtactgtttcttaggtgttatacctgatttagtgttaaaagagaaaagtccatgcctgacaccattatatccatccattagtttatccacagtaggtgtcaagtagatatatgttgaatgaatacatgtccactgaataaaggcaagatgttctttggcgatgtagtgtgacgacattgagttttgggttcatttgtgttgtttcaacatctctgataaacctctgaatacagaaactcatgtttgttttttttctgttaggatgtgggtactgccattgtttcagatactacagatgacttgtggtttttgaatgagtcagtatcagagcagttaggtgttggaataaaagttgaagctgctgatactgaacaaacaagtgaagaagtagggaaagtaagtgacaaaaaggtatgttgtggaaaaattccatgttgattctgtttgtgtgctcatagtatcatctgttgagatttctttgtatctgtttttacaacagattgctcacataatcccctttttaactttaattaatttttcaatccaattttaagattcacattaagtaatgttaaccagggctgccttaaaagcccctacttagtcaaaagcagtaagctactcttttttcccctgattatagcaacaagctaccttttctctccctttgctaacaaggtaaggtgctaatcaagcttgtccaacccacagcctgtggaccacatgcggcccagaacaactttgaatcaacacaaattcataaacttttaaaaaacattatgagttttcttgcgattttttttctccttttagctcatcagttatcattagtgttagtgtattttatgtgtggcccaagacaattcttccagtgtgacccagggaagccaaaaggttggacacccctgttgtaaatgaacagcagtctgtaggagaaaacttatttcttggaaatcttgatagcttc

SEQ ID NO: 6931 - DNA, 1099 bp, Homo sapiens
caagccggaactcttgggctcaagcgattctcttgtctcagcccccaagtaactgggactacaggcgtgcaccaccacacctggctaattttttttattttttgcagagacagggtcttgctctgttgcctaggccagtttcaaactcctgggctcaaggtatcctcctgccttggcctcccaaagtgctgaaattataggcacctggctgtaaaatagccaccatgcccagctattttctttaaagtcataaatatgggcatcttctctcttctgaatgcaaaatttatttggtaactcttctgggtgcttttctgtcgtttgtgctactactgaaatgccaactagaagtacagaatcatgtgtttggtcttgcatttaagctgtctccttaagtgctagagatgggagaagaatgtgagttttaaattgaagcagttgtcttttttgctttcagttaattagcctcatctaaaacaagtaaacattactaatgagatgtttttgccttcacaggtgattgaagtgggaaaaaatgatgacctggaggactctaagtccttaagtgatgataccgatgtagaggttacctctgaggtatgaatctttagcaagaactattttgcaccagccccatcttcagatgatgtaatcccagcagttcacttgtgttgaagagtgctgtttacccctcatttctgtctcccttgcctagttgctaagtgatgttggtttctttacatttttttaagagatttttattggaacttaagaagggaaggggataatttgatcttatcctctccctaccttgaaaaggatgagataaatgcctctgtgtgcctttctccctgccatcaaatctctctggagacacaaagttattcaaaatagtcttgcactgctttccctgactcaacacctctctgcaatcccaaagacagacccataggctatctaaaattatttgttgaatataaaaataatattgtcattgttttcttaaaaagaagcaaatggaaaacagcttaatttccacacagattagtattaatggaggactattaaagaagacttgatattccactcttaggttaat

SEQ ID NO: 6932 - DNA, 2272 bp, Homo sapiens
tgagccacagcgcccagcttaaactattttcttggtctgtttttgattttcttttttccttgccactgcggtacagattttttttactcactgccactaaactaaagcaaggcatagtttatatgtgaagtgttcagagtttactgctataaggaaacttccaaatactgacatttaccttttagctgtagttattgggaccatgtgctctggttttctggagactgccaaattgctcccatttttctgcatcccacctggtttctttctgcatgtcccctttcactttcaaacctcttcatttggatgttaaattatatggtcacctagttataggtaagccttgttcgagttgatatcttgattgtgaggaaggatctgtgtcattggagcttgtttctgctgcaacgtgctgtagactatgaataatgaaatcacaccacattaccatcagatttcttgttttagttgtcaaattaatatttatgattgttatcttgggcgaaaagttcagagcagagatgacaaatcattagaacaacgatgaatttcagtattacggctaaaaagttcttctgtctgaatattaactcactctccttccagtgtacttcacagtaattggtatgcttttttatttaatgcttaaatcaaactttataaaaatcttagaccagatctttaatatggtatgccatttccccagtctaccaatggaatagtatgggtttctaatcctaggcttgtacaatggattggagttgagccatgccagcctccacactgccactaacttctgtaatgtaagattgagtcactgccaagcatttgaaatatgcagttgtgttttaattataatttatgtatagttagatgtatgtagtgcattgtgtggtattatttggtttgtaagaatttatttttaagggtcaaggtcatttgtaacattttgtgtgtgtcaattcaatgcaatgttggctgccttttgaagtctttgatatattggtgaatattcttctgatctataatacaaagctatgtaatgttacctcttgactcgcttttgaaaggaagacaattgttaactagatatttgagttttttcccctcagaattatgtgaatttctgatatatggctttagatactgtgaatctgttttccatttagtcagttatctgcttaaattgttcagaactatatcctaacgagcaattagttctgatggttctcccagtcatgagtgtgcatgtgtgcaagcatgttttgatcctgatgctacctttgctaaaaatggccatagattaggaactagctatgtttttagaatcaaagatgaaccggtaagctgtctcatgtaccaaacgtgaaatttacagtgtttacaaatgtctggaattttgcactgccatagggaatgttaaggttacttggctggaatttatcagacttgtgagtaaacaagttgaagtttagcagatgagggggaatattgaggcccctaaggctaaacaaaataatcagtatctgagatagtggctaatgtggctccccaggcctaatttgggaacagtttttcctgattgctttgagaagtactttcttttgacagaaattttcattctgcttgccattgctatattctccctttataggagccattggatttctttccttttgtgggaaatgtcccattagcattttcagatcttttgatgtgcactaatgccattattggtaatgccgttattggtgaatacagcatagttaaataaactgttacagtaaatctacacttggatttgctgcacctctaccaatagccttttgaatgactgaaagtgttaacagagaaagaggcatgtctgcagaaagagatagctaatattttttggtactttatctgaaatccaagatgctgcttcccctgcaggttgttttccttcttacgatcctcattgaatcccctctgggagcacaggacagttagtagaactctccatttctttttttttttttttagacggagtctctctctgtcgccccggctggagtgcagtggcgcgatctcggctcactgcaacctccgcctcccgggttcaccccattctcctgcctcagcctccctagtagctgggactataggcgcccgccaccacgcctggctaatttttgtatttttattggagacggggtttcaccgtcttagccaggatggtcttgatctcctgacctcgtgatctgcccacctcagcctcccaaagtactgggat

SEQ ID NO: 6933 - DNA, 1320 bp, Homo sapiens
accaaaaatacaaaaaaaaagctgggcatggtgggtgcatgcttgtcccagctactgaggaggctgaggtgggaggatcgcttgagcctgggaggtggaggttgcagtgagctgagatggcaccactgcaatccaaggtgggtgacagagacgctgtctcaaagaaattgaggtcaggcttccttcttacagaattatttttttctctgtagtttgcctcattttttcactttcttttcaatgagaatcgaagtgtttcttttgggtttttttttcccccttttaaaatcaacaggaaatgtttcaaaggagggatgaaatgcttcttggcttcctcagcacttggcaaggtagacctcatagcaaccttgaatatgactttctttagtctctagctatgcactattaagtgcctcttgggtagaggtagagttaagtattgagtgccagtcttgacgtccgtatgcctcagtttttctcatatataaaaagcagtatacatacctacccttttctacctcatcatttgttgtagggattaaatccgggagagcaattctgaagcctataaatttccttgaagagatctaagaacctattatgctcttggtgtaccaagctctggggtatatattcagaatacctcatgttctggaagctgagcactagctcccctttattgcctgcctggcagagcctgtttgattactgcaggcccttttacccatgcttctagtttaggtattctttctttgatatgaggctcttgaccagaaaagagttctttctctaggtgttctgagagaagtttgtaaatttggatagtacattctatcctgataaaaccaccttgctgtggtcttgatgtacaaaaaaaaattttttttttgagacagagtcttactctgtcacccaggctggaatgcagtggcgcaatcttggttcactgcaacccccgcctcctgggttcaagcgatcctcctgcctcaacctctcaagtagctgggactacaggcgtgcaccaccacacctggctaattttgtatttttagtagagacagggtttcaccatgttggccaggctggtcttgaactcctgacctcaggcgatctgcccgccttggcctcccaaagtactgggattacaggcgtgagcaactgctcctggcccaaaacatctctttctacatacacttgagtaggtggcataaaatgcactgtcaatatatagaaaacatgaaattttccaaatatttccgatcagagaatcacaagagcagcaaatgtggtttcatcaagtgggaagaaagcagcaattta

SEQ ID NO: 6934 - DNA, 1241 bp, Homo sapiens
gctgcaatctgttgtgcgtttgtgggaagcagcctgatgtgctgaagagagcaccttcttgaaagttggatccatctgggttagaatcctgtggcttctgcttcccagctctatgaccctggacgtgtctcagtctctcattgagcctcatttcacttatctataaaatgggtttaacacacccagttcacagggttgtgaaaatgaaaccagctcatgcttgtaaaatgcttggcacacagtaggtaccaataaatattaaagaacttaaaaagtcatcttttaattatctacccaaataaacaggaataatgtgatggataatttaaagaattctgatagacttggtagggtattgttttttaaatatttgagaatagtcttcatttagttcagtaaatgtttattgaacatctactgtgcacaaagtacagggccaagtgggtctttcctggtgttttatgattagggtgaatttaagttgctggtgcattctctaagcatatatcatctgacagagggagagggagggcccttcggaaggctagtagcagagagggggtggccctcggtcaaccatgtatgtggatcttacgtggatctctgagaagtggctggccctaagagaaagatctgcattgtgaaggctctgtctggatggtgtgcagtgagatatgctgcccagcttctgagaaatggtgagtctgtttttagagctggatgaagcggatgattgatggaactagtgggtggtcgctccttcactttcacaagctgctactgaggcttgagggggccggtgaccacccaactatcagctggaagaggagcaaggtgcacctgctctcacctgggcatctgagcagatcacagctccctcaactagtgctgggagggagggaaggagagcaagagggagctaggaaacttggcttctatctctgccagcagatggacttctgcctgcagcaggagtctgtctgttcttctatcagcctccatgcagcctcctccaagacggcgcgacagagatgtgcaaacagaacgtcagagatagctggggccctggagagcatctgtcccactgctttctcactgtcctcattcacattatagcacagaaacacagtgataatggctcagggaccccaattgacccaagggctaaagggtcatgatctcagcacacctgtacccatttgttgctccctagccccacttggggagccctatcttagccg

SEQ ID NO: 6935 - DNA, 1245 bp, Homo sapiens
ggaatcttttctctgcctggtctcagaatgggactgccaactggctcattggtgggagacacagtatcctcaaacctgtggccactggcatgacagtggtgctctgtctccctgggtgacacccaccctaggcttcctcctggatgtgatggggattgccagagaggctcttagcataaaaggcattaggtgggcatttttctgtgtgcccccaaaaagctccatggaaacaggcacctggtagctgcggaacacccgtggacttgtgtatatggtcataggctttgggaagacaggacgtaaaggaaaatgagagaaacaaaatgggtcagatagctttggccacagccccaggcagcctttggggcctatgacacttagtgcccttagatgggatacatcttgcctcggccccaagactcctccaacttacccgtcccatccagggcctgcacagcttagagaggctcacagcttggcaaatgctagggcttcatcagaccactgacttgactcagtgtttgttaaaatggaaccactcccgttggcctactgtttctctcctgtacttcttgtaatgatagttatttattgactctggtagcaggcagttcttaaataaagatggtttctcaacctgttggggaagctggcacgagctgtgggtgttatcatcaggctaaagcatacctccttgtcctgttcttcactccagaggcttttatccaagaatttctttaccccccacacagtgaaatataagtaagttacaacatacagtctatattgcttcatccagtcccaggaggagggaaaaattaggccaagatcttaaggcaggtccaagcagagcacaggcaggcatttggctagaatcagttggctttacctaatacagtggcagtaaacaatgcttatgtgatggtactgcttcaaggtggcctgatttttaagacatctttgaggtgttgactcagtggtcccaaaggaaagtctccctgcagatatattaatgatacccaactggtgagaacgaggctgctgcctctactcttggttcacagcagccacaagggtgtgaattactagtcactttccagccacactttctcacacattcgataaccatttatcaaacttttttttttttgagacagagtttcgctcttgtcgcccaggctggagtgcaatggcataatctcagctcgctgcaacctctacctcctgggttcaagcgattctcct

SEQ ID NO: 6936 - DNA, 1237 bp, Homo sapiens
agatttcaaattttcagaaagggaacaacgaaggccctctcttcctctcataccacgttttgctcaagaagctgggctgtaacaattcagggttttcccttgttttcctctcattgcatgtttccctccaatattggttcattgtcatcaatcatggtttttgaagatagctagttttatccatctccagcaaagaatcatcaatagtttatattgctttacctgtgctggcttccagagatggaaacaaacccaggtgtctctcaacaagctacttttttactggggtgggggaatctatgcaaggagtaaagtaaaaccatccagaatcaaagcagcaaccacatagttcaaatcaaagatcaaggtgaattttttgtatcactgcctgtggaaatctatcctcatcagtcattgcatttttccctgcctatacctgtgctcctttttcttactgtgttttcagtcacttcctttctgtgaaaggttgcttagctttttttttgacatttgttgttctttataaaaataacagattggatagatgtgtacatttggtgtttgaaattctctgaaaatcccattaggaaaccaggtgtgaaaagggctcagtagcttctctgagtggcgtttttagctgactggaagtgcttaatctggatcgtcttttttttttttttttttttttcaatattttaaaaggagaatttaaatactgtgcttactgtgaaatatatcagttggtgagccgggcgtggtgggtcacgcctgtaatcccagcactttgggaggccaaggcgggttgatcacccgaggtcaggagttcaagaccagcctggccaacgtggtgaaagcctgtatctattaaaagacaaaaattagctgggcgtggtagtacatgcctgtaatcccagctacactggaggctgagtcaggagaatcacttgaacgtgggaggcagaggttgcagtgagtggagatcgcaccactgccctccagcctaggtgacagaatgagactctatctcaaaaaaaaaaaaaaaatgatatcagttggtggatgctcctataggtagccaaacacattgattacctgttagattttaggatagaaatcaaagtagagcacgtcagcaagagcctctttgtctcactccatcatttaaaaccagtatattcagtagttgaagaaagagctctccctgagtcagttgcaaaacgtctatatttttagatgc

SEQ ID NO: 6937 - DNA, 1200 bp, Homo sapiens
ctgttttcttttgactctaactataatcataagtctgtgcttccattatgaaggtcacattcctagcattcttgggaagtattagctcatactctcattcacatatgggaggttagatttttttcctctacccagagtccctttttagtttaccccacggcttagtttgctgtcagataccagttctctagcagattccccaacagttttttccccagtggggagggtggaagggagggactgatataagtaaggagatgagtagttgtgttacagttcattttctttaaaaaaaagtattttgagaaaaggtgcaaaatattcttgaaagtctctaggccagccaaagtccacatatggatatttggggatgttatttaaatactcagcaggctgagtgcaggtatacgtgtgtatagagtgtgtatactttgcttttgttttataacattgtcagctaattttggctttgttctttggcatccattcttattataagtgatggaatgccatgaaatgtactgtattgtatattacttgggaggacactaggttttcaaagaagtctggcagcacttgggttatagagggctcagcatgaccaaagtcctaaagattttacctcccagctttggttgtatgtgttcccaagtggtgaggtgagattgtggctggaggaagaaaaaggatggcatgaaagaatgacccttattgtggtctgtccttctaatcaacataattagggcagcttaccccaacatgaaaatgatgacctggccatttttaatggccagagcttgaagtctggtctctcattttgtttcagaaatgagtgagaggccttcctgcagagcagtcaggagaaatggtggagcctggggccctggaatggctgaccctgtgcctagagagctgatggcaagggctgtctggcatggctcatttgggtggggtttccccaggcataccttagttccctgatcctctgcaaagagtagctcattgactgagcaagcgcttcaggaggactgtgctggttgttcccagaccaaagagagtcacttttgactccatcaacttcaaggggacagagcctaggcagcagattctcctaatttttaacactaaaattcaaggaagcagtggaggaaagaatgcattactaccacagatagaaataggggactcatagaactctcg

SEQ ID NO: 6938 - DNA, 1118 bp, Homo sapiens
ataaccacagtttatttgaattaaaccagttagattattttctattgggttagaatgacactagaattttatccctgggcttgattacagcttcctgaccctaaaggcaggttcacaatgaagaatgttacagggccagcatggtggcttatgcctgtaatcccagtactttgggaggccacggtgggtggatcacttgagcccaggagttcgggaccaccctgggcaatgtggcaaaaccccgtctctaataaaactgtaaaaattagctgtgcgtggtggcgtatgcctgtaatcccaactacttgggagcctgaggcagaataatcgcttgaacccaggaggcagaggttgcagtgagcagagatcatgccactgcactcctgcttgggtgacagaacaagactctgtctcaaaaaaaaaaaaaaagaatcttacagaggttgcccacgaagttcccattcctcctgccttatctctgtctctgtaccttataggtaaacctaaactgggacaggaactgggccggggccagtatggtgtggtatacctgtgtgacaactggggaggacacttcccttgtgccctcaaatcagttgtccctccagatgagaagcactggaatgatctggctttggaatttcactatatgaggtgggtcctggcctcattcatctctatgagaaagatccagagaagaatctagaaccctggtttagattttgtaccaagagctacagcatggcctctctatatttagttttctgtgtctaacagacatgtgctccctttcaggcctttactgtctttgcttgctctttccccaccatcctaatttctcagactcatcattccatttaactttcttctttagtccttaagccttatcagtttttagaatccaggattcttcatccttgttgaagaggccatgctctgtctgtactgagggctctgtctgcactgagggccattacctctggacctgtcctaagcatggtctggaaattattgtctcatacattgtggcatggcatgcaggattagagcccaagccttgtagcccagatctctctccttccctccaggtctctgccgaagcatgagcgattggtgga

SEQ ID NO: 6939 - DNA, 1232 bp, Homo sapiens
tggagatggtgaggatgaaggctggagagtgagggaggaggctctgctggccgcagagaacacagggatgggagggtccctagccttcgggcacctccagggccagagagcaggctcagagcagctagtgtggagctcagcatccccaccccacccctcctccctgtagagctgatttgaggcctccttctggggctgggctctgcaggccaggtgggtgtggcctgtgttttcccttctgttctttctgcctgtactggatctgttattttcagggaaacaggccccagggcccccctgagcctcaccctaagcccttaggcctctgagagtgctgttgggttctatttatttatttatttgttcctttgttccctacccgtgcccccagtgtcttccctgctgagtaccaggagaggtcctgccccatcctctctctgaagccagggcccttccattccatttagcctttggatcatcctggctgggagaagtgggaccgagccacccagccccactatccccaagcagccctacagccgggatgggaggcacgtggcctctcttttatccgtctatttattttgtaagtgtattcgtgtggaggaggttgttgctttatttttttaaggctctggagtgttgtgtatggtttcttttcacatcccagcctcccatgggcacttctaagaagagaggggatttcttggaaaaggagagaggaatcccctagagcagggaaagcagtgcctgccagctgttgtgcaccttcctgagaaataaatatcctctaaattttcaaaccatcctgtctggtgttggttgattaggttgtgtctgtgggaaccaccacgtctctccccacacccaagcattctgggtaacacaggctaggcctctcctgttgacctgaggccctcttcctccagaatccgacaaggaacaaggcatggcctaagcggtatgatagaagggatgatatccaccccatccaggcctcttagagtccaggcaaaggcaattaggagagagatttccatagctcggagcaggtgagccaccagcggcctgaatggcagcagccatacccaagtgaggccacgagagggcagcagagtccttacgctaacactttctcccggtgcagccccaaagaaggcagctgctggagttagcttggttttctcagagccgtcagccagagcacagagcacctgctctccaggtgctgg

SEQ ID NO: 6940 - DNA, 1259 bp, Homo sapiens
tgggccagcctgcctatcatgatggcgtgcgtgcctgtgtgtgcatgtgtgtgtgtgcatgcatgtgtgtgcgcgcacgcatgtgtgtgtgcatgtgtgtgtgtgtgctgaggcactgggagctggctctccttctggcaggctctaaatgagcagggccacagacccacagtccagccccatggggctctgcaggcctagaggtagagggcctgctagaaacagaaggctaaacaaaaggctggcctgctcaccctcaccggagtccctcttcctaggaaaactgccttatttggaagacaaaagctcatttgttgtctcatccccacccaggagagaagggtccactccccgaagattcctcttgtttccacatagagattcctcacctggtacatagcatatattgggcttttatttgatcatcactgctcactttaagagcaggctttcgatctgtgagcccgcggagtatacaccatgagcaaagctcaccctcccgagctgaaaaaatttatggacaagaagttatcattgaaattaaatggtggcagacatgtccaaggaatattgcggggatttgatccctttatgaaccttgtgatagatgaatgtgtggaaatggcgactagtggacaacagaacaatattggaatggtggtaatatgaggaaatagtatcatcatgttagaagccttggaatgagtataaataatggctggtcagcagagaaacccatgctctctctccataggtcctgttttactatgatgtaaaaattaggtcatgtacattttcatattagactttttgttaaataaacttctgtaatagtcaaaaaaaaaaaaaaaaaaaagaggaggctttcttggctgggcgtagtggctcatgcctgtaatcctatcactttgggaggctgaggcgggcggatcacctgaggtcgggagtttgagaccagcctgatcaacatggagaaaccccgtctctactaaaaatacaaaaattagccagggatggtggcgcatgcctgtaatcccagctacttgggaggctgaggcaggagaatcacttgaacctgggaggtggaggttgcggtgagctgagatggtgccattgcactccagcctgggcaacaagggcgaaactccgtctcaaaaaaaaaaaaaggaggttttctcatggcctgcctctccttccttgcctccctcctaactccaaattttgtctgactctgacatccagggggatccaaggctgtg

SEQ ID NO: 6941 - DNA, 1666 bp, Homo sapiens
ccaggtcagaccggctcctgtttgcatgcccttgcttgctctgtcagagcagctctgggggacagcgactgtccctgctgacctggggtacccgtcagcccagcctcctccctgcagccccacctcttctccattctccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagcctggaagaccgcttggcagcccttctggccacggctgtttcttctttgtgcttcccgtgtgcctccccagtagccctcacctgcataccaacccctcctttacccacgttggggctggcataagctgcttccctgagaggacatgaggggggggcggtcctcgtaccctctcccaccctggtgtttgggcacctgcgtgggatgcacacggatgacagaatcaaggcgccaggatgggcactctgccctggatacaggctctaccctcctcccccaggacctgcctagtgccagtttggtagtccccctttctggccccttggagcccacacacgtttcatctttttcccctctgagagcaagaagagacatggcatgttctctgggaccctggaatcctaggtacccacatgtgtgccaaagcctaccccacctggcaggtgtcccacagcaacagaaggaatagtagtccccactctttccatcagccctaccctaccctcattccccgacaccctctggcttgaaccatggctgagcagtgccggcatacgctttgctggcatgcttggatgcccagctgtgtccagaggtggcctgggaccgccagttgcacgcctgccacctcagccagcccccgcccagctcatcagtctgaatggagttgccttaaattggcaggtggtaccgtactcactgcccttggagctgtgaccggctcctgcctgtccaccccttcccgaggtggctcctgcttaccttatcatcccagggctctgattagccaggcctggtcagggtcctggggacggcacccagatatgcagagtcaccctgacactggtgccaggctgacctcagctcccgaaggctcgcacagcctccccatccttccttcccagcccttgtggctctgtccacctgatcccaataccagcttcccccagcccctgccaccccagagggcggccacgacagggagaggtgtagatgccaccatctgagggagaggaacgtggaacaggagcaggctctgatgctgagaggcttgcctccgggggctggaagcctgggtggccggggcccctgaagaaggctcccctctgtatcccccaggtctcctcaacactgggctgatcctgaatggcacaggccaaggggaggccagcctcgcctttctacccaggccccctgccctgcccacctcaggcccccaccctccactcctccccacggtactgtgaacgtcgtgtgactcagtgcagagacagataatatatttaattcatgtacagaaaggagcgagcagtctcgtacagaaaagctgactttgatagattgatgccaaagatggagaactgaagtcccccctccag

SEQ ID NO: 6942 - DNA, 1118 bp, Homo sapiens
gccatccacacttacttattgtgaaatatgaaaatccagagtggtttgtatgagaggggaaatactggctctaagctttctacagaaaacaggaaattcatgctgttgttgacataattttaaaggaaacttttaacaagaaaattcatgagggatacaatcaaacatagttaatctcttgagtgctaatcatttgagtatagtccacatcaggaagttttatgaggttgaaaactttactttgaaatatttaattgggagactagaccatttctttttccaagtcattctgatttattgtcctagtaaatgtatgtgtatgcatatatactgatgtattgactgaatgtgtgtgtgtgtgtgtgtgcgcgtgtaaatctgttttcatagggaacatacattgatggctcctagtctattttatactaaaacttaaaaaaatttgctgcactttgcagttgccactttttaaaagattaatgctttgcacatttcagtaggccttaaagatgaattgctcaccaacattttagaaatacactgcttacatgtgacatactctaaacaaagtcatagtaaactgttctcttaggttcatgtattattgagcaaataaggatgtcctttcttaaaatttctacatttatgtttgcttttgtgtaaaatctttattagtttgtaagtttctcaaagaggaggtttatactggaagcagtatttctaaagtacagagattcgaccatggattgaatacagtagtggaggaatgctggtattgtggcctaatttatccttttaaactgtatgtcattagtattagccaaaacctcagagtggagtgtcttgggctgaatgatcttctcaactttgccttgtttcccatctcataaaggctccttctggttcttttcccttccaaggattgtgagtcatgctcacataggcctgggatcttctggatggggtcggggaggaggtgggggtttcctgtggctggcccagagttctagccaatggaatcattcaagaatgcctaaagttcaggggtgggaatgccatatattggtgttaatcacttggcactttcttgggcaccaatattagcactgtttcatttt

SEQ ID NO: 6943 - DNA, 1366 bp, Homo sapiens
agaggcagagcttctctgcaccgggcaatgaggatttccagatgtcggagtggagggcaggcaggaaggaaggttaggagagcctgcgtggggtttgggccatcaggggccctgccttggcttttgttcctctgttctgtgcatctcttaccaccgtcttcattccccctgtgtcttttccttaccttggagctctgttctctctgatctgtgatattgagtttgtctgcctcttacctgttctaagaggctagaggagacctagacttctgggttcacatttgtccccgccctaccccgttacccttctcccactcctgaggaagggtcctggttagacttggaccaagtagggtctccatcttctctcctgctcctgattctcatgaagtcccattgcccctgggatggaggcaagggtctgttctcacagctggggtggtgccagtgctgggtacacacctgtcctcttccccttttcttcacccctctgccttaggtgttcctgcccaaataccgaggggacactggaggtgctagcagtgaggacagcctgatgaccagcttcctgccaggccctaagcctggagctcccttccctaatggacacgtgggtgctggaggcagtggcctgctcccacctccacccgcgctctgcggggcctctgcctgtgatgtctccgtacgtgtggtggtgggtgagcccaccgaggccagggtggttccgggccggggcatctgcctggacctcgccatcctggatagtgccttcctgctgtcccaggtggccccatccctgtttatgggctccattgtccagctcagccagtctgtcactgcctatatggtgtctgccgcaggcctgggtctggtcgccatttactttgctacacaggtagtatttgacaagagcgacttggccaaatactcagcgtagaaaacttccagcacattggggtggagggcctgcctcactgggtcccagctccccgctcctgttagccccatggggctgccgggctggccgccagtttctgttgctgccaaagtaatgtggctctctgctgccaccctgtgctgctgaggtgcgtagctgcacagctgggggctggggcgtccctctcctctctccccagtctctagggctgcctgactggaggccttccaagggggtttcagtctggacttatacagggaggccagaagggctccatgcactggaatgcggggactctgcaggtggattacccaggctcagggttaacagctagcctcctagttgagacacacctagagaagggtttttgggagctgaataaactcagtcacctggtttcccatctctaagccccttaacctgcagctt

SEQ ID NO: 6944 - DNA, 5977 bp, Homo sapiens
ttaaggatgttgtgcatattctatagcatggtgcttcttctttacaggtattactgctaacatcatagagtgttggtaaaaactgatgggaaatactgtagcatagtgtagtaacttatgaccagtttagaaactgagatagatttacctagggatatatgtgctcccttgtgcccaccttggtttttagtaagttgcatattgtctttatagattttattcttacagattgttgtattttgtagctgacttttattaaagacatttttttctcttcccttccccaaattatttttctattttcagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctctttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcagcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacatctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaagaaaaaacaaactcctgctttgcttttattgaagggtttccaggactgcgtgtctgctcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttgttttgtttaaaaatggctttataaaagggcttttataacccagatgtgtgctctgtgtacttcttgtaataccttaaagcaaacacactaacttacacagctttgttaatcagctcccagttcagcctgactttgtgggaacttatttccctaataaattatttagaaactttaacagtgaccatccctgttgttggtaaaagataaacatgtcttggttcaaaagttaatacctcaggatggaatcaagaagcagtagacttaccagtttgattaattaagggagcactggactgggtgcgtaaggattcttaattagcattttttctcatgtttacatccaaggttatgaagtgttgtggaaagcaaagtttaacaatcatatataataaaagataatgtttatactcacagaacacacttgca

SEQ ID NO: 6945 - DNA, 1628 bp, Homo sapiens
tgataagccagtggtaagggaaacacagctctaacctcacctcattctccaggttacaaaggccatgtgcccctttgaatctggcagagaaagtttcctcgttgtaagtatttgcatctacttcaagccagattcttctgcctctttctcctttccagacccctactctgtgcagtgctgaccacagctagagccaccgccccattgctcaaccagtatttatttccctaaacgacccttcctcacattcccttccctccacctctccttaccaagcacccaaaagaggatttagaactagcagggtggacatcatctggttgtttctacttttctctgcctagcacaaaattgggagaaaactggagcctccatccgcagtcacacgtgtacagatctggggatttggatgtaggctttttctaacttctctctcagaagcttctacagaaacccttccatctgtagcctcaagggcccacctccaagggaaggcttaggcaatgatcctgtttctaccaacactgcaccttatcccaggaacctgccctagacctccagagaccatattttctctccctccatttctacccagacctccaggcctccttctggaatcatagaaccgtagaattggaaggaattttagaggttttctagttggagttgtgtccaacagaattcattaacaccagcctgggcttgtttttcctcctccctctggacttttttcatcttttcctccacctcaaaaaatacttacacacagattcttcttgtacaggcatcaaaaccaactcctctgcccctaaggctgtgtccctgtggtctccagccacccctaccccagtcactcgccccttcctcatctctggaatttggccaggcagtcccagaagactctggagtgacctcctttgcctaaaaagcagacagataggcatgccccaggccctgagtgagcagaggaggactgtagggtgagagggaaagaaaatgaaggtgactttcatggaagtttcatttcttttccccgattgtaccaactgcatgtacttttggcctggctgcaaggagcaatattggtttactctcgtatccttaaaaagttacagaactgtgtcttaagagaattatttatagttactataactgaattgacaaatgtcaacttaactgataaattatatttggtaaaataaagaggacgtttatttagatggttggtgtttcctgtatgtctcatcaaaaagcagcttcaactgttgtcttgggcccctctgtaggccttaccctctcctcaattaggagtagaaaggggccaaagtgtgacaagaaatgaaacatctcggccggctgcggtgactcacgcctgtaatcccagcactttgggaggccgaggcgggcggatcacaagctcaagagatggagacaatcctggtcaacatgatgaaaccccgtctctactaaaaatacaaaaattagtcaggtgtggtggcgggtgcctgtagtcccagctactcaggaggctgaggcaggagaaccacttgagcccaggaggcagaggttgcagtgaaccaagattgcaccactgcactccagcctggcaacagaacgagactccatct

SEQ ID NO: 6946 - DNA, 1490 bp, Homo sapiens
agcagcatcttcctttctaaagagctcttattgtgcctgttgtctgctcaaagtggtaattgtggggtggagaaacacagagaggttgctggggtggaaagaggaagattaaaaagtaaggattatggccagccaagccctgtgatgcactgaatgggtctgatcatgtggcctctggctccccctggagagagaggatggctataggctgggcccttttgtctccccaggtgctgattctcctgtacatcgcagactggatggtgcactggatgtggggccggggcctggacccggacaacttctccatcccatacttgactgctctgggggacctgcttggcactgggctcctagcactcagcttccatgttctctggctcataggggaccgagacacggatgtcggggactagcttggtcactcaacattttccccatccctctgcactttctatttgaaatttttcttttgttcccctgtccctcctccaccccacactcccacctctttctaggacttcactttgataccaaattctcattattttcaatgggaatttttatacattgagccaagtttgtatagcaagaatttgggaaacacagatggcctgagataagcagtacaagtaggtttttgagacaatcaccaagtgcagtttcatggtgggtgcctccaggtgatgtggactggagcaggggagttttgtctggaatctggggacatggggtttggctttagcaacctgtcttggccctaatgagaaaccctttgtaagtgggctctggatttttggttttgttttctttttatctgttttgttttatttttggttttggttgaacagagggacagaagaataagtaacactcccaaacacagacatacttttgtagaagtggaccaacttcaaagctctggacaggagacacctgctccaggcccctgtgatcccagttctgttctcttgccctctggacctaagcgttcccactcgcagaaagagtaaggtggactgacttttcaatttgtgcacatgcctcttgttcaatggcctggtcaacatcaacaacccctccctctgatcatttccagttgattgtcatatccaggaaaaaatggaacagtgcactcttctccctgttgacccatgtccacctattggttccccaaaatccacattctccctgggcccaaatgactttgtctccctgggcccagattctttgtctctcttcaaccttcatctcaaattgtctctaagcactaccttccccagagcttgccaggttgggttttgagattagggtcaggtcatgggtatgtggagaatggtttggaggttgaggacaaccacaggtgtctcattgctgccatttctcctgaggacataatcacttggtcaccttggaccctgtcacttcctaaaattactcgttctgtcatgccatagaggtcagttttcctctttcttggcttctaccca

SEQ ID NO: 6947 - DNA, 2284 bp, Homo sapiens
ccccagtcgtcgtaattcagccagctgcagtccgtaccgttcttaggttagccagagacaggttttcattatcaggtcactgtgaaatctggtaaggcagtcctgaggacatgggctcaagtctcagtcccctcagaccacggtgatgccttgaccagatggttggctactgccatccagctttcagtggcatcttgttttgggaactgattatagagaatcatatatagtccagtcttcattttacatacacacacatattttacacacacacacattttacacacacacacacacacacacacatatgtttttctagtctctggcatgtgtagcctctcctggtcatagaccagtctctttgtaagttattgtggcagttcacacagtagccaccaggggtctctgtttccattacaaactttgttctgtctgggccagagaacctagcctttgaaatctctccatcatatgaaacataacgggatgggacaatcccgtaacctgtttggggttgggggctttctctctgtgttctttccattgatgtgaattggtcattggtgtttgctcttgcctctcctccatcccctagaagtacacccccgtcttattaaggagcttttaaagtttttctgaatgtatagacatttctcgggttcctacctttgtctctgatggaccattttccatttaagacattttcctgtataagacagttttatagctggttccttttagggtaaagagtcttaagagagttttattgtgtctatggcaggtttgggaaaggtaagaaatgggtcctttttcctcctaatgtttttggcacttaaaacataaaattcattatcctattaaaaaattaaattcagctttgctaatccagaaattgttcccaaatgaaaacttgttttaagtccaccccttagtttccttattttacaaggtctctcttcagggaccaacaggggcttagagagccttagttagattaaagggagaccctacctcttaaaaccagttttcatttatgcaaacaaggacaattaagggaaccctgaccccacaggctctcaagtcttcccaaggccagaatcgaaagaaaattaaaatttgaatgctgaatattctggctctactctggccttttttctggttcccttccaaaatgcacaaatcatacccttgtctgctccaattcagtctccaaacctggtgcctgtgctcctggcccccctagcatcatgctatcccaggagtatcaggaccagacacatccacagccaggctcatgggtctcagacagcaacttgagttaaagctgaaactcatccttcttctctgtgttttctggtttaaaagctgcacttatattttagccttattattttctgtagttccggagagatggtgggttgccattctggtaggaaaatctgagttttcttatctttgacctagaagagattctttttggaccaacctgcgaaattggtagttaggtctatggaaagtggtaggattttttttttttaatcctgtgcaaaggaaaagaggtgctttgtgggaaatcactaatgagaaggctaacctgcagcaccagagaaacctttccaagtgctaggcaggagaactgaagaactctttcagtgaagtgagtcagcctagaagaggcaacccacagtcttgatttttgttgctgtttcctgacctgttcttgcctgtcacctgggcctacacaggtcccgagccaacggggctttcatacccaaggatctgtttccttgctgaaaatgaaaccctatctttcactttacattcctttcaatccaactgatcaaaactggtacccacacttgccctttctccctctctccagcacactcccctctaagaaagtaaaagcaaagctttcttaatggcaacactttgggcctgttctgttgctcctgccttatttctctttcaaccctgtacatgactcgtgttcaccatccccttgatcagtgtccatccgcgctaatttgcatcatgaactgaacagtgtgtgagtggtcacctactaaacccagctctgggggcagagctgtcttccccatctctggtgctcctaacacctgtgagatggtcctgtcgagaggactaggaaccgataggaggagagtccttctcggcagagctcactgcaaacaactggaattgaggttgcacactgtgatttttacaccgaaaagccaaaaggagctggccatccagggcctagggagaccagccttcctca

SEQ ID NO: 6948 - DNA, 1164 bp, Homo sapiens
tggacaatccccagaagtttgcactttttaagcggatacacaaggacggacaaggtaggagaaagagtgaacccaaccagaccgttcccttcctacctgtgtccaagcccaccctctaaaactcctgccggccttgggtgggagctgtgggcttctcctgagcaccaggggtccagctgcccatgtggtgttcagatctgtggaatccgggcagggaggcaagagcagagtccctgactctgcatgtgacttcaggaaaaccacaccctaggctcccatttcctgatctgtgcaatgggaggaatctgccccaccattcctaatctttcaggagatgatgtgaatggaatcatgctttaaactctgagcagacacccaagataaaaggttattgccctgttcattactgtcatgttcatttcattaaaaggcccgtgtctacttccagttgtacgtaccccacctctgcatttccaatcctttcccgcaagcctgggccccgcccttcttttctgggaagagctcccagcaccctctcttggtttgcagtgctcttccagaaactctccattgctgaccgccccctctacctgcgcctgcttgctgggcctgacacggaggtcctcagctttgtgctaaaggagaatgaaactggagaggtagaggtaggtctggacccattgtgcaaacccaggccttagggcaccctgggtgggtgcaggtgggtgttgtcctaactacctcacataggtgggagccacgcagcacgggcaggaaggtgactgttgagagagtgagcaggggtgggtgatgggcctgggggtcagtgtttcagccaggactctgaacaccctggggtagcacattagggcctgtgtgtggcaaggcctgtggaaagaaaggatttcatgtgctttatttctgaaaactcagggaggagggggaccaagaaactccctgtgctcaggcacaggctgtttttgcttcaaaatggcccgagggctaccaagctccatctctgggctccactgggtatagacgtttttgagccatttgtcctcccttttcttgacctccatcccccaaggggagctaaccagtgtgtagtcttgtggcataaactggagtaaaaccaggccggtgacacccatggcctgagaatga

SEQ ID NO: 6949 - DNA, 1217 bp, Homo sapiens
gctgctggcttctcctgccaggaagtgaacaatggcggcggtgtgggagacaaggccaggagagcccgcgttcagtatgggttgagggtcacagacctccctcccatctgggtgcctgagttttgactccaatcagtgataccagaccacattgacagggaggatcaaattcctgacttacatttgcactggcttcttgtttaggctgaatcctaaaataaattagtcaaaaaattccaacaagtagccaggactgcagagacactccagtgcagagggagaaggacttgtaattttcaaagcagggctggttttccaacccagcctctgagaaaccatttctttgctatcctctgccttcccaagtccctcttgggtcggttcaagcccaagcttgttcgtgtagcttcagaagttccctctctgacccaggctgagtccatactgcccctgatcccagaaggaatgctgacccctcgtcgtatgaactgtgcatagtctccagagcttcaaaggcaacacaagctcgcaactctaagatttttttaaaccacaaaaaccctggttagccatctcatgctcagccttatcacttccctccctttagaaactctctccctgctgtatattaaagggagcaggtggagagtcattttccttcgtcctgcatgtctctaacattaatagaaggcatggctcctgctgcaaccgctgtgaatgctgctgagaacctccctctatggggatggctattttatttttgagaaggaaaaaaaaagtcatgtatatatacacataaaggcatatagctatatataaagagataagggtgtttatgaaatgagaaaattattggacaattcagactttactaaagcacagttagacccaaggcctatgctgaggtctaaacctctgaaaaaagtatagtatcgagtacccgttccctcccagaggtgggagtaactgctggtagtgccttctttggttgtgttgctcagtgtgtaagtgtttgtttccaggatattttctttttaaatgtctttcttatatgggttttaaaaaaaagtaataaaagcctgttgcaaaaatgactcatgttagaaacgtctcccttgaacttcaccatcttacggacactgggagcgggggagagagggtgagaatggacatgatcacatgcttcctggtggagtcagattttcttttgccagtga

SEQ ID NO: 6950 - DNA, 1251 bp, Homo sapiens
attaaaagtataagagaaaaaaatgactagtgattaattctggcaggagagacagctggaaactgaggtgggagggaataaggcacatgtggtaagaagaactgtatctgttcagacagggtcacaaatggagattgtgtttggaattttgtaaccagtgctttatagttgtctataggtctcatggcatagttatttaatcataaactggcatatttgcgaagcatgtatgagaaaggagtgggcccaagggctaggcatgaagtcaggaaggcagggctgtttcctgtgtcaggctaacttggattgttcactgggcctgttttcccacccataaaatgggaaggcataccccaggaatgagtgaaaatagatgacaatggatgaaaaagagtttaggatgtttcagaagagtgtgtgtgagactaggacatcataaaccaggcaatctttctttggcccttgtgattttatagtgagcacttttgagttcgttcttgatatttattaaaagtctgtccaggcagcattcacagtgctggtgtgctttccacaggagaaagcttcgagctgatgtgacaactgctttccccacccttggaactgatcaagtctctgagttagtacctggaaaggaggagctcaacattgtgaagttgtatgctcacaaaggggatgcagtgactgtgtacgtgagtggtggtaaccccatcctctttgaactggagaaaaatctgtatccaacaggtatgacaacaggacgaagatggccattaccattaggtagttcttgcctaacatctgcttctctctgtttcttccattgtctcccataaaataagcaagcacgaaatctcccaataccatccccaaggatctttatggacctggtgttcctagaattgggtctttcaattctaggatgcaaaaggttttctcttatgcaaaaccactataggagggattaaaaaaagggctgacatagtaagtaagggtggttgcaaagggaagttctgagatgaaggaacagtggctgagaagtttacagtgggttgactaggaatagagcagaggtcttgaaaaggatggaatttcagggcatgtcttcatgagacagagtcttgctctgttgcccaggctggagtgcagtggcgcaatctcagctcactgcaagctccgcctcctgggttcacaccattctcttgcctcagcctcccgagtagcaggaactacaggcacccgccaccacac

SEQ ID NO: 6951 - DNA, 1166 bp, Homo sapiens
tggaatagccaataagcttaaagctaacttaatgtcagaaaccaatggtagtatacccctatgcagtgtattgccaaaactgattagctagtggacagagatatgcccagagatgcatatgtgtatatttttatgatcttacaaacctgcaaatggaaaaaatgcaagcccattggtggatgtttttgttagagtagactttttttaaacaagacaaaacatttttatatgattataaaagaattcttcaagggctaattacctaaccagcttgtattggccatctggaatatgcattaaatgactttttataggtcaatgcatctttgttattatcgtcagatgtatttcaactgatgtattatactattggtttaaatctctttctctcaagatagaaggtgtagcaaaagtatcccaactactcctcgcttctagtgtccctcggcatctgttctggaggggtaatttgggatgtggtgttagttgtggctgagagccagtgctaggtcccttgccccactaggccattctctaggctcattctaggtgaaagagctcacagcagactgtggggtgggggagcaccaggaagctgttggtgacctggacaactggtgtccctggttttcagtgactcgctcctcttcccttcagttctctgatgtttggtgttattattttatgttgttattttgcctctgatttgtttcctagtcactcaaagcattttacagaagccttaccactttactaaataaccctgtaaggtactgatttaaaaactgagtcatatgcatccctcctcctttcctctcccatgcccaaggaagataaaacagcttctctgccacaattgacccagagtggtaaagatagagaatcagcatgaaaactgcagttccccagctttgtggtactccacggaccagcctccttgctgcattttcatagaatctcttccttataaaagtaatcactctcggataaaccttactacagtttaaaaatgcttccctcttctctttacagctacctgccacttcaatgtgccacatttttccccccactttcacgttaagcttaatgctattccctagatctgagtgaacttcagttagaagaagaaaactaaaaatccagaaactggtgataatcaagttttc

SEQ ID NO: 6952 - DNA, 2238 bp, Homo sapiens
tggggggctctcagggaacagcagcagtgccatagccaggctctctgctgcccagcgctggggtgaggctgccgttgtcagcgtggaccactaaccagcccgtcttctctctctgctcccacccctgccgccctcaccctgcccttgttgtctctgtctctcacgtctctcttctgctgtctctcctacctgtcttctggctctctctgtacccttcctggtgctgccgtgcccccaggaggagatgaccagtgccttggccacaatgcgcgttgactacgagcagatcaagataaaaaagattgaagatgcatccaaccctctgctgctgaagaggcggaagaaagctcgggccctggaggctgcggctctggcccactgagccaccgcgccctcctgcccacgggaggacaagcaataactctctacaggaatatattttttaaacgaagagacagaactgtccacatctgcctcctctcctcctcagctgcatggagcctggaactgcatcagtgactgaattctgccttggttctggccaccccagagtgggagaggctgggaggttgggaggctgtggagagaagtgagcaaggtgctcttgaacctgtgctcattttgcaattttatcagtaatttgacttagagtttttacgaaacctcttttgttgtccttgccccactcctctccaccagacgccttcctctctggatactgcaaaggcttgtggtttgttagagggtatttgtggaaactgtcatagggattgtccctgtgttgtcccatctgccctccctgtttctccacaacagcctggggttgtccccgctggctcacgcgttctgggagctcaaggccaccttggaggaggatgccacgcacttcctctctcggagccctcagacatctccagtgtgccagacaaataggagtgagtgtatgtgtgtgtgtgtgtgtgtgtgtgtgcacacgtgtgtatgagtgcgcagatctgtgcctgggatcgtgcatttgaggggccaggggcaggcagggctgcagagggagacggccctgctggggcttaggaaccttctcccttcttgggtctgccctgcccatactgagcctgccaaagtgcctgggaagcccacccagattctgaaacaggccctctgtggcctgtctctattagctgggttccgggaggcagagaggagtgaccgggcactggcactgcgatcaggaagactggacccccagcccccagggcccccctccccccacttagtgctggtcctaggtcctctgaggcactcatctactgaatgacctctctacttccccttcttgccattattaacccatttttgtttattttccttaaatttttagccatttctccatgggccaccgcccagctcatgtaggtgagcctgggcagcttctgttggcagagcttttgcatttcctgtgtttgtcctgggttctggggcatcagccagctaccccttgtgggcaaaggcagggccacttttgaagtcttccctcagatttccattgtgtggcctggtgggtcagggggagtctttgcaccaaagatgtcctgactttgcccccttgcccatcagccatttgccatcaccccaaacaactcagcttcggggccggtgaggggaggggcctcccccagcacagatgaggagcagctggggtaggctgtctgtgccatggccccccactcccccttcccttggagggagaggtggcaggaatacttcacctttcctctccctcaggggcaggtggtggaggggcgcccagggtcgtctttgtgtatgggggaaggcgctgggtgcctgcagcgcctcccttgtctcagatggtgtgtccagcactcgattgttgtaaactgttgttttgtatgagcgaaattgtctttactaaacagatttaatagttgagagtttttctttctctttcttcctggggctcaggccttaccccccaccgcctctatgtgcagaggggttttgttgggtggtgagggtgtgggttgggggtcctgggagaggagcggagggcctcctgggcgagcaggagccagcacctcattggtgaggacctgggcaggatgtgtgtagggcatccttaaagcaggacagggaggctgcaagggctcaagcccatcttcttttgccaaatgcagaatcaggagccaagctctttttggcatatgattctttgacctacat

SEQ ID NO: 6953 - DNA, 1323 bp, Homo sapiens
tcccatctttaaccctttacattgctgagtgatgtggaacaaatcactgaattaaataattgtctctagagagcagctggggattttaagcaccctggagagaggtgcagaccctgccaggatgataaaggttgtcatcactggcaactgactcctgaccccgggtcctttactcgtatgtcccaagtaggataccataggcagcttctaaaggctgcttacctagattcttctcaaaattgtgtccaagatgttaagtaacctgctattcctgtttagtggttacataacatgtacttagtgtctttgtggagctttgggctggtaggggcagggataggggaaagctaaacagaagtagaagaaaaggtccttgtccagaggaaggttattttaagagacaggacatgtaatttataacaaatggacatttgcaatatagcaacagtctgagtctagaagtgttcaaccatcacatcgcttctcctgacttttctgttgtcctatggctatgagactacaggggttgggggatggggatgcccccaccaccaccagtgtgagaatgagatatggttggggaggcgtgtttggcacttttacaaggttgcattgtccacatttgcttggatggtggcatctgtagcccaaatgggcattcagtcttttcttctgctgtgaggtaagagtaattcagacctaatgaatgagaagagggagcactttgatccacagactttggattaacactgtacccactcttagcaaaaggggacttctctaacaagctagcattgtgttaacctgtcattaacccagcattagagacaggtcactgggatgttcattctggctctcagcctgctgttatttccccactctcacctgtgctagttcgctttctccagaagaggagctgaggtggtcttatcctcagataggacatgagaaattggaatttggcaagcaagggcttcagcatcctttagtttctaaagcaagatcccttcagagaagtctagcaggaagaagccaggagaatgtagaatggaaaagagctcttactccaaattttagagaagtttcagctctacttctcatcttttctctcctggtcttacttgaatgcatgttggtaatctgtatacattactatgactgtgtctatcacaagtcctacaaaataaaaatggacttaaaagtactctctgctgaggctgtaagttttgttttgtgagaaataggtaaagacattagcatttaatctactggaataagctggttgctgtggcttatacctgtagtcccagatacttgggaggc

SEQ ID NO: 6954 - DNA, 1329 bp, Homo sapiens
catgtagtagtattcaggggtttttatttatttttatatttttttaacatctcccacacttaggaattcattgacttttaatctgaaggtaccttaattcattctagcttagccactgttcaactcgagaaactaaaaactccacgtcacattttagttgttgctgtagctgataaaccccacctgtagaatcttgtccatattctattactcattattttttttgttttgcaccccaaattaactgattctttttggtgatttatcacatagtaactaaaaatttatatttatcactagtaaataaaatcattttgattttaacttttttttttttttttttttaattttcagggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtatttttcctaaatagaaataaatgatcccattttttggtatcatgtagtatgtgaaat

SEQ ID NO: 6955 - DNA, 1207 bp, Homo sapiens
ggaacaatcgatggccttgcagcactcacacaggacccccttcccctaccccctcctctctgccgcaatacaggaacccccaggggaaagatgagcttttctaggctacaattttctcccaggaagctttgatttttaccgtttcttccctgtattttctttctctactttgaggaaaccaaagtaaccttttgcacctgctctcttgtaatgatatagccagaaaaacgtgttgccttgaaccacttccctcatctctcctccaagacactgtggacttggtcaccagctcctcccttgttctctaagttccactgagctccatgtgccccctctaccatttgcagagtcctgcacagttttctggctggagcctagaacaggcctcccaagttttaggacaaacagctcagttctagtctctctggggccacacagaaactctttttgggctcctttttctccctctggatcaaagtaggcaggaccatgggaccaggtcttggagctgagcctctcacctgtactcttccgaaaaatcctcttcctctgaggctggatcctagccttatcctctgatctccatggcttcctcctccctcctgccgactcctgggttgagctgttgcctcagtcccccaacagatgcttttctgtctctgcctccctcaccctgagccccttccttgctctgcacccccatatggtcatagcccagatcagctcctaacccttatcaccagctgcctcttctgtgggtgacccaggtccttgtttgctgttgatttctttccagaggggttgagcagggatcctggtttcaatgacggttggaaatagaaatttccagagaagagagtattgggtagatattttttctgaatacaaagtgatgtgtttaaatactgcaattaaagtgatactgaaacacatctgttatgtgactctgtcttagctgggtgtgtctgcatgcaagagtgacaccctccattagacctagctagactgtgcagtgatgtggtggggaggaccagccagggaagagggagcacctcagcagacacaggcaccagccaggatgctaaggacctttagccaagtctgccaactattctcctccatggggagaggaaacatccatttccagtggtagaaaggcagacccgaatgtaccagggagcttccaaatggagggtggtatgttggg

SEQ ID NO: 6956 - DNA, 1149 bp, Homo sapiens
gtgtgaccaggagaccttatgctacctgtaaaaaagttcagcccaccccatctaacttctgagctctgtttgggtgaagattttctggccgcatggctgctcagactggcatccaggctttgctccaccaagaagttaaaggcagtcggacatctcagtagcatctctaccagcccttaactcaatgcatctacctggcatctcccagcagttacttttggagacgattcactgcccctggggcgtttccttgaaggtttgtggagagcgtggagaatgatggggcaatggccaattggagggtggagagtgaagagccggagctggctgtgagtggtttggccacatttctcaggattccatgagagacttggggaacttgggctgacaaaggaagtagcctggggcatccttaaggaaggaattaagaaaagggaaaaagctggactcaagccacgccatgagggtgaaaggttataaggccctgccccctttccagctgcccacctgttcctcctccacacctcttcgctttgggccaccaagaaccaatgaagtccacaccctttggatgagaaaaagagggagttggttggcctctcttctccctgttatccaatttgaggatattttgaccttgggtaaggatgaagtgttaaagccacagctcctctccacaagaagccattcatcttgggggaggcagagagggaagtctctctccaaagtctatccagcttcgcttcgtttcattgatctgcacaagagacaatgctctggaaaaggaagaggaccccagaagggtgcttggcaagacagaggatgctaatgggcaatggagagcactccctccagctggcccctgctgctgcctcccgtcctctgcatggggtcaggtgcttctgtgcttgctgtcctacctctctccacagcagggctctcaaaaccattttgatcccccattggcagagggttcccctctttacagagttcagtcattaaaagcatggatcagctgttaatctcattggaggagggaactgtttcctgcattcattcatctgggaaccttcttgagtagccactgtctgccagccactgctctagagatgggaaaacagcacggaacaaaaccaaggtctttcttcc

SEQ ID NO: 6957 - DNA, 1210 bp, Homo sapiens
ctcccgcttccctcctgggtccctcctggctgtttacccttttcccggcttctctctcacaccccattcatcatccagggccagattctcactcagggagcacttttcatctcctgccctaggtcctccctccccggcctgccattcccaccctgctccccatcagcacattcttccccctgtctcaacctctcagaaaactgcgcccgtcactctccctcacagtgggctgagggatccaagaggtccggggctgggctgatagcgcctcaagggtctcaaatgtctactaactgtgctccttcaccaagggactgatgccactccaggtgcttaagggtccttcaggccgagtgtctctacatcttggcacagaaaagacctttaagtggtcagacctctgcccagagttccagccacccctcagtttctgcatgcccctttaatccagctccatggcactccccttgcttggtgtgtgtaattgtgagcgtgcctgttacttaggagaggctgtctgacagctaaggatctctactgcaagagctgggagtctcagacaaagagagaaaaataatagaaactgcaggtaggaagatacagggtggggacatagcctgcttaagaagcttcctcctgaaaaggagttaaagcttttttattggaaggctggctgttggttcagaaaagcactagagagaaagaaaggcagggaaagacaaggaagggagaggaacttcagcctgtgtactgaggcagacctgtatgggaagggcccagagaatgcgaggccccagcctaaggagctggtatctcagcatcttctcctcctcctcaggaccggttttcctctttcctcctccacacccttctgtgctgccacaggtgcctggacaacccagcaagagcaacacaagtggtcctaaatcacccaagggccatgagaggagggtggcctgaaatcatgggaccactgatagaaatggtgggaatgacaactcaagacctcaggtcagcacggggagaaggtgggactagcagcaccctgtttgtttcttccgagaggactgggtctggggaggcaggtgctgggtcaccaggttctgctgcacaatgatcaccaatctctcgagctaaaacagaaccctcggagtttgtcaccatcatacaaggcagccaaggagatgatgtccttgtacagtgtttctcc

SEQ ID NO: 6958 - DNA, 1228 bp, Homo sapiens
attttttcataatctaaataactatgtggcataatgtatctccctggtttaaataaacagtgcagacatttctctcctgtgatttgcaatgccttgtgggaatttagttaaaaatatgaagacagagagagatttatatgtgattatcatctggaggacaaaaagagaaaagagagaactagctcaaagtactaagcttaagggttctcctgaaatactttacaatctgtttaaaaagggtggaaagtctaatgaggccagatttattttgaaattttaaaataatttcacagaagttctggaaacatatccagtcgggacctagggagcggtatatatattctgtaagggcaaatcctttctgccatacagcaaataacatatggggctgatacttcttaatgtattgcctagttttaacctggaaaaaaaataataaattctataaggagtttggatgacttcataatcaaacatttaataaatgttcaacaacaacaacaaaaaacatgtaaaaccctgggccaaaactctgtgaaggataaaataaaagacataaatcacaaattatcttcaagggcaacttttttaggtaagaaaaagtatatctatctatccagggcttagatatttttgtaaaggcatgattactatgtaaaaaaatagactgacaaacttgttggcttgattaaagatttttaaaattgtgcatactataaaccatgaacataaactgtattcaggccatttgatgagatactcacagaatgattgtaagaaggttccaatatcacaggcaatgacattttcccttgaagattcaattttgttaaataaaaaatcttttcccccacaatcttttcttttttcatgcgatgtacaccatacagtctaaaccgaactgcataatttccaatcatctcagattcaacatgattaaatttaaatgtttctgtgaagacagggcatggtcctctctggatgctggtttttgctctctgtttctttataggtagaagaacaaggtgtacttgccatgagttgccacctgtcctgttatatgttgggatgtctgtgacagctgtcactgttaccagaagcttctgttcttgtgagtcatagtcaaaagtcacatccagtgtgccatatttagcttctggctcaggatcaaaaggtttaggaagctgcgaagatgatccttgagctgacatatcctaagaaaagaaaa

SEQ ID NO: 6959 - DNA, 1717 bp, Homo sapiens
tttttatttctaattttgtttccattcactgtcctcagttcctctgtggcctacattgaaggtagctgtcagtattattattgtcaaccatatttaatattgaatacaagtttaagcatgctgcaaagcattttctaacgttaattttaaaacattgtctctgccctccaaagtgatggttaacagctataatttactaagatctagcacaataatttattacttgcttgattctcaaaacaatactgtgaggtaagtaatgttatcaacattttattgataaagaaactgcagcatgaagaggttaagcagactttcccaaggtcattcggtaagtaagtagtagaactgggattggaacccaggtgtaaattactctaaaacccatgctatgcatgttgcatttgcctccctgtttgaaaaaaaaactacttaggacattatatttatcaataatcccactcaccttgattgaatggcagaactaagggggaaaaaacagctggggaaagagaaaagactagaaaagaagatcagaaattttttttcttctcaggacacaagtggtggtacttttgtgtcattttgtagatgactttgatttgcaaagatttggaattgatttattctaccagtttagcctatacttatattccaaaagcatattaatcagttctgctccttgaccacttttaggaatccaaggtgttttaattgttacatgacccccttactactctatgaagggcataacctgtgtctagcccatatctcactcatatcagtggtgagacaaaagatttgtcttcctctgtcctctcattgcaatttatttatgttttattctcaattttattaagatttgtcaggaattacagctagtttattacatatgtctctcttccccctaggtaagtagtcaatgccttgttagtatctttctgtacccctttgcttatagtaggcagacagtaaatattgaattgaactaaattccctgtggaagaagccagtcacactattacatgagtcttagtttttatgaatcttgtgttatgtatggatttatttattccttcagttaatatatatttaagagtactagatatgtgccatgtgttgttgttccaagtgctacagatgcagagataataaattggtcgaagtctttgccctcatggggcctacattctaaggtaggaagatggccacagaatgggataatttcaggctagtataatgaagcattaagataggggcatgcatagagtaccgtgggatttagtagaagagtgcaacatggaattcaaaaaaatcttcctggaaaagataatccctgagttgggtcttaaagaacaaatacatgttagactcccatcaaacttgaggacacacgttctttccaagaacaaaatgtaaaataatggtttctaaactgtagtatccttaagaattattttgaaaatttaacttgggccaggcgtggtggcttacgcctgtaatcccaacactttgggaggctgaggtaggcagattacttgagctcaggagtttaagaccagcctgggcaacatagcaaaaccccatctctaccaaaaatttaaaaattagctgagcacggtggtgcatgcctgtggtcccagctactcaggaggcttagatgggagaatcgctggagcctggcaagtcaaggctgcagtgagccaagatagcgcca

SEQ ID NO: 6960 - DNA, 1245 bp, Homo sapiens
tccttgttgctggcctccaaggcaaatagtgcttcaccctgacctctcactccaggacagcctctaagggatttgatctgctcatcttcagttgaatgccctcactccaagactggatgctggatctcatagaaaattcacagccagacaatcttctaatctggagtctttgagatcttctaccccaactcatcattttcctattgaggaaacgggtccagggcagtcgtgtgtcttacccagctacacagggtgacattttggtctagaacctagtctcatgagccctttgcattctttccccttaagcaagaatagaatgtagtggaaatttattgattgagacacagaaatcctgattagtgataggcctgtcttctgggcaatatttctaaaatatttgagtgacattgatgtttaagtgacctccttcatcacatcctgcagtatctccagaagcagcactagggtttgagtttcatacttcagcccctctgtaggaatgagaccaagccacagctgtcttttgaattacgtagtcgaagaagacggtagcagccctgtagcattctaaggcatctatacccaaggagtcctgtgatttgagcttcagcagggtgatctacatttgggtgcttgtttctgagatttgcagagaagtataacatggtagttcctctaccttacagttaatcgtttcttaataaagaagcagaatttagaaaccacaggatagtgtacccacagatgggtgttatcaaggccagtcatgaggatggtgtcctggagtcttgtccaccctctccatacaagtctcaaaagtcatcctcctactcagtgattcacgtttagtggtttatattattaaggtttgattcaaacagagccttttctgtcctgtagataatctacatgtttgtagaattattttgaatatgtttgaggaaaatgtttaaaatctaaatatactcacataacttgattattcactcctctgaaaagatgctggataggctaccaaagttcccaagtggtagataattcagaagacttgtttgaatttggattttttttttttttggagtggggaagggtataaaggaggcttaaaatttgaatccataatatatctaattacaggagaatttacaacatctcaagtacgtaaattaagttgtcattgagtgaaaggttcacttggacctagtgctgcctcctgtttattacatagcatggcccttatgt

SEQ ID NO: 6961 - DNA, 1522 bp, Homo sapiens
taaaacctaaaaaacagaatcctcaaaaactttgctgtatgtgttttaacattttagagaacagtatgttgaataactaaggtatgtaacttgaataggaaaaatgtccatcaaatgcaccttggaaaatcacagtaggtagaaggctgtgttaaccgtttgtgtcttattaacatccttaagttaattttgaatttttgacagttttgagggaaaagacctatggaacctaatgtgaagtatttcgtatgttaactggtgttgagttgaagatttttactgtgtataagcagatatcatttgaatgataaaaatgtcattaacctgctgtcttaagatgttcacacaaatatggagagtaattctacaatataaaaatatttattttaatactgagtttcagttaagtcataaacagtgttaaaactcttgggaaggtgtaggggttttttgtttgtcatttttaaaattgaaactgtgtcatacagtgtttcacgtctctgaaattgggattataatagcactattttgatgtagctctaccgatactatgtggtaatgctattttgttttactaacaagctctggaatatttagcagtcattttcactggcacaagagccttttgtatgttattcaatttaaacttttaaaccaaaaattttatggtccagtgtctttggcaaaaagatgctggagggaatgtaacatacaattaatatgtggttatatatatatataaaaagacacaaattgccatgttatggttctgccttgaaacagcacaatgaagtgtatcagtatattctgtgattatgaaacttatatgttgtgttgttttgtgtcttctgttgcctgtcctttgggccagatgtgggccagttaaatgcagttatcatctcattaaatacagatgcagataaaatatctttagtgctgcaacattttacctaactttttgtatgttttcatgactgtgtgttattttccaaagctgttcctacctcaccatgaggctttatggattgttatgtattataaatgttctatatgagacagactactgtgtttcttctcatttattaaaagttaagtagaaaaataaactaattttaatatctacttcatttgtgcatatggcctcccctccgatactaggcttagttacacagagagttggatttcagataattgaaagagaaatttcagtttaacacaaatgttgcaagtgtacagagtgactaggttacaagatgggtgtggaagaaaatgtaagcaaaaattgcaattaaaaattgaaagggtaacactgcaaaggctcactaatatgaaatactcagtggctttgaattttattataagcattaagcttatagattatatagttgtggttaacctgctgcttttggcacttgctatttttttatttataagcatagttactaataaggtttattaaatattttacacctgtaaatcatctaaaattcttaacgcaatagtatattattgtggttctatg

SEQ ID NO: 6962 - DNA, 1206 bp, Homo sapiens
ccaaaattctaaggctctatgatttaacatttatttatagactacacacggtggaatcttgtgctggttgctatggggaggtggaggggcagtaagaatacaaaggaacgagtttctgtccaggtggaggtaaaatataaacacgacattttaaaattacgatggaatactcttgataaattgtgctattttagactgaatacataagcactgtgttgtgggtggagatgagttgatctggaaaggaacagcttgcccatctaaggtggggtggtggctggaatcagagtggcttaagctggacctgaaaggcctcaccacagcccctgcgcagcagaaggacctccccacccactgccctagattactactggacaaatgcagtgccagctattgcctggagatgtgtatacaaggcttgtttggagctgttattttgcattgttttggtattcttgtaattcctatgaaatttttttcacttgtatgtagtgtgtttctagtctccccatccagactggagagctggatcctcaccttctgtttctgttttgctggaatataaagaatggaggaaaattttcaagacattattaaggaaaaaatgatagaatttgatgattaattgggtattgggaaggaggaagctaggtaggagaacaaagatagttataatgtttctaacctgacaaggaaaatactgccttaaacaggtgaggaagttgggaagggaggccaagaagctgatttttaggagaaaatatgaactccatttttaatgtgcttaatttgaagtgaagtctgggtttgggcagtgctaaagggtggattaatgggtttaggacttccataacttcctctcctttgatatggatgagtgacagttttctgatcatctgtaaacacagcttcaaacatcctatcaactagcccctcatatacagaaattcggaagccacttatgggtcaagatatcctcatggaaatggcctagaggcagtttgaagaccattttgctttctactaagggctgctgtgcctcgctttatttaaaaaatacattcctccaaatgcgaagatttgatacccaaagaagaaccaataagaagatgtaaaagtcagtgatgcttgcaaacacaatagcaatccttcaataactaaacagactaaattgggagatttttagacccatataaaaacaggttc

SEQ ID NO: 6963 - DNA, 1194 bp, Homo sapiens
tactttattgtaaatcccatatagccagttgattctcacagtatacttagttgctcaggaaagaactaaaatgcttttttaaaaggatacttaattgctttttgctcaactcctacagtcaacctatgattgattgtctttcaactgtgatttgaaaaatggcagactgtccaaatctaactcatttcccaataaatttattatcattcaatctgatacgtgatctactgttaaaactgtttcttaccatggtacatattagactcattaagccgaaaccacttttagctttaacattaattgtaaatttatatgattcaattttcataaccaatgcttaacaactgcaggcaaaattctaaaatgtgaccactgggtcttgggaatcagtaggggctgtatccagcacaccactgccccatcctttttttcttaactattagtgttgaataaacttctcatagttaatctacttgctgaactcaggaaattcctatcactgaccctggccagggctttaaagggtaggaaaagcattaatgtcagtcctacacagcgaacttttgatttagaagaatgtgacagaaagaaaacatttactgaaatacatgggaagcttgcatatttctaaagttgtctttatacttttcatttctcaaagctaagtaaactgtggtataggcatctctaagatgttagcatttaaaacatcaattgttttattgatgtttaaacaattgtttaaatcccactgaaaaatttaaatattaaaatatcttgcacagtctaccaaatgagttaaatcgttacagtcgtgtctacctcttatttttctatctgtatttaggctgctgttttggtgagattctaatttctttttcccctggaactactttctgtggaagacaaggaacagactggggacagaggcctgaaaacaaattggaagcactcagagatctattgctgaccagccctattcctcatgagttggcggggggaaagccattgtttttaatttccacttaatatgaaaatgcttgtttttaaaatgttttttcctgctgaacaaatgtatttttaaaaggaaaaaaattctcttttggctctaagaagtcagctgtatgagcaggcgtgaccatatcataacatgctgatatgatagaaatcaataaatttttacctctcaggatc

SEQ ID NO: 6964 - DNA, 2673 bp, Homo sapiens
ggcccagcaagcaccactaaattactggatgaaatgaaattgttcacttgagggattagtcaaccatctgggggagaagttgctcactgtcaaatacagcatgcacggtcctagctgatagaccttttcctcattgctacagcaagccacagggtagagtgaccagttctcctatccaaaaataaatgcgaacatgcatacataaatgtggctgagggccacttttgccatcactgtgctccaaaggaacatgatattgttaaatatactgtacacattaaactattctataagatgctttacttttcaagtacggtgtcattttcacagtctccagggtgacaaatgccaatagatatgtgagttaatttttttaaatatctccgtgagttgtaaatagatgtgtatttgatctgccctatccttctttgattctttaacatgttctctctcttctgtttgcaaaatatgtttgaaagcattggtagtgctttccttatcagtaactggagttctcctgcttgcactagagaaggtaaagagagaatcagtattcttatatggcaatctggggaagcagcaatatgccactgtacaaaactgaagaaaagttcctaatttgtactttgtgaagggagatgaaaggacgtttaaagtatatatattttgtcaagaggaaagaagataaaactatgccagttttatatcaatagcttgtagaagctcagctcttcttggtcttggctagactgcctagattcccacagcagacaaggttgagaatccattgctggaatcttggtattgatgagttacagtgatggaacatgtgcttggccacaggcaggtccagtcactgcaaaagtgaccaagccagcaggtcacccttaacttcagaaacaattattggtggtgaactgtacttaaattgcagagaaacctgtaagtaatggaaggtaaagaaaaattacagaatggaaaataatattttgggcaagcaaacaaattcactgagaattccaaaagtatattaaaaaagaagatagctatgagttcagatctatcttattggtctttaatattacaaccaatccttaactttccactataaaggaaggattactagattgattactttctggatagataatctggtaataaatgataggtaaatcaaaaattacttttatttaggagtttgaattcttactctcatcagacattttttttctagggacgcttactaattaaatgatttaagttgtttcttaggggttttttgcctatatatttatgactgtgttaatgagtagtgaaatgatgcggaaagacagctatcaggaagaggaaatacagaagcctgaataatctatgggttagaaaagcatccctgaataatcaaaaattggcagtattggcattgttctcaagcctttttatgaaaatgaaatctgaaatcaccaaatgtaaacctgggaacattattctagtgttgctgtcttggattcatgttaagaagcgtcttcattctttgctcatgttgcccacttcttgtggatttgtctgagtgttttttgacaatcacttccttaaagactcttctgaactagttggacctggttaatcatagagagtagcctttaatcatggatagtcttcttggattatttttatatttgaaaagaaaatgttttatttgcactactgagtaggaagagttaattgttttctttgttctttttttgaagtcattacacaggacttcactccagagttaccattatgagtgtgttcagctctggtccacagaggatggataaaaatggtttgttatgtttttttgctctgcagtgctatgagccttatatctgttaatatgaaggacaaagtcaaaagcagcagtggatagcaggaagggtagagactaatatgtttgggaccaaaaccatctaagttagagatttccagatcacagaggggctgggcattctctggagcagtcattggttggtgctttattgtaatcattttgcgccaatccccaacaattaggaactggaccctgggaataagctgagggtgctgaactgttggggaagggtgactgtagccacatggaagataaaatatgggtttttctgcaaaatttccatctgagggtttttacatttaatatttttttaagacagtttaaagagcaaacgttttttaagtgtattctagttgcaaagtatgcacacatatcttgaatggctttatttttattgtgtaaaactgttgaacacatgactgtgatgcacaaattctttacgtgtaaggagtctatgcattttacagtaacttattttatgatcgggtgatgagacagttatactttcaactgccattatttttattaagtgctttcattttctttacagttattataaaattgtatttattttatacagatgggttttcattttcctgatgctgtaatgtttacttcagcttgttgacctttctttgtgttatctgcatgttgtaacgtgtgataagaatgaatgtaaaggctgtggcaactgtaattaatttttgtaaagggctggtcacacgtggatctggtttatgaatgcatttgggatgattttggtaaccagatcaccttttcagaaatttagatgtgaacaccaa

SEQ ID NO: 6965 - DNA, 1460 bp, Homo sapiens
gaaaagcagtgtccactggaccccttctggtactggatgtgttctttacaaaggctagctcagtccaacactgtgtttacatacactcgtgcttttccttatctgacttctcattttgtatcagaggcatatcataaattgataattttgcaaaatgcacttttttgagatgcagatatagcaaaggattagtaatatagcctgaaaacaaatgggagcatagcagtgtgtgaggttctcgagaactgtcttgtctctgtgtgtttatttgcctgccagtgctctccagcgccatcctgccctggacaccaccctgacgtgatgcctctattgcagctcagaggctttattttttccattttgacattggcactaaatgcatttggggatggttaaaacaaattactatagaacatttaaatgatcagtttaaggggaaataggctagtttatagaaaaataagagctagtggcttataatggtgacaggttctcatgtggcacccctaggacctgtgcagacagtagtctgttgaatcattacatcaaggagctgcccctgtcagggtgagtgtaattaggaacgataccagcacataaggctccccccaatctcttccagttgctttttcttttttcttttttttttagacaggtcttactctgtcacccaggctgtagtgcagtggcataatctcagctcactgcagtctctgcctcccgggttcgagcgattctcctgcctcagcctcccgagtagctgggactacaggcacccaccatcatgcttggctaatttttgtatttttagtagagatggggtttcaccatgttggccaggctggcctcgaactcctgacctcaggtgatctgcccacctcggcttcctaaagtgctgggattgcaggcgtgagccaccacgcccggcctccagttgcttttgaagagggtaaagtcaagtttctatttctagaaaacattttttagaaatttgttgcgatgtttgtacaatttacctcataagagaaccacacccttctccaaaagtgctggtactgcatcagtgagatgagtagggtttttgtttgggattgtaagactattaagatcctagtaagtcagtggtagtttactgtgatgtgagcattgtagattcccccgttgtcactaatcacacaacaattttgagaagtaggctataaaacaaaaaaaggttgctgttttctatttttaaataaaccaaaaaaaaacagaaaagatgtgaattttccccagttatgtgggaaaggtaaagcaacaccaaataaaagcccacagcagcttcatctttacgataactcagtgcatatgtgaaagagaatgatgcattaactgaaatacctcattgaatattatactactactggtaaaatgcagaagacagtgttaatgtgtttggtttggggactggttgttataaa

SEQ ID NO: 6966 - DNA, 1919 bp, Homo sapiens
actgcagactctcaagagatcaatcaaattgccagaaacagtttggtttttcatatggaataagtattaaagttacagtgtagttcatttattcattgatttttgtaatgtaatattctggaaaaaattttgttttcttaaaaattttgtctgacagctgggcgtggttgctcacgcctgtaatcccagcactttgggaggctgaggtgggcggctcacgaggagatcaagaccatcctggctaacacagtgaaaccccgtctccactaaaaaatacaaaaaaattagccaagcatggtggcaggcgcctgtagtcccagctacttgggaggctgaggcaggagaatggtgtgaacctgggaggcggagcttgcagtgagccgagactgtgctccagcctgggcgacagagcgagactccgtctcaaaaaaataaataaatacattttgtctgaaaaataactgggatcctggccagaaagattgttctttcttgttttattattagttttttctgttgccaagcttttttttctttcaagaatagtcacatgttgagatcactgaattggtaaatttgaccgctactcttccaaaatacatcatttgctgcctgacttagacctaggattctgagttgttcattgggaggttctgaccagtcactacaaggtttatccatggtagcagaacctgagtccttctgtagatggacttgaaagtgttccgtgcaacatccagccttctggattatgaaagcccacagtctaacagtattgaaacatcctgctgtattagttcaaccacatatttatctcttcctgtgctaaagcagtctttattattttcatatttaattgaaacaaagagcagctagcaatttcatagaaaattaatttgttttttctgatgtgtctgcaactgtgtataatacagacatttcacattgtttccaaaagtgaagaacactcatttaatatcttcaatgttttaagttagaaggggtggatcttttcctttggttggtgattggtttggtttatacttgatgagttatgctagactgattgtttagagagagcagtctctttattacacaggctcagtttgttgggatgctcagggaacagagttttctggttagccagaaaacccccttttttcctattttaattctggttgaaaaccatgataaaatagactttcttagcacagtatggtagatataacttaactgctttttgattggggatcatttagggcttcaggatcacgatttctaaacatcagggatcatatggttgcagatgccgatgctataagtaatttggccggatgcagctcctaaggtaaagcagggtactttccctggaatttcctttttaaataaatatctgtttctttgcttgtgttttgcctttttctcttcaaagtcaacattaattcaaaggagaatggagcttaagataaaaaataaaaaggggttgttgttttttttttctttcttgtcatgcggcctctgggactgagaagtgatttgcaacttgggtctctccaagattgcttgccttcatgagcacaacccattgtactgctaacagccagaacattctcataaaatgtgtacagatctacagtgtccacggttgaatgacatctcttcagatgcagcccagttgtatgaggttcacacaacctacacagtcatctcagcacctgggaacacgtgcttaggaaaaattgccagagcagtgcagaaccccttgttcttttaccaggtgtggaaacagctgaatcagaaagcctgggtttcactcttggttctggtgaattagctgtgtgaccaagcaagtcactttacctctacatcttaggggtttttttttttgtctgtcaagtgactgaattagactggttttc

SEQ ID NO: 6967 - DNA, 1494 bp, Homo sapiens
tttatactagaagtagaggattaagacaattatctcaatagatgaaatgaaaaaatactttatttcacagaacaatttgtttagattatttaaagagttatgtatggagatataaccacagggacagaacttgctacttatgatatcaaaaatatatgcagaatattaaaggcttaggaagtgtattttctaaaaacaatggaacaattactatcggcactcaaccttcatcttccttttccgttctcttagagtaaactccagtaacccatcactgggtcaaatcacatctgtttccgttctgtcagaattataagcctgatattggagacaacagtataagatactttaatttgtttcccaatgaaatatccttactgtacctagttaatgtgccagaggagttagattaaaagtcatttcacatttagtgtagttgaagttgtttggggttggaagaaggtctacaaaatatttatttgccttggtttttaggataatcaaagtatgggatttacgtaagaattatactgcttatcgacaagaacccatagcatccaagtctttcctgtacccaggtagcagcactcgaaaacttggtaagcctttaataggtcttttgggggagataagagtttttgtttaaaaaaaaaaaaaaaggctaatttccagtaacattgatatgaaaaattctaatatgtgaagttcaaaagataaaaactcagaagaatgtttttggtttgtgtatattttggggacaaagaattctgatgatgattcttatgaaatgatctatttttgtctctacattttaacctcagatctactcaccatcatcaggacgtgctaacttaagtttcctttttccaggatattcaagtctgattttggattccactggctctactttatttgctaattgcacagacgataacatctacatgtttaatatgactgggttgaagacttctccaggtaagatattagtcattcaaattctcttaccaggaaagcattatgggctttttttggtaatgataatttaatgggctttcttctaaactgaacttattaagccatatgaggactttggcatctttgattacatccagtgataatttcataagtgtacattccttgtgatgatttcataagttagctgaattgtgctttacatggtgactttattttaatagagagtatctcctgaaattatgccctttggcctatatttagaattctctcaattttttatttaataagctgtggagtagataaagtgcttctgctcagcttttttcctctttaggggctgctggttaaaattagggggctgaaattttcatacccccaaaatagtttcagcctatctcagccttctccttaatgttagaggcccttttatttctagatgttttccccagcctcaccttttttttttcctcaaaactttaaaaatagaatctgatacttaaaactaataaataaatgata

SEQ ID NO: 6968 - DNA, 1260 bp, Homo sapiens
gaaaatgataaaagggtgtggttggaatcaagtgatgtatacctacttactggcaaattgacccttagatgattaggttagctatgatttttcttgatgagaatttagggactttgtatggctttcacttctgatcttcatgatcctctcctctttttcagtaacagtaacgagtagccagagtactcctgccaaagcccccagggcaaagtgcaatccatccaattcttccccgtcatccgcagcttgtgccccaagctgtgctggagacctccctcttccttcaaatactcctacgttctctattaaaacctctcctgccaaggcccggtctcccatcaacagaagaggctctgtctcctccgtctctcccaagccaccttcatctttcaagatgtcgattagaaactgggtgacccgaacaccttcctcatcaccacccatcactccacctgcttcggagaccaagatcatgtctccgagaaaagcccttattcctgtgagccagaagtcatcccaagcagaggcttgctctgagtctagaaatagagtaaagaggaggctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaagagaatagttccccagagaataaaaactggttgttggccatggcagccaaacggaaggctgagaatccatctccacgaagtccgtcatcccagacacccaattccaggagacagagcggaaagaaattgccaagcccggtaagtcagcagtggtgggaagatacatttcctaacttaaaaggggccagacacccagatgtctcaagtcaggatgcttttttttttttttaaagaaagaaatctatttattcctagtgctgccaaattcagcacataaatacaaaacaaattttgcatgggccatatttttagtaaaaatgttttatgctaagaaactatttttgtttgtctgaaattcaaatgtaactgaatgtgctgtattttatctggcaactctacttact

SEQ ID NO: 6969 - DNA, 1453 bp, Homo sapiens
aatcttgagtttcttttcatgtacataaaaagcaatagccttttagtatagatagccctgagccaaaaagtaatagaattttctctagatatttaatacagagagtgtatagactgactctaagttaataatgtgcaaaatatcttaaacatccctccccttattcaacaattatgtatcagtgatcttgaaccattgttttatatttttcacctttgtaacctcatggaaagaggctttacatactttctatgtactatttacttagaagggagcccccttccagtcatgaaacttcatttgttttatccatatccctgaggactgtgtagactttatgtcagtttttgtcattatttgaaaatctattctgacaactttttaattcctttgatcttataagttaaagctgtaacaactgaaattgcatggatcaagtaagcatagttttatccagggagaaaaataaaaggaagccatagaattgctctggtcaaaaccaagcacaccatagccttaactgaatatttaggaaatctgcctaatctgcttatatttggtgtttgttttttgactgttgggctttgggaagatgttatttatgaccaatatctgccagtaacgctgtttatctcacttgctttgaaagccaatgggggaaaaaaatccatgaaaaaaaaaagattgataaagtagatgattttgtttgtatccctacccatctcctggcagccctactgagtgaaattgggatacatttggctgtcagaaattataccgagtctactgggtataacatgtctcacttggaaagctagtacttttaaatgggtgccaaaggtcaactgtaatgagataattatccctgcctgtgtccatgtcagactttgagctgatcctgaataataaagccttttaccttatctgatgtccttttctgagctttttgcattacctagaagcagtctacaaaaaagaactatagtagtcaagaatcccttctacttgttcattaaaatgtttattcccaaagttataatctatttcaagctgaaagagcttttaataaaaaacatcttgcttggatcagactttgagcatttaagatggcttggattacttgataaagcagggtggagtgatgtagttctttttctaaacaagtatttccagcacaaacttttccatttgaatacattccaagcactattgctaggatcccgtattagagtttgcttttggctgtttcaacacgggcccttaattaaattttgtgaggatgactgattagtgtcttcaaatgtctcttcatctggactgcacatttaactgatgttggatcaagaccatgtgtagctactcttgtgttgagggtcagcccattatccccatccccagccctaacagcttaaaacagctttaactcccatcttgaaattagcctatggccatg

SEQ ID NO: 6970 - DNA, 1240 bp, Homo sapiens
cagttgggactggtagtgtgtgagccgagttccccacaatgccttggcgtcacctcacgccctcctccttattcaaacaggttttctgtgaagtcttggctgtttccttctaattcccacctgaactctttccatcctaggggaggccaacacccttccccacctgcgcgcttgcttaacctgcacttcctatcttgcgtcccgtgaagtagagtccttcactcctcttccaggtttgccctttcccggtcttgctttaacaaccgcacgaaccttccccgaccttcactttcccgagtgtcagctcctctgttcggccacttttagctagtcctttacttttacagttataaagccgtctgcacccaccttcttctcaacttcacttcccattgattgcccctaagagtcatcagaccaggaatccgaatgcaaacaacggttaagagttagctggcctttggatgtatttataaagaaaaagcctaaaatttgaccagtgtagtatcttattcacaggatcgttagctttaaatggtatcctttagctcaaggaatagatttaaaatattctgttgtctgagccgatacacatggtctatttggaaatacgaaggagtaggtagtgttgctttgcagtcgaatgggaacttagtttgccaggcagtgattccagggactttgtaggtttgtacaggaattcaaattggtatccgtgcctaatgccttgcaggagaacttggcactctttttggctcacttttcccactaggtttagaggattttcgatgttatttcctggtgttctagtttattctttgtgtattactcatgcttaattttataattttaatgtccttgctttttatgagatagaaatgttggaacaagatgataatgctcctacatatttagataaaatttgcaacctgacggaaatccctatcatctgatgttcagatttttcaattcatttgaaaaagctgcagcatccccttcaaggccagtctggttctcatttgtctttgggcctgtgaatccagccttagtttggcaaggagtctaaagaaaaccccagatcaaatcacagttgacctacaacagctccagaaccctattgagaccctaccttgccctgactcttggagtgcttctaaatcatgacatctcacagttagaatcaaactggcttttgaacagagattttgagatattagtctgtgctatcgaatttatcatt

SEQ ID NO: 6971 - DNA, 1236 bp, Homo sapiens
gaacacaccgattctcattttggcaagattttgaggttgtttggagggtaagtcaggagtggtaatggttatgggaccagataagaggagcaattagcatatcattgctgtagtccagatgaggcatggtgagagtctgaaatggcagcgggaatgacaagaatagatttcaaatatgttaaagacgccgaatcagtaacatttaatgattagctggatatggtggcacataatctccactactctggaggctgaggcaggaggatcacatgagcctaggagtttgagtctatcttgggcaatgtagcaagaccatatttctttaaaaaaatttttttaatgattgattgtgagtaatgagggagagagaagagtccagtataaatccctgaatgatggggttatagatgggcacatttctcactagatttttggaagaagttttacatatgtgaatagcttctacaaaattaataaatatataaaagtaacttctgagtaggttatttctaagtttttctttatttttatttatagatgccacttcaaatgaacaacaagagcttttctgtcagaagttgcagcagtgttgtatactgtttgatttcatggactctgtttcagacttgaagagcaaagaaattaaaagagcaacactgaatgaactggttgagtatgtttcaactaatcgtggtgtaattgttgaatcagcgtattctgatatagtaaaaatggtaagcctctagaattatgttcctcagatttatgtaaatttaagatctgaggtataataatgaattgagactgattttaaataaatgtacaataattaatacatcccccaaattttagaaaatagttcataccccatccattccaatgataccatcattgcatatacaagtttgggaattgagagtcatagtggctggtggcttccatattggatagtgcagatctagagcttaagagaagggtttaggcctgggattatacagattgataggtaattaatgtcatggaggtgaatagttactgagaacttttatttttatttatttatttttgagacggagtcttgctgtgtagcccaggctggagtgcagtggtgcgatcttggctcactgcaacctctgcctcccagtttcaagcagttctctgcctcagcctcccgagtagctgggattacaggtgcccacgaccacgcccagccaatttttgtatcttcagtagaga

SEQ ID NO: 6972 - DNA, 1919 bp, Homo sapiens
gcaagtagtaacgtctagctggtacaggagatgcacagactcagtacatttaggagagtgacaagaagaaattaggtgctccaggtaagtggactccaaagctttagcagagggatttaagtgaaatgtgggtaagtaatgtgttctccagtaagctgtcaaacagcacctctctttgggttctgaaataatttctgattacaaaaattttggtttatctacagagagaaaaagaaggaattggaacgtgaagaattatggaaaaaattagaggagctaaagctaaagaaagctctagaaaaacagaatagtgcttacaacatgcacagtattctcagcaatacaagtgccgaataaaaaaaaagcctcccacctctgccggataggcagagttttgtatgcttttttgaaatatgtaaaaattacaaaacaaacctcatcagtataatataattaaaaggccaattttttctggcaactgtaaatggaaaaatatatggactaaacgtagccctgtgctgtatcatggccatagtatattgtaacctttgtctaatcattggatttattgtgtcacttctgaagtttcacagaaatgaatgaattttatcatctatgatatgagtgagataattatgggagtggtaagaattatgacttgaattcttctttgattgtgttgcacatagatatggtagtctgctctgtatatttttcccttttataatgtgcttttcacactgctgcaaaccttagttacatcctaggaaaaaatacttcctaaaataaaactaaggtatcatccttacccttctctttgtctcacccagaaatatgatggggggaattacctgccctaacccctccctcaataaatacattactgtactctggaatttaggcaaaaccttaaatctccaggctttttaaagcacaaaatataaataaaagctgggaaagtaaaccaaaattcttcagattgttcctcatgaatatcccccttcctctgcaattctccagagtggtaacagatgggtagaggcagctcaggtgaattacccagcttgcctctcaattcattcctcctcttcctctcaaaggctgaaggcagggcctttccagtcctcacaacctgtccttcacctagtccctcctgacccagggatggaggctttgagtcccacagtgtggtgatacagagcactagttgtcactgcctggctttatttaaaggaactgcagtaggcttcctctgtagagctctgaaaaggttgactatatagaggtcttgtatgtttttacttggtcaagtatttctcacatcttttgttatcagagtaccattccaatctcttaacttgcagttgtgtggaaaactgttttgtaatgaaagatcttcattgggggattgagcagcatttaataaagtctatgtttgtattttgccttatgtcatctttgcttcttttagctctaagcttaggcatacaggagaagtctgcccccctttttacatacatatgtgtatttatagaaacttttaagacaaattgtgggacgaagtctaatttaaaaataggaagattgtgtgccaaggttgagtgttctagccctttaccaaaatatgttttacagaatatttgcataaaattctaagttctaggatatctttccatcatctttcatatccttgtatgttaagaggatgggtttaatttactttgaagctaatttttcataatccataataaatagcacttctagtgaagagcagggagcctgtggcacagttagaaatcaggtattattggctgggtgcggtggctcgcgcctgtaatcccagcattttgggaggccgaggcgggccgatcacctgaggtcaggagttcaagaccagcctggccaacatggtgaaactc

SEQ ID NO: 6973 - DNA, 1210 bp, Homo sapiens
cctaattggctgcctttttcactgtgctgaccagctgttcaagccacttcagtttgagtacaacataccaacatgacactactcacccacaaaggacagcattgggatcaggctttcagatgacctctaagatttttcccatttattgtactcttgttacaaagtactttttaacacatgcagtcaatggctataaaaactattctgtgtacagattctacccagactttggtcttagaattatgttctaattaaggagcctggttacaggttcattctgtcttgagttcttttctgtgctgcctttctatcatggataaatgctaacgctgtattttttcactccaacttgagatagagtagttttgtacccattgccttttttttcttttaaactctctttttttttttttcctgatgtgtaactttctagtaagataatttcatcatgtatgttactggctatttcatgatttcatgtatcacatcgtatattttgccttgaagattcctgaaataaggaaatctataataacttcagatagcctacatgtccccatttagtggagacctcttgaatgctatttgaattctgcagtatcatttttatgaccattctcctttgaggaatactatgcccaggtacatgctctatcagtgtgccgggagagtggattcttttcttcactgcagagtcatcacactgttagaatagtctgctcttttacatgctcaggtagggaaaataggaccaaatatatttccacagtgcctaccactgtgtcatgtttacagtgagagtttaaatattgttgatgtcctgactctgtgagctcatagggagtatcttcatagtaatgacatttgatcagccataaaatttacattatgttcatatgcacccaaaaaagctagtcaggtaatgaatacccttgaagtgaatagcaattttgatttaggcagtgtgttaggccatccttgcattgctataaagaaatatttaggctgggcgtggtggctcacgcctgtaatcccagcactttgggaggctgaagcgtgtggatcacctgaggtcaggagttcaagaccagcctggccaacatggtaaaaccccatctctactaaaaaaaaaaaaaaaaaaaaaaaaaaaaaaaaaggccaggcgcagtgctgtggctcatgcctgtaatctcagcactttgggaggcca

SEQ ID NO: 6974 - DNA, 1287 bp, Homo sapiens
ttcctaaactgctcccagtaggtcagagtctttgcggttttttttccccacaactagggccgagtggccttggaacggtttgaccatccacagagcccagttggcttgtaggtgcccgtggacaattttgtattagcaaatccagtaagactatggttattcttggtggcggaaacccttgccacttcttttctctttctccagcacttggaggttgggagggaactctggagggcagatctctcagctgaagtttcaaatggattgaggtgtttgaggagggaagattctctccctaattcctccgaaaccttgacttctgagttgcagggctggggaagagattgcagggtctactgtgtaggaggagagggaagagaggtgcaggacatgagaataagaagaagagctgtgagaggccacaagcactggagcgccaagccccagcttccctctctagattccagctcccgccattctgccacactagaactcaggacagctgtgttcctggaggtatgtttggagagaagcagcttctcagcttccacccatggccttcgccaagcagccttttctctaggtaatcttgcttttggcgaggaaatgagaaagtgacaaatatggtcttgacccaatcactccacaaactccgggaatcttactgtaagatggccaggactagggtttggtgactctgtccctgtgctattctgtcagcattacataaggccatcgcgtcatttctaaatgtgttgggtgtcatgaggaagcttgggaggggcccaaagggtggaaaattaccataacaggcgagaggcccatcagctgtggggtcccagtccctgtctgccatggataattttagtggcattatatccccatccacctcctccctccagctggagcgacttccagccttgaattcctctccatttttgcacttgtctaaataatccctttcgagaggaggatcagtgtcactgggttgacaagaatcagccgagggggagggcaggtgaagatgactgcgtagcatccgctgagaccaagtttcaagagggaaaccaggactcccccacccttccacccacgggtcctttctcacactgctcctctgggagtgtgtaaagcacctactacactgaattgtcaagttttttcctgtggttcgtaaagagaaagggagagggaggttgagattcatgtttcaaaggccatctgtgaacttaaaccaactccttcccagccccgggcctcagaacccttgcagctcttcactaaggg

SEQ ID NO: 6975 - DNA, 2111 bp, Homo sapiens
tggagaaaagacttgtatgattaatttacaataacccgttgacaattttactaaatatgtgtgtgcttctttaatgtaggagctgaagttgctttggttggtggcttgaaacttctagctagactgtcacttcttacagaacaagacttatggactgttaatggacttccaaacgaaaataactcttcagatcatctgcctttattggcaaagttcagacttgagctctgactctctttgatcacatactaattttctttccaatttgtattgtttttcaaagaatgtaaagttcttaagtgtatgcatgttgtttatttttgcactgtggagattctgaagcggttatgttagatgctttgaaactccatatcagaagaaataactttataacaattttttttaataatgaaaaatattttcgtgacaagtgagctctaaattctctttattgtaaaagagatgtaaaggttttatattctaaatcctagtaaaattgacagtgatttttaaatataatgcatcttcctttgtctgcttagtaaaaaatttcatttcataattttggcaagctctgtagtggatccaaagtatctttgagttcttgcaaactacaagttgtttcctttccagaaggcttgatttcattaggagacccctctattgagttctaaatagtttatcttagaaagccttgggtcattcacaggtatccaaccagccattgtttagtttgtttttgaaggggtttgataatgctttttaagttgtacagaatgcttaatccatcttattactgtcctgagccatgtaatatgcctgcatcgtgttggggaaatgtttgggaaatataagccagcataacgtgtaaagctcactctttcaccctggaacagacaagaggtgggcttaatagaggcagagactggggatatacctttgtttccctagcatttttatttatttatttttattttattttattttttgagatggagtttcactcttgttgcccaggctgggggtgcaatggcgcaatctttgctcactgcaacccctgcctcccgggctcaagcgattctcctgcctcagcctctcgagtagctgggattacaggcatgcgtcaccactcccagctaattttgtattttcagtagagacagggtttccccatgttggttaggctggtctcgaactcccaacctcaggtgatccgcccacctcagctctcaaagtgctgggattacaggcgggagccactgcacatggcagcattttttaaaaattcagttttaagatctctggtttaggggagagattttattttactgaaccagttctatagaaatttattttattaggaaatttgtctttggaacaaagtggcagctataaaattatttttgttaagcctcagaaatatgaggaagcctgtaaaactctagtggggagatattaacttggagacctaatgctctgtaaatagtcatttaaactgttggttttagtggttttgtttctaaaatgttttcttttaccgtgatgcaccagtatgagatggtgctgacactttctatgaagtggttatgagcaggtttaataaatcctctatacaagtgtttgaatcaattttaaaacataaaaagtggaaatttccttttttgtagacagtaggaacaaggaattatatgcatttttactaagtagtaattttacactgaattgtaaatgtttttacagtgagttttattaatagaatgcttcaccttaaattggaaaacaataatagtcttggactaagtctttgtactaaagcatttgctataattatttttaaaaaaacaaacagatgaaaacctcagagaaggcatgtggattataagatttgtctagtaaaaattgtaattgaatatgtttaaatatttaatttctcattttggggggtttttatttttttattttttagatggtgtctcacgctatcgcccaggctggagtgcagtggcgcgaactcggctcactgcaacctccgcctcctgggttcaagcaattctccttcctcagcctcccaagtagctgggattacaggcatgcaccaccatgcccagcta

SEQ ID NO: 6976 - DNA, 1147 bp, Homo sapiens
gtatgtacttttgtttaaaaattgcctaaattaattattttgtctttataaatacattattttgagaaaggatacatgttttgacatctaactcatttgcaggccaattgtaattggtttttgaagagatgaagtgacattttatatagtataaatcttctccatactgggttgaatatttttccagtatgaataaaaccatacttgtttaaaatgaaaatttgaaaccaaaacagaatagtttgaggaagaattgccgctttatatgtaatatatttttactttattttattttatattattttcctggtcagcaggaatctgccttatatttttaaagcaaatattattagttaatttcagtcagttaatcatattgtttaggacatgtgtttgcctttgcatgacaattttgaacactttaatgaaaggattatttgttgttcagatatctgaacctaaatggttatgagatacatgtttaatttttttctctctagataattgtatggaagagatacagtgattttaagaaactacacaaagaactatggcaaattcacaaaaacttattccgacattcagagttgtttcctccatttgctaaaggaatagtgtttggtaagtgattattttgaaattgtaatttaaaaaaataattaattttgtatatatactgaactctaacataactacactatgaagtcagaagcccttttacttattgagataattcatattgttcaacagcacttgaaattgtcttttcttgttcttgttatagttttgtgtacccagaatatatttactcttcctatctatgaaacaaaacaacttcagttccaaccaaccaaataaaaaaccctgtaggaacataagaaaaggtgatattcagttattcttatagttttaaaattctttctttttttaaattaagtctcattttgtatgtttccctgacactttgcttatagtatgaatggtgtggttttctagtatttgcttcttgcaacttctttttgataccttagtattcttttttttttttttttgcctcatcagttttcaaatacctaggtaacagtattttatattaaagtttctgtgtcaaaataattggtgtagtttctgtcccctgtctggattt

SEQ ID NO: 6977 - DNA, 1251 bp, Homo sapiens
tttttctcacaagcatgctgttatgtatgctgacagcatcacacgttgaatttagcataaaagctttttgcttcaagctgagatttttgaccccactaataatacagatgttctcataatttcctctcttcagcccctttataaatcaaaaagagtagaaaagggaaaattatatgagtaattacagtattagattactatagaaaaccatttcacttctttaaaattctcttttcatctttagtttcgaatcaccagcttcttaaatgtcaactttcttaaattgacaggctctaaattatgaatgtaccatttatttatcggttgacacctttgtctcttgttttatcagaaacattttcttttctactgagagtactgctgattctaattgtagagattagatttgacttcagaagtttgcataataagcaaagcaactaagtgataggcctgctgctgctttctgatctgtggacgtaaactatcataaaccagtgtttgatcattcttcccttaagtgttgattcttatttaattgtagggcgatttgatgaaactgttatcgaagagagaagacaatgtgctgaagacctgctacagttctctgccaatattcctgctctttacaatagtaaacagcttgaagactttttcaaggtttggtagtctttctggaatattttatatcttattaaatacttttgtaatttgtagtaaagtaaaataaaaaatgccacttttgaatttcgttattcactataaaagtagaaattaatagctctataataatgtttatggcatatttcctatttttagtatagaaatttatgctttttttttttttttaaaggaactggttctgctctgttgcttagactgttgttcagtggccattgacaggtgtgatcatggcgtactatagtcttgagttcctgggctcaagcctcctgttgcctcagactcctgagtgtttttgattcatggatcttaaaaaattgatgcaaagagcttagagattgtttaactcactctgtcataattgaaatacattaaaaaaaatgaagcatcataaaactctagtacttaccttcactttttgaagtgtctttcagtggcagattactcttggaatataagccactgtaagtctatattaaatttgttattatgttgacttgtataaagatacaacaaaaatataaaactgcacagttttagagagcaggccagtgcaaattatattactgg

SEQ ID NO: 6978 - DNA, 1149 bp, Homo sapiens
tctaccctgccacttcacctcctgggaatccttatcacatatttgtcctgaaaacattatccacctgccctgtgctttataatatcagcagtatatctttttatcttgtggatgatgtgcctttatattttgagaaaaatttccagtaacagatttgatttgcatggacagaaacttgagcaaatgccaaactagcaggggggccattattctgctctataaataagtttaaaaaagaaaaaacacacacacagaaacctgtgaatcaacatgttttggtctaattgaggggaaaagcaagacagataaattttgaaatgcaaatgatcaccttctgttatttaagtatagtttctgccaacttagtgatcctagattttaaaaagtcataattatttcaacaatgtatactcccaaggatgcccaagattcacaagtttctataacaaaactgagaacttttaaaaaagttgccacttttttatattaaagaaaacaaatccaacaacaaaaagacaaaaaccatggagctttctctggctacatctgtgaaaaagccagcgcataaatggctgcagctgcagacccatcaagagggtcttgagaatacgaattcactgatcaaacccagccctgttttcaaagtagaagccattccttttaggttcactttgtatccttagattatctaggatgattctctagaaaggttttattttaaataaacatcattcatggtaaatgggttcctttcataccacagaaacacagaatggagttcaggaagagaaaaggcaaaagaaatagtccacaaagtaggaacagattgtatagcatgacaatataaatataacactgtctggtttccacattaggagacttgtagatactttattaggatacttttacacaggttcttctgctttttttgttgtgagggattagagaataaaaactggagtaaattggttatttttctctggaggactttcttctggttactctgattttatatctgtttttacacacatacacacaaaagttttagccaaaagattttatgtgctttatcatttgatttattaacttatgataataaagaataaacctttgtttatagtgttttaagtataaaggaaaaataaaatg

SEQ ID NO: 6979 - DNA, 1201 bp, Homo sapiens
aaggttgtcaagaaaaactagatgttaggagaaaggaaaatttaattgcagttttttttcttagaattgactgctgtgagagttccatatgcctttcttcattgctgcttttgtcccccgtgagctaaaaagatggagtgacatcaaatcaaccagaaaaagtatgcctttgtgacatcccatcaccacatgccaacaggtatatattccccattaagttcttcggaataggaatcctctgtttcaacctggccaggtgttgtggtggctgtactctagttagactcggaatatctggggatggagggcttcccctgtgtcttctacttcaaggtctgaaggctcagtgaaggagtataatctgctgatctttgtagattctggagttttgttgtatgtcctggaaagaaacccattagtattacatgtattttcagtgaacagagcttataacccttattataagaagctcatcaataagcaaaaagatacttgtttcctttccttggaggtttttccatccttgggatattctgctgttagggatgttttagcaagtggtctcagttactggtttattgcgtgatgaacaacatcagtatttatcttttatctctaagccccaaggtgggcactgttagaatatgtctcatgtggacagcatatagatctggtgcgtctttgaggtcgtcagagctcatgggcttccctgaaattcatccactgtccctgccgtatgctacgggaatattcattagtgtacaaaatgcagggaggaagtaggtttaatattcaactttctagccaaagtttatattgaaacccaaaagaaaacatttaagagttgttccacatatttcacttttaaaaacaaatgcctttggttctttagcacattttgcattccttttcacatctccagtaaatgccaacatatctcctgttaaattagcagcagccatttaaagtcctttcggtggcatctgcataataattgcccagagatgctttatatctgggaagcaagccaaggaataaaccttgaagcaaagtgtattaaattagttatctagttagagcttttggaatgatttcctgatgatgtatcaagtctgaagctggagctgtcagtgtctattgctgcagtttggatttgaagggagaaaatgtaaaatggaggaaaaaaaagttaccatctcac

SEQ ID NO: 6980 - DNA, 1869 bp, Homo sapiens
gtggaagctgagcattttgttagcctcttatttaataattacaaagagatttcatatttaggctacctgaatattcttagcaagggaaaaatatgaaatttaaatacattacaaattgtaattgagccgaagggtttgtcttcaagataaatgcctaaccccagtgtcttgcccataggggccacttactgaacgtataagtatgttgaacatttgaatgaagagagaaagatgtagtgggaaattcaccactttaagagatgtgtttagcagaggccacgcatcagtttctaaaaagtaataactaaatctattctattttgattctttttgaaaaataaaatgcatgcttgttatgtattataattacaggctattcaaggccgaaatgagagctgtgacatatcaaaagaacatacttcagaaactacagaaagaacaccaaagcatgatgttcatcagatttgtgataaagatgctcagcaggacctcaatctagacattgagaaaataactgagactggtgcagtgaaacccacaggagagtgctctggggaacagtccccagataccaattatgagcctccaggggaagataaaacccagggctcttcagaatgcatttctgaattgtcattttctggtcctaatgctttggtacctatggatttcctggggaatcaggaagatatccataatcttcaactgcgggtaaaagagacatcaaatgagaatttgagattacttcatgtgatagaggaccgtgacagaaaagttgaaagtttgctaaatgaaatgaaagaattagactcaaaactccatttacaggaggtacaactaatgaccaaaattgaagcatgcatagaattggaaaaaatagttggggaacttaagaaagaaaactcagatttaagtgaaaaattggaatatttttcttgtgatcaccaggagttactccagagagtagaaacttctgaaggcctcaattctgatttagaaatgcatgcagataaatcatcacgtgaagatattggagataatgtggccaaggtgaatgacagctggaaggagagatttcttgatgtggaaaatgagctgagtaggatcagatcggagaaagctagcattgagcatgaagccctctacctggaggctgacttagaggtagttcaaacagagaagctatgtttagaaaaagacaatgaaaataagcagaaggttattgtctgccttgaagaagaactctcagtggtcacaagtgagagaaaccagcttcgtggagaattagatactatgtcaaaaaaaaccacggcactggatcagttgtctgaaaaaatgaaggagaaaacacaagagcttgagtctcatcaaagtgagtgtctccattgcattcaggtggcagaggcagaggtgaaggaaaagacggaactccttcagactttgtcctctgatgtgagtgagctgttaaaagacaaaactcatctccaggaaaagctgcagagtttggaaaaggactcacaggcactgtctttgacaaaatgtgagctggaaaaccaaattgcacaactgaataaagagaaagaattgcttgtcaaggaatctgaaagcctgcaggccagactgagtgaatcagattatgaaaagctgaatgtctccaaggccttggaggccgcactggtggagaaaggtgagttcgcattgaggctgagctcaacacaggaggaagtgcatcagctgagaagaggcatcgagaaactgagagttcgcattgaggccgatgaaaagaagcagctgcacatcgcagagaaactgaaagaacgcgagcgggagaatgattcacttaaggataaagttgagaaccttgaaagg

SEQ ID NO: 6981 - DNA, 1142 bp, Homo sapiens
catgcagatttacttaagggtagagtggagaaccttgaaagagagctagagatagccaggacaaaccaagagcatgcagctcttgaggcagagaattccaaaggagaggtagagaccctaaaagcaaaaatagaagggatgacccaaagtctgagaggtctggaattagatgttgttactataaggtcagaaaaagaaaatctgacaaatgaattacaaaaagagcaagagcgaatatctgaattagaaataataaattcatcatttgaaaatattttgcaagaaaaagagcaagagaaagtacagatgaaagaaaaatcaagcactgccatggagatgcttcaaacacaattaaaagagctcaatgagagagtggcagccctgcataatgaccaagaagcctgtaaggccaaagagcagaatcttagtagtcaagtagagtgtcttgaacttgagaaggctcagttgctacaaggccttgatgaggccaaaaataattatattgttttgcaatcttcagtgaatggcctcattcaagaagtagaagatggcaagcagaaactggagaagaaggatgaagaaatcagtagactgaaaaatcaaattcaagaccaagagcagcttgtctctaaactgtcccaggtggaaggagagcaccaactttggaaggagcaaaacttagaactgagaaatctgacagtggaattggagcagaagatccaagtgctacaatccaaaaatgcctctttgcaggacacattagaagtgctgcagagttcttacaagaatctagagaatgagcttgaattgacaaaaatggacaaaatgtcctttgttgaaaaagtaagtggctatatctgtttatgtttaaatatgtagtcatgaggcaggaaaccatattttcttctagacactgtgaattgtatttacttctagaccgtgtctgctatattggaccaaactttgtaaaggctttatgtttactgggtcttgaattgcagaaacactgagttggctctggcagtagtcactattctggctgattctttgggacatgttcatggattggaccaggtttttaatgtggcacctacataagggcaaagctttggtttatgcacagttccttgttctagttatat

SEQ ID NO: 6982 - DNA, 2167 bp, Homo sapiens
aagttctctgttagatggggcctgttctcaaggaagaggaaatacttcaattatatataactcctagagaagaagaacttaatttaaaacttagtgacatagtgctttatttttcatgttgtggaaatgtgaatgtgattgaacctctaacagagatgtttgtgttgcaggtcaaagttgctcagcggagcccagtagattcaggcaccatcctccgagaacccaccacgaaatccgtcccagtcaataatcttcctgagagaagtccgactgacagccccagagagggcctgagggtcaagcgaggccgacttgtccccagccccaaagctggactggagtccaacggcagtgagaactgtaaggtccagtgaaggcactttgtgtgtcagtacccctgggaggtgccagtcattgaatagataaggctgtgcctacaggacttctctttagtcagggcatgctttattagtgaggagaaaacaattccttagaagtcttaaatatattgtactctttagatctcccatgtgtaggtattgaaaaagtttggaagcactgatcacctgttagcattgccattcctctactgcaatgtaaatagtataaagctatgtatataaagctttttggtaatatgttacaattaaaatgacaagcactatatcacaatctctgtttgtatgtgggttttacactaaaaaaatgcaaaacacattttattcttctaattaacagctcctaggaaaatgtagacttttgctttatgatattctatctgtagtatgaggcatggaatagttttgtatcgggaatttctcagagctgagtaaaatgaaggaaaagcatgttatgtgtttttaaggaaaatgtgcacacatatacatgtaggagtgtttatctttctcttacaatctgttttagacatctttgcttatgaaacctgtacatatgtgtgtgtgggtatgtgtttatttccagtgagggctgcaggcttcctagaggtgtgctataccatgcgtctgtcgttgtgcttttttctgtttttagaccaattttttacagttctttggtaagcattgtcgtatctggtgatggattaacatatagcctttgttttctaataaaatagtcgccttcgttttctgtaagaatgattcctaagtgtaaaggcattcgaatattggtactatttcttgctaattacaacagcctcttatacacgtgaaaatgtttgaacaaatgatacagatctttaaacaaatgatcttagcatctttagttgtattaaaagacacaatttggaatacgggtcataaggagtatatgggaatataagacgtccagcccagtgcctcctacattctgtgtccccattaaaccacatcatcaaggatacaagtatgtggtatttcccagctcacttgatgatgatatagttttgaaagcatgcaggcattataagccatgtcagatccaaaaacatttgaacaagttcttacatccttgaatcagggtaaaaaagtttcccagggcatgcgctagtaaaagatcatttgttcttggctttcagtccaaattgatgcacaaattccgataagcaccatcatttatatttaaaagttgtccttcgcaaggtggcctctgttgttggataatgcttcaataatattaagctacttaatattcatcagctgaaagtgatatcctgactttcctcttgtttcttcagttgcttggggttgaggtctggtgcaatatccttaccgtaaatcatcccagggcccccatgtgctcaagggcatgaccccgagcagacattgttgggatcaggccatcagctttattggctgtctccagtgattggaagattccactctgtaggctttgctgggtagcatcgtgggtccttgaaagcatctctttgtattttcctaggtatgccatagctgctgctcttattacttggatacttgtttttttgttctttgtttttttttatttgagagggagtcttgctctgtcgtccaggctggagtgaagtggcatgatctcggctcgctgcaacctctgcttcctagcttcaagccattctcctgcctcagcctcccaggtggctgggactacaggcatgtgccaccatgcctggcagttttttttgtatttt

SEQ ID NO: 6983 - DNA, 1193 bp, Homo sapiens
aaatttaaggaattctgcagagataagtcagtgtcacctcagccccactttagttagaagagcctgattttacctgtgttataatggacttctgagcaagatttcattttaaaaaatgttcccctgtcaaataaaaaatgtttgaaagtatggggaatttcagttctaaagcagttaaattattacatagtacctaacacataatacctgtaccataattgtaaagagtggctggcagactgaattaattacccattaattcagtaacctaaagcttatttattgtaaacagtatgacaataccagaaatctgttgacagaattttgtctttgtctttgtttttttcattttcattttattttttaattgtaattaaattatttgtaataatttgctatattggaagatgtatttcggctttaatgaaattcacatttttgtttctttgtcacaatgtgatatttttaatttttgaaaggtgaacttaggaatgtatttgttttcttcttctctttataggtattcctagtcgtaaaataaacaacacagtcagatctgctgattctaggaatggtctaaattctacagaaggtgaagcccggggaaatggtacacagcctgttctctctggaacgggagaagaaactgttaggctaggtaagcaaagattacagaaatagaaaaagaaaaatacgtatgtttttagtgctgggtgatattgagtaattacttttaaagatttttgcctcatctccttttttatccagatttatcatttatatcttggaaaggtctcatttaacacttaatttttatttaaaatgttgtgtaatcttctatcttctctgaatctttagaacagggttgccaaaatttatctggtaagagccagagattaaatattttaggctttgtgggccacgtgttctctgtcagacctactcaactttgccattgtagcatgaacacataatggacaatatgtaacaagtaagcatggctgggttctaacaaaactatttttttttttttttttgagacggagtctcgctctgtcgctcaggctggagtgcagtggtgccatcttggctcactgcaagctctgcctcctgggtttacgccattctcctgcctcagcctccggagtagctgggactacaggcggccgccaccatgccagactaattttttg

SEQ ID NO: 6984 - DNA, 1370 bp, Homo sapiens
ctttacaagataaaattggacttcatttagtatctttttaacagaattacttggaataatgagatacaataatcatatctcttttgacattttggaaatttttttaattttacaagtacatttaacagatcatttataaagcaggagtccattttaacacttaccgactttttttggtttggaaacatattaccacgtcttaataggatggtgcccatataggtgagcatccctttagatcatgggaaccagcagactgcattcctaatcttcattatgcctgagacttgtcttacaatgttacctttaagtgaatcacataattgtctttggaacttggtctcccaacacttattgtgattgcaaagtgtttaccagatatttgatgaggtgctatgtttgtgaaaaacatatcatgtaattcaaaaacactattgatattgaataccagataccactatgtagtaagtcttttaggatgattttaatttagtcgtgcgtcattttctgattctcatcattgggagatcttaaatcttagcaagcattagcaatattaaatgccaaaattccattgaaactttcaagttggagcaattgtctgtgtttgaaaagatgaaataaaaataataatcaagggcaaagctttgagtgcccagaagggaaagctgtaccagttgctaacctgtcttgtttcaggagccaccatgtttttttttcagtgttaacaacaatcatgataattaaattaaaacactagtttgttcacttgtaggactgcagttctgaattttgggttaaaggttttggctgctgtaagaatgtgaatttgaatgtattttgaattgtaagagcaaaagaacgtttttgtacaattttttttcatttaattggaatgatcttcaggtttctacaaatagggtaattgtaaatttaaagcattagcatttattggtgaataatgtatatatccccattccaagaaatataagtgagtgaagttgaaataaaatctttaaaatttactatattgccagtggtttcacaacagttctcttgtatttatttatcaattaaatcaaataaaaatgattatgtcaatgcgttttcagttatttaagtaacagttctgtttaaagtgtgctatatatgtttgttcatttctttgcttcttcccataatttaaaaaaaatggggggagggagaacttaatatatgtggaaaataagttattatcaatgaaagaaaatattaggcaaagcataatttcaaaattactaagattgtaattatcttacacccttcttcctctttatgacagttatgtgaaagttgggtgggcaagtaagaaaatgaaagaaaaaactaga

SEQ ID NO: 6985 - DNA, 1415 bp, Homo sapiens
tttttttttccttacacaaaatgattttaggactttaaaaatgatccacttacctatataacatgttaggaacattgtggcataaagtgaaatttgcgtgattgttaattgttgctgttaacaacacattaaaaatcagtttgctatttttgatgttccttttctcctcctgataactatttagataggtagagcaggtgtagtccaggtttgaaatgagggagatataactggagttcaacttcttttcagccactgtgttttagccagtttatgggagatttgagggtactgcaaagatgtctttgttgtgtcttgatgtgctgtgagcgtaggttttggatagtggaaaaacattctttcctatcttttataactgagcaaagttcctagtaggtttgcaaaggtatcatagcctgaaaaaaggttgggagacctatcctttttgcttgccagtttaatatagaactcaaatgttccttctgcagaatagaattgaaggagttataaatactgattacttttccttttcttaattagattgttcagattccattctgtggggaaattgactgtgaggactggatcaaaaagaccactgccaggtaaacctaattaactggcaaaacttttgaaaaattgcaatggaaaggaatagcaatttgcagcataaatgagtggaattcttatttgttattaatttcagggatcaagatcttgaacctggtgctccatccatgggagctaaaagcctttgcatccccttcaaaccactctgtgaactgcagcctggagccaaatgtgtctgtggcaagaaccctgccaagtactacaccttatttggtcgcagctactgagggatgaacgaaagccccctcttcaactcctctcactttttaaagcattgatattagtatcttctcagatacagaccgttttatgattttttaaaaagtaaaagttctaaaatgaagtcacacaggacaattattcttatgcctaagttaacagtggataaaagacttttctgtaaacaactccagtaataaatatcatgaactaatatggtttttgtattcatttgtttctgaaaaatgtgcattatgtactatgaggaaatttctacaaagagatgaagacaattgaaagccagatatctgttattgatctaagcactcccaacatgtctcagaccctgaaccgccagttataccctacactgataggtctcgaagcactttctttccatagctcctaatacagaatctgaaattgtcctaaatctttctgtttaaaaaacaaagcaaacccacaaatggaaaaagcaacaataataaagatttcccttgaacttctgtctttctctagttagtatcaggtctttgaaataagggttacagtttctgtctgaaaga

SEQ ID NO: 6986 - DNA, 1193 bp, Homo sapiens
ttaacaatccttataatcataatgcatgctaaagataagagtacccagaatgaggacttttcaaccagagaataccactgtatcaggaatgagtcaaaaatgtgtcatgttactgatcccctcagtggcttgtagcctcaaaaagtcttcgtttaaccccattcctatgcaaatacgttttctggatgctattttgtgagaaaagttgggaatgctggtctagaaactactctgtttctccatgaagaacttctggggcagtagattttttttttaggtttatgccttcttactggaataggtttctacagtatctcagcagtattacctgttttttttttttctcttgttttttttggctttgcctttgttttttgggttttttataatttatggtagctaaagccatgaattacatctgtatattcaactggagacattcatatatcattttaactgccttttttatcttatagggagttcccattagacttgaagttgggccacgtgatatgaagagctgtcagtttgtagccgtcagacgagatactggagaaaagctgacagttgctgaaaatgaggcagagactaaacttcaagctattttggaagacatccaggtcacccttttcacaaggtagtttcttaaaattgcttatgtctctctctccagatcttccaccacctttgagatctttaccaaggaatttttggggttgccccaattggaagcaattgttccctccctctgaacccccatgctacttaatttgccactctctgggttttttacttgtattatggttatttttctaagtgccacctgcttcctactaggtttgcaacaatgaagtttctgtcccctggactaatttgggttaatttaaatctaggcttttatgagatataaatgtgagggcttcaggcattgactgtcatctgctgggtacacattggcagcacctgggaagctttagtaaataccagtgccttcctagagatactaatttaattggactggagagggcctggaaactatactgttaaaagctcccccaggggattataatatagccaaggctgagaacctcctgactggggttgggaatgagggatagaggaaggccttagggccgccctcacctatggagagagtcatttagaatcatagatctcaaggtagtcaaggcaga

SEQ ID NO: 6987 - DNA, 1730 bp, Homo sapiens
actatgttccattatttttgttcaggttctgcaattttgttatttaaaatgtatgtaacacctgttaaaagcaaaatcaaattaattcaaatgttcatggatttaagtaactgcttattggaatgttattattaaggaaataggctcttttaaatttttaggtgaaaatacttctggactttaatgtgtagaaaaaattatttttcaggaaatttgcattttgatactgtatatctttcttaacatttattttctcttatattctaaacatatatacattttaaaaagttatttgacttctttttacattgcttcattgaatatctttcttaataagttcacactggctgctttaaccttttcataaaaagaggtttttattgttcagattgcttttcccacacaattagtcttaagtagtgcagttttatagatcttaatgaataaatgtaccctaaatttgaacacatttacatttaaaatgttacaggtcttgcagatacttgacttatatgctcaggtatatgaagaactcctggcaattcctgttgttaaaggaagaaagacggaaaaggaaaaatttgcaggaggagactatacaactacaatagaagcatttatatctgctagtggaagagctatccaggtatcaaactgccacacaggattcgtaggtcactgtaagcacagtccatggacagatccaataatttcttctgtcatcacagaagtagactcttaaaaaataagtgtttcatgtactttcgtataataatttcaaacaaatctatcccattcctctgtctccatggttcgttaagtcatagtatgtatcctgaattactactaaaatatgaattcctttttaactgttgtaggtaaaattactgctataaaaggggctgcccagagcaaaatgcttgtaaatagtattttttgactaatcttaatctcttattatggtaattatgcttataattaaaaaccttatttaatgtaaaaaaagggagaaaaaaagtgtagtgccattttaaagcatgtgatcttatagtaatcattttcaagggcataataggttattaaaaatgaagcttatttttctctctctattttagggaggaacatcacatcatttagggcagaatttttccaaaatgtttgaaatcgtttttgaagatccaaagataccaggagagaagcaatttgcctatcaaaactcctggggcctgacaactcgaactattggtgttatgaccatggttcatggggacaacatgggtttagtattaccaccccgtgtagcatgtgttcaggtaaggaaaatattcctgtttatcactcattttataaaatacaagccatatttactaaaggaaatttgaaagggtgattttctgaatatcattcaggcagatttctctgataataaaaacaacgtggaatgcagtctggaccctagtgttttgtgactgtgtgtattatttatttattgtttcttactcttttaatttttaagctacttatataaacatttttagaagtcattttttaaaaacggtttatagtatgttaaatgagctgggcatgcaggctcacgcctgtaatcccagcactgtgggacgccaaggcgggcagattgcttgagcccaggagtttgagactaagcctgggcaacatggcaaaatctagtctacaaaaaattagccaggtgtggtggcatgcactgatag

SEQ ID NO: 6988 - DNA, 1175 bp, Homo sapiens
cacttaggaatatgatcttcagattctataaatgaaacatagtatgcttaagactgatttatgcaaactctgaaatcttaattgcgtagttattacatatgattgcaagtaactgccaaatgtttttaaacatagtaattcaaattttataatgcttgatgcaggtgactttaagttaataaatatatacatgttcctcatcaattgtatgtgaatctgttctctagttgattattagtatctcgatgtcagtgattatgttgtatttattaaccaatatatgtctggcatgttagaagctcaaataaatgtttgatttggaatttttccaaagaaaatttcttatccatttattacaaaataaaacaataaattattttataataatataaaattattatagaacaaaataatgaatttatggcagctgtggttaatatttctttgaatacttttaatcttatatctagaaatgcagatggaaaaatcatatctcttgatgcaaagttgaatttggaaaacaaagactacaagaaaaccactaaggtcacttggcttgcagagactacacatgctcttcctattccagtaatctgtgtcacttatgagcacttgatcacaaagccagtgctaggaaaagacgaggactttaagcagtatgtcaacaagaacagtaaggtaaccttccaaagaaaccatatttcaccttttaaattttcctttagaattaaaaaaattaattttatatatttcggatcctcagataaaatggataagatgtgtagaattttatttaaatcaaatgatgtaagttggccgagcatggtggctcatgcctgtaatcctagctctttgggaagccaagatgggtggatcgcttgagctcaggagttcaagaccagcctgggcaacatggtgaaaccccgtctctacaaaaaaaaacaaaaaaaaaaacaaaaaaaaaaacgatgtaagtaatgtttccattttatagatgataggaagtgaaacacagtgaagttgagtaacttacctgaggacaaacagtaaatagtagagttgggattcaaatctgaccctcgtatttaagccttacgccagcatgcctttcacctaagtctattacatgcttcttgcatcatatttcatatttatagcagggaaattatttcttc

SEQ ID NO: 6989 - DNA, 1257 bp, Homo sapiens
cctttccccagttatagagtttacctgaatgatatgttttcctataataccaatttattaaatggtcactggaggcaggttttttggtcatataatcttaagtttatgaatgaaataaacactaagtaggtattggaaaatgtgaaggtttcctagcctcttatctttattcagaagtatggcagtgtattcaaagagagggcaaatgattgtcagttctcccagtaatgaccagcttttccaaagtaaatggaaaactccatcgtgagatcagctttctcagctggaaatttggaggctaatataatgagtatctatctgttttttcttttttgatctaatatcatgtaacttccacaaccattttcaggctaaataagactgatggtctatgttacatttgcttaaatgcagtatcaagggttgaaaatgcacgaaaaaatgcaaaagatatactgatggttattttggtttcttactacaggttatcttggaagatgttgcaatgttgcatatcaaaccagatcaatttacttatacttcggatcattttgaaactataatgaagtatgcagagaagctaattcaagaagggaaggcttatgtggatgatactcctgctgaacagatgaaagcagaacgtgagcagaggatagactctaaacatagaaaaaaccgtaagccacattgttttatattttaattgatattcttatattgtgcttctttagtagaacgtgatttcttttttgtgaaagctgctagtttttttgtttgtttgtttgttttgagaaggagtctcgctctgttgcctgggctggagtacaatggcgcgatctcggctcactgcaacctccgcctcccaggttcaagtgattcttctgcctcagcctcccaagtagctgggatgacaggcgtgcaccaccacaccttgctaatttttgtatttttagtagagacggggtttcaccatattggccaagctggtctcgaattcctgaccttgtgatctgcctgccttggcctcccaaagtgccgggattacaggcatgagccaccgtatctggcaaaagctgctagtttaaatacatttgggtatatgactcatttgtcttagaaatcttttttcttcctctatctttatgttcttgttattttattaacatcacaactgcatgtgaatatgcccttagtatctcacttattatgtgtagtcttttgcattgtattcattcaatttgaaggattccttctgca

SEQ ID NO: 6990 - DNA, 1203 bp, Homo sapiens
gagtcaccacacttggccagccttgatttatattaaatcactgttattctcaacatcccagttatattttcatatttgcacctctgaatagacatgtaaagaacaaattagcagactgggcgtggtggctcatgcctctaatcccagcactttgggaggctgaggcaggtggatcacctgaggtcaggaactcgagaccagcctggccaacattgtgaaaccccgtctctactaaaaatacaaaaaattagcctgtcgtggtggcagccacctataatcacagctacttgggaggctgaggcaggagaattgcttgaaccctggaggcagaggttgcagtgaaccaagatcacaccattgcactccagcttgggcaacaagagtgaaactgcatctgaaacaaacaaacaattaacagatctattttttactatagtagaaaatacatggtaaatataataaagtttccatttttacatttcttcataagtctcatgacttactgatttgctagagcagcagtaatattttatctcgtgcttatattctagaaatgtgatattcacagatgtgaattctatacttcgctacttggctagagttgcaactacagctgggttatatggctctaatctgatggaacatactgaggtaagcaatgaacattttgttgtgtgtgttttgtcttatgcttctgtttttttatgggaacctcatcatttattgttggcttatgaactattctacttaaggatattaacagagtgttaattatatagaccaaggtacagaatgctcatcttgtttttttgtcacaaaaaaattctttttttgtaattcctaagtttgaacctttagtcccctaccagctgtacttttgggagcatttagtgccatcttggccttcacagattcctagcatttcatagccagatggggctgtatagatcatctcatccaactttcttactttacggataaggcagcaggcctagaaaagttaagtttgaacagggtaacacgcatagtttggatcccattttcttttctttctaagtgtatgccttgtttaattaattatttcagtagtaaattagctttatatacaatcatgtgcctcttaacaatgggatgcgttctgagaaatgtgttattaggcagtttcatcattctgtcaacatcatagagtgtacctacaaaaac

SEQ ID NO: 6991 - DNA, 1107 bp, Homo sapiens
aggttcaagcgattctcctgcctcagcctcccgagtagctggggttacaggcatgcgccaccatgaccggctaattttgtatttttagtagagacggggtttctccatgtcggtcaggctggtcttgaactcctgtcctcaggtgatccgcctgccttggcctcccaaagtgctgggattataggcatgagccaccatgcctggctggcactatactaatttctttttgtctccgaagggagaagcagattaatttcagtgtctctaactgaaagctgaacaaattcaaaaccagttggatatgctagtgaatggattctggattctgatttgttgctgctctgagacaaaagactacattttctgtctacagactactgagaaaaaagttcactccttgtaggacttaatattggtttgttgactcatcctgattgctttatgattcaagttataaatactgcattgcttttaaagataaaaaatcttttcatattatttataggagctttgctggcagtagaacacgtgaaagacgatgtcagcatttccgttgaagaagggaaagagaatattcttcatgtttctgagtaagtgttttcatctttttattttcagtactgattggctttttcttttttttagagtttttttagagacagagtctccctcttttgcccaggctggcatgatcatagctcactgtacctagaactcgtggactcaggatcctgccatcccagcctcccgagtagctaggactgcaggcacatgcctccacacctggctaattaaaaaatgttttttgtagagatggggtatcactgtgttgcccagcccagtttcgaacccctggcctcaagccatcctccggcctcagcatcccaaagcactagggttaaagacgtgagccaccacgtttggcctctgaatggcatttaaagaaatattcggcatcgccgggcgcggtggctcacacctgtaatcccggcactttgggaggctgaggcaggcggatcatgaggtcaggagatcgagaccatcctgggtaacacagtgaaaccctgtctctactaaaaatacaaaaaattatccaggtgttgtggc

SEQ ID NO: 6992 - DNA, 1175 bp, Homo sapiens
tgcagccataaaaaatgatgagttcatgtcctttgtaaggacgtggatgaaattggaaatcatcattctcagtaaactatcgcaaggacaaaaaaccaaacaccgcatgttctcactcataaatgggaattgaacaatgagaacacatggacacaggaaggggaatgtcacactctggggactgttgtggggtggggggaggggggagggatagcattgggagatatacctaatgctagatgacgagttaatgggtgcagcacaccagcatggcacatgtatacatatgtaactaacctgcacattgtgcacatgtaccctaaaacttaaagtataataataaaaaaaaaagaaataagcgtttaaagagatgggagtaaagactataatttgtacatttcagcagcatttaaattttaaaaataaatttaagaatcaagttttttttttttttatctgagagagttcaatgttaatgaaagtcatcaggatgactccatgcttcttgccaaagaccttattttcccaaggaccctcttagattatttcctagcccttctacagactctaagatctggcctgcctgcccacttcctatctatttcccccattctttcatccaggtttccaacctgctgagagaattatgaaatgggacacaatttgatctacatccctagccctgatctcttctcatctgattgtcccctagatatcattatgatgacatccctcaggtatctcaaatttagcgtgtccaatttgagttcatcctctttctacccacctctggatgtgtttctctccctgttttactatcccactaatggcaccaccatttttctaactgatccagccaaacacctgaaagtcatcctagactccttccttcctcacagcctatcactctggtcctacttatgtatcttctgaatagttttttgttttttttttttttttgagacggagtcttactctgttgcccaggctggagtgcaatggcacaatctcggctcactgcaacctccacctcccgggttcaagcgattctcctgcctcagcttcctgagtagctgggattacaggcgcctgccaccacacctggctaatttttgtatttctagaagagtctgagttttataataataattattttacactataaccaaaaaaag

SEQ ID NO: 6993 - DNA, 1166 bp, Homo sapiens
tagagaccactcaaagatgttttaatatattttgttacttttgttattaaagtttatggatatgcttcaataacacattttggctttggtgatttaaatgtataaaattcacaaattcctatttccttttcttttcttttctttttttttttttttgagagggagtcttgctctgtcgcccaggctggagtgcagtggtgtggtatgatctcggctcactgcaacctctacctccagggttcaagcgattctcctgcctcagcctcccgagtagctgggactacaggtgcacaccaccatgcctggctaatttttgtatttttagtggaagtgggtttcaccatgttggccaggctagtctcaaattcctgacctcaagtgatctgcccacctcgacctcccaaagtgctgggattataggcctgagtgccgcgcccggccaagtacctagaatttcaatgtagaaaaagaccaggctatactgagatgtttttatatatattgttttgccagatattgtcataagagaaaatgtcttgatattttaattgttcaaaatgatactttataggattgtctagtggacgaagatggagttttcacagatgttgcaggtcctgaacttcaaaacaaggctgtccttgaagagggaactgatgtgggtgagcatcatatctgttgatatcatacatgttttctgaaaagtaggtagcagtaacctttgctacctattttccctccttatactttaacagaaacaaaaaaataaattatgtcttgttttgccatatgttttaaaatggagtttgggactttttcatcttttgctttgaagctgctttatttaagcaagtcagggcagtcaacagggagtgaagttattttagggctatggagataataatcagcagtattacttttgtggaaggatacaatcaagatcagggctggatgttgactgtaaattacacattccctactcactttttaacccttgtaaataactgacctatatggcatgatttatgtattagaatcttgggaatcctccagccttgaattgtctttctgtcttcctttacagattcagagaccaagtgctatgaaaacctttctttgcccacactaagactaaggctatttagacctgatatattacttttcta

SEQ ID NO: 6994 - DNA, 1190 bp, Homo sapiens
ccaggctggtcttgaattcctgacctcaagtgatcctctcgtctctgcctcccaaactgttgggattacaggcgtgagcaaccacgcccagccaagttgactactcttttattttttgagacggagtctcgctctgtcacccaggctggagtgcagtggcacgatctcggctcactgcaacctctgcctcccaggttcaagcgattctcctgcctcagcctcctgagtagctgggattatgggcacacaccaccatgcccggctgatttttgcatttttagtagagacgaggtttcaccatgttggtcaggctggtctcgaactcctgacctcgtgatttgcctgcctcagcctcgcaaagtgctgggattacaggtgtgagccactgtggctggcaaggtgactactcttattgccacctgttgctgcagatttagtattttctggaagtttagagcatttttaggattttcacagtactttttaattatgtctaatttggtgtttttttttttaaagttataaagatgcttcagactgcaaagaatttgttgaaagaggagaaattggtgcatagctatccgtatgactggaggaccaagaaacctgtggttattcgtgccagcaagcagtggtttataaacatcacggatattaagactgcagccaaggtataaaaagcatcctgttttaacaggtcgggcatatcattccctcagtataaaggggctgcatgtgaggttgaggtggggtttcaggagtaatagggattgctgctattatgatttagtttcataacattgtagaattttagatctggaaggaccttggacttccattttttcattatacatgtgtgagaaatgaggcataaagaggttgagtgatttgtccacatcacactgttagtagatagactttcttgcccagtgtagtcaaagttgcatagaatttggacagaactgtgttacctagtttaacctcccactgcctctgtttcctcatctatataaagtggtaataatgcgtatctcatggagtaaggaaattcgagtttccagaatatggtctgatacataataagcagtcagtaaaacttttttaaaccctttgcttccttaagattgaaattacaatcaattaaaaaagttactgttctgcttacaaaggaagcatattaaaaagaaaaa

SEQ ID NO: 6995 - DNA, 1601 bp, Homo sapiens
taaaagtatatacaacttttaaaaagtgcaaccctggctaaattccactcctttggttaatactgaagataaaatataaacaaatgtcaactctgttataattaatacagatgttttactgtttatttctaattcaaacacttaagtagctttattgttaaactttgctatttaaaattggttataatttagattatgttcttataagattctatatttcctatctaaaatgttgttgtaattcaatttaaatgtgttcatgtacagtccccatcagtagcgtatagaacaccccactctcctttagtaaatgttgagaaaatgcctttgttgtcatgctccaaatcccacactgggctgccacctgggagttctggataccgaaaggttcctttcccagaggttctgctgttgccatcagaggaggatgaccgtgcttgaggaggaagaatgggttcaagatcatcatattcatcagaaggggacactaaatagaacccttaacctgttgtacttgccaaaattgagaatcagagatgtgtaaaatgcagcaaattaattataatgtaagttaagatttgctttttgccaagttgcaaagttgtatccacatcaggtcactgtaaaaatgtattatcttgtaaaacttatgtaaaaaaaaaaaaaaaaaaaaggcaaagatactaaaaattttaagtccgactttatttttcctacaagtgtttagaaatgcttctgggatttgctaatattatctgtccttgggaacagtattgaaaaaactgcttagtggtattacagctttagcaaacctacctcacagctgggatgagaggataaaatacaactaattttgtaccctatagtgcctagagcagtccaagtgctaaataaatatttactgattaaaaccaaactatagctactcgggaggctggaggaggatcgcttgagcccaggagtttgaggccattctgggcaatatagcaagaccctgtctcgaaaaaaaaaaaaaaaagaaaaaaccaaactaaccaaaactctgtaaaagagtgctttgagctctacaaataccaagtatttattgtggtatatttttagaatgtagccatacagtgtaattatgggtatctgtcatggatcacaattattattcatagtaagtcattgtgatacagaagtttgtttcttcacttccccttaagaagccaactatagtaatcatgcaaagttgaggagtatgtccttcagggatataaaaagaaaaacaaatctgttttttgagctaaaagagcacatccaaacaagaatttaactggctaaaatttagtaattactgttaagtaactatcaaacttgaaatcttacaagataaatggttaagatgtcttgagtatttgggatgggggcctgtgagtctgattgagacatacattttacagagtagcagcactggaaagggctagtccaacctcccagcctctgcttgggtctccgctgccccagccacacacatcctagaattcttgtaaacatatctggctctgtgttaacagtcacttgttatatgttttctaagagattagttcttcctgtgattt

SEQ ID NO: 6996 - DNA, 1099 bp, Homo sapiens
ggtacccagctactctataaatttgagagaccacagtatgccgaaattcttgcagatcatcccgatgcacccatgtcccaggtgtatggagcgccacatctcctgagattatttgtacgaattggagcaatgttggcctatacacctctggatgagaagagccttgctttattactcaattatcttcacgatttcctaaagtacctggcaaagaattctgcaactttgtttagtgccagcgattatgaagtggctcctcctgagtaccatcggaaagctgtgtgagaggcactctcactcacttatgtttggatctccgtaaacacatttttgttcttagtctatctcttgtacaaacaatgtgctttgaagatgttagtgtataacaattgatgtttgttttctgtttgattttaaacagagaaaataaaaggggtaatagctccttttttcttttctttttttttttcatttcaaagttgctgccagtgttttcaatgatggacaacagagggatatgctgtagagtgttttattgcctagttgacaaagctgcttttgaatgctggtggttctattcctttgacactatgcacttttataatacatgttaatgctatatgacaaaatgctctgattcctagtgccaaaggttcaattcagtgtatataactgaacacactcatccatttgtgcttttttttttttttttatggtgcttaaagtaaagagcccatcctttgcaaggcatccatgttgttacttaggcattttatcttggctcaaattgttgaagaatggtggcttgtttcatggtttttgtatttgtgtctaatgcacgttttaacatgatagatgcaatgcactgtgtagctagttttctggaaaagtcaatcttttaggaattgtttttcagatcttcaataaattttttctttaaatttcaaagaaaaaaaaaagaaaaccagaaaacaacaacaacaacatgaacaaaaaagaccccacaaaaacctcattcagaggtcagcaacctcaaagactgaagatagatagcccccaaagatgagaaagaatcaatacaaaagcactgaaaactcaa

SEQ ID NO: 6997 - DNA, 1137 bp, Homo sapiens
aagagagtcaaaacaggatggaaaagagaaagacctagatgagaagagcaaagtcacagaagaggagaaaaccaaggaggagaagccagaagccaaaggggtcaaggaggaggtcaggttggcctgagcagacctctccagctctggcttcttgccaagtcccctgcctttctccaccaacacctcagattttatgctttctatttctctgtgtatttataggaaagtttattaaatataaatatccccagggactagacagaaaccaaggccctgagcccagggcagctatgctgggtgaactcttctaggagctgccttgccacccatccttccatccttccccagttcttaactttgaaccataaagagtaccaggtttgggtgaaagggatactttcatgcaaccataagacaaaatcctgaaaatgccaaatgcctgcttagtagctttggaaaggtacccttattgaacattctagaaggggtggccaggtcttcaagggtctcccgttcttttcaggctgctaatgtaacatcagccatttttagattggctctgtcctcataccttcccagtggcctcaggtgagccaagaaactcacactgcctgccctttgtcttcccctaattctgcaggtggaggttggtggtctagtttcctttttgagataccgttttcatttttgagacctttgtaataaaatggtacatttctatacaaaaaaaaataactgtttagaccccatctctccccactgcttgtcacagtggaaagatgtcttttgttgaagacttcactcactcatctgtttgctgtatctggtgactaccttccttctcagtatctcaccccttcaaaaaggctctctcctgtaaccaactgaaccttatctctatcgactccttttcctcagcttttatacatacgtgaatctcttccactaaaaaaggcatccttcaacctggcaatcccctttcagtgctgccatcttgctcctcctttgtagtgagcccttttgaagagtatctacacttaaaccatcacccattcctcaccaatccatttactttctggttcctagtgccaccactccactgaaacttcccccagcaaagtcccccatctctgttgc

SEQ ID NO: 6998 - DNA, 1996 bp, Homo sapiens
gtaatgcctaatgtggtctgcctgtgaatctccccatgtagaatttgcccttaatgcaataaggttatacatagttatgaactgtaaaattaaagtcagtatgaactataataaatatctgtagcttaaaaagtaggttcacatgtacaggtaagtatattgtgtatttctgttcattttctgttcatagagttgtataataaaacatgattgcttaaaaacttgtatagttgtctagatttctgcacctgaatgtatgtttgatgctttgatttgaaaatgttcttccctgttatttacattctggtgggtttttaaaattcttacctccatcatgcaattttgaaaattgtgtccagaattaaaagtgcatagaaatagcctttacaattgtagcatggacctttaaaaattgttttaaaatcttatttaaatttaaaccagaagctgaaaaatagatcagctttattatacacaaaattattactgcttatctttgctcttttccttgttatcccgcaaggtttagttgagaagatacaaaatgtttacagtgttggcacttagagtttttaaattcaagtacatgaaattcagtaatagcattgccttgagctaactaggaagtaccgggaaaaaagttaaatctacatcaagtttcttttgaactttgaagtgttttctgacccactgctaactgtagcaacaaaatttaaaagaaaaaaaacatactttatctggctattataacataaactgtcacgtaggtttgctgccttcagaataccgcaatttaattgcgggaatataataatattgggactgtttcacagcacaaactcatctttacagtgttgatcaatgcatcagttaagaaataatgccacctcaggaattaactggcattgggaacatttgcctcattctcctgctatcctcttcattcacccctgccactgtaatatctataagtacttaagagacttgtgagcaaaacatactatttataacagtatatgattgatttatgcttatgtggttgttcagtttgttcccatgtaactcgtttgttttaaatattttgccagatttcttgtatttattccacatcattatgcctataatgtgccgctttgtgattgggcatttgcctacttttctttcataattagtgatatatgcgatgtaaaaccactagtaaaggtacattttaatacttgttattttatactgaattagccttggaggttgactgtgcaatgttatttactgttgtaattactgtaataccaacatatgggccccatctgcacactcctgaaaaacagaaagtgtattcaaattttatcagtttaaagaaaataaagctgtgataaatactgtaattccaacctacattagaaggtctaagtgtaggtgatgtgccattccataatggcttccagactagggtgaattttatgttctgtactgtactgtgatgtagctttcttctgtaacagttatgttttaaaattaagtgagttttttttttgccttagcaaagggtggtgtttgaaaaaaaaaatgtgtagcccctttttaacctagtgttcattcaaaaaaaaattgatgcaaatctttattcactttcactggtgcacactgaaattttacttgaacagttctcataataaagcacttgtcttttgctctttatcagaatgtgaattacctgttttctggtacaaaagtattctgtatgaggagtttattgtatgtgttctaaatttagttggcaaagggtgaagctgtgaaggttttcaagattattgaaactatgaaggtttcttgtcattatgacaagaaagtttaatctttttataggaattcctgtcactgaaatacgtttttaaaaaaatagactcatgtgttttccacggtagaaactgatatttttttacattttctcactgtggccaactcttctgtgtttgtagaaaggaatttgacttca

SEQ ID NO: 6999 - DNA, 2064 bp, Homo sapiens
aataagatcataattgtttcctggcaaagaacaattgttacagaaagatgttgtataggaggttgatttatttggttattaactggtatgtggaacttaacattttcttctcctcactgatttgagaaactgtagatattttaatgaggcatataattccagatcgtcatggtgttttctggttatgttaagctaataaccgtctcttcttttacagagattcctctaatggaagaagatccctaatatgggtcaagatccagatgactctcctgctccttcggggaaaggaccttgtatcttggagtgaggtcacagaaggatagagcctgggggcaaaatgtctaacttgtctacatggggaccacagttcacattatgcatctcaggctccacagtgaggctgacaaactgcaatggcagtgcttttaaatgagatttgaggattcaccaagacccatggggaaccggggcagcagggaagccctcgcgtggtcttggatgaggggtgttaaatgtgtatcgtgctgtggaacatgggacaattccacgcacatcccaccgaatcatcacgcatcccattgactggcaagtactccccgccccctctgaaagcatgtcacatcatgtaaatttgcttctaacatctgcttcaaactgtctctggactccaaatttggatgggtcagcctctgcagaaagtttgtgttgagatgctggaagaacagcagagcctcctgcaccctcagcaagggaccagctcccaaaggaaaggtccttgtgtgacatttggagaatcttccttcatccagacaactctactcgaagcaagacgaaagcaggatgtggcagttgcagtgagaaaggaaaggaaagatgggcagactctgctttctggaaatttcttcacaaagtagagctcatgaactctgtgctgtcttctggtaacatatcatcagtgtttgtattcatggtgtggcacatggatccatggcattgggtaaatctggtggtttttacacatggtcagaatgtgttcaaatacatctcatgatggagacagtaaccaaggtaatgttttgtttcagcattttaaaaagactccacttaacatttatctcagaatcatgagcctctctctagttgacaattgtcattgttcccccagccccaaattgaaccatacatttattttccaaaacagaaattgtttctgtaaacatatccgaccttcaaaagaagtgtgaggttggatttttcccccttttatttgtcctaagattccaggaggctggcctcccagcccagatagctcagccacctcacctgcctatcattcctgcattcctactttgagggtctcatcatgcccactgggtgttgttcctaagaaactgattgattaaaaaatttcccaaagtgtcctgaagtgtctcttcaaatacatgttgatctgtggagttgattcctttccttctcttggttttagacaaatgtaaacaaagctctgatccttaaaattgctatgctgatagagtggtgagggctggaagcttgatcaagtcctgtttcttcttgacacagactgattaaaaattaaaagaaaatgacagtttgaagcgtgactttaatagtgcagtagagtcgggtgggcaggagtggggtggtgacagtgatcatggatgatgggattcaatgtaagattaagaacaagagatggaaggagataacacacaggcaatgctcaccttctaaatggaggttgtctcagagaccactgggcaagtgcctcattttctactaggcagttcagaagaggcatgaggggctatctctgatattctcccctacaaagtagacagcagcaacatcaagctgcctgactggcagaccaagtacagggttgcctctccagcccgcagcacttgtgaagacaggtagcacagtgtcttagtccacttgtgttgctatatagaatatctgagactgggtaatgcataaagaaaaaaggtgtatctggctcacagctctgcaggctgtacaggaagcatggcaccagcatct

SEQ ID NO: 7000 - DNA, 1145 bp, Homo sapiens
tgctgtcagaggaaatcacgggtttgcacctgctccctcacctgtgtgctcctctgtggcttccttgtggcttcgaaactaggcacacttcagatttcttatgtgaagccatttttttttttcagtgaagtttcacagttgtcatcacatgcattttgtattccttcagggacatcctaacgtagtgactcagagatggaaagcaggtgagagcccctccctcagcgctgctgggtactattgatcttaaatttgatctgtcagcacatctctgagtaggtaaacaccatgctccatcctgctcacaaacaagcaaagccccagcctcatgatcattggcttccttcagtagacacatgtgttggccttctgtgttgttacaacaaaacacaagtggaaaatgtaatgtgctgtataatgtttattgattttccctgagctaaaagcaaagtttcagacgtagtcatggagatggccaggactttggtacagagggttccgtgcaacttcctggaatcattacccaaatttagatcagactggggatggctggtgcaatggcagttttgatgattagaattcagcagaactcctgcaggcagaggttgggtggttctgtacaatatgggagcagagtccctgtcttcctgttccctctcagagccacatagacaacatgctgggctgtcttgatgcgatgcctttgcactcagtatacaggctcactggctttcctgccacttctccacgctcctcaaggccaacttgagacttgagaccgtagcattaagagtcagctttactactgagctcagctacagagtttcctcatgatctggaacagcacttcacttcccaaactgcactgtgcatgtgaatcacctgggaatcttgctgaaataaagtttctgattgagtaggtgttgctagagagtaccaatttctaataagcacttagttgatcccaaaatggacagtccatggactgcaattcatatagcaagagtccggtgaaaggtgaagacccagaccagataccatgacaatttaatttgcatactggctccactgaatgttgtaaaccatccatccttagcacgtaggggatggagggggtctcctgaccattgcaactgtggggacgg

SEQ ID NO: 7001 - DNA, 1317 bp, Homo sapiens
tgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcacaccatgccatgttttccttcctggagggcagccccacaggacggtttatgagcacacaattatagcttgtttctactttaacaaggtatgctgcctctgtaaattcatgtattcaaaggaaaagacaccttgcctataattaaaatgtggaactataaaattttttaaaatccaattcagaaactttgataatctgaccataacataagggaagctctaatttctactgcttgctgatctgctgttaggcagcacagagacgtatgtgcctctcaggaagttccctgctcgaccttggccagctcctcctggggtaggtacaagcaagggagctgagaaaacatgcagatgaagtcactggtctggtgcttgtggttcttgatgaatcatttcctcaagatgacttg

SEQ ID NO: 7002 - DNA, 1185 bp, Homo sapiens
taggtatttaggtgtgcccttctttttgtttccagaaaaattctgacactggtattctcactggaagaggggcaaatatagatacattttacagcagtaaatagacttttatttggaaatggatgggtctgatttttttaaatattgtttgtaaaattataatttaaaaatagcctgtattgaaaactacaattaaaaaaaaaagactaggctatttagaaagttgctttttaatattttctttgtatattcggagaatcatgaatattagtgttagaagggactatgtgatctaatatagattttacagaaacttttggaaccacagaagttaaatggtgcacctgtggccagcgtggagcccactggatttagactgctgagctcctgacagctggctgagatgcattgccttttgtagtattccaccctggcttgactctgtgtgtgtggaaaatctgtgtgacttcagtttctaagacgtgttttaatgaaaaaaatttacctgagatactaagcatttgttgtatccataatgtataatttgcatgaaggatagatggtgaatgatatatttatctttcttttacctgaaaataatgtggtttctactcatttgctttagaacgtccagttgcggataatgagcgaatgtttgatgttcttcaacgatttggaagtcagaggaacgaagttcgcttcttccttcgtcatgaacgcccccctggcagggacattggtaggtagtgctctgtgaatcgtgacagatatttaagcttttattttgtgctgggagtagtaggtggcacatgatgagaagccaggtaatttgagaggtgaaggagaggttaggaagtggaaacagtggagataggctgtcgaggggagaagtttgactatagttgtttaatgcaggtgggaaggagtcattagagcagggggttgaaactataagaaaggaaatacttgttaggcagggtccctgattaggtccttccacagccctgaggcagaaagtcctcttagacaagaggaaggatccctcttccataataacaggacagaaataaaactgtggcagatgtggctaaatttgtgcattttgtgggagtaagttgagggatttctcatctaaaaacatttgttttctctgaggtaggagtgatgatggaggtgggtgggaag

SEQ ID NO: 7003 - DNA, 1222 bp, Homo sapiens
tttccccatttcccccagcctctggcgaccactaatctactttttatctctatggatttgcctatttaagacatcctatataaatgcaatcatacaatatgtggtcctttgtgtctaacttatttcacttaatatgttctcacggttcattcatgttgtagttcttattgatatttcatacctttttatttgcctaaatcaatcatttctatgattcctaaaaaatggtgctagtctaactacattatttccatctacacttactaggcaacatctttatcatccattgtcaggaagccctttaagaaaactgcacagtgaagttcattttaataaatagggtttccttgctctcaagtagttactaatcttagacaaaagggtctaggatgaccacctttcttgaggtttacatgatcttccctgacttccacttgaaaggcaccctgtgagtctctctccgcctgttatcccacaggctcctccccactcctccaggtaccccttccccggcggctgcaggaggaggaagtgacgcaccggaagtgtccctgttccccttgctgtgggggtaaggaatcaagcccccaagatggcggcagcggcggaggagcggatggcagaggaaggaggcggcggccaaggcgacggcggttcctctttggcctccggctctacccagcgacagcctccaccgcccgcgccacagcacccgcagccggggtcccaggcgctcccagcccccgcgctggctccggaccagctgcctcaaaacaacacgcttgtggcgctgcccatcgtagccatcgagaacatcctcagctttatgtcctacgacgaaattagccagctccgcctggtgaggcccccgcagaactcctgcctccctctccccccggccgaggtctgggagatgagaagggagcgcgttccccgggaagggagccccccgcgagccccagccggctacagatctgggagggagccgctcccgtcccgaactctcccttggcgtcagtcagcaggagtgggctggttcccgattgcgtcctagctgcggagctggggttacttcctgaggggacttcgccttgggggctccttgccccccgcccggaagcgggccctctacgggaggggtagcggagttggtcttcccaccttccgcctggcccgagagtagacccggagaggtcatgtcgcctgccttttgtatgccgct

SEQ ID NO: 7004 - DNA, 2301 bp, Homo sapiens
ttaaaataaggtgttaaattatgatgattaacccaactgaccaaatggattgcaaagaagaagaaattatcagaagtgacatagtaagggtattccatttttaaataagtgtaagtattactggtagagagacattttaagtgactgacccttttgaattattcctccacagttccaggaccgtctgcagccctaacaacaatgcagctcttctccaagcaaaatccttcaagacaagaggttaccaaactccagcagcaggttaaaacaaatggtgctggcgtgactgttctcaggcgtgaaatttctgagcttcgcaccaaagtgcaagaacagcaaaaacagcttcaagaccaggaccagaaactgctagagcagacccagatcataggtgaacaaaatgcacggttggcagagctagaacgcaaactacgagaagtaatggaaagtgctgtaggaaattcctcagggtccgggcagaatgaggagtctcctcggaaacgaaaaaaggccacggaagccatagactctcttaggaaatctaaacgtcttcggaatagaaagtaaattggaatgtggttctagttccagaggaagacacagcttagtagcttaagcagttatgcatatcaggatactgtgagcaacatggtgtcccttaagcttctaggctttcagaacacaacttaaacttgaactcttatggttgggacattcttttcctgcttctcctgattgaactgatgcacagaatctttttactttgcaatagatttgtactaaccagacctgttctatcatgttttgaggagttaacttttttctgtgcagataatgttgaaagtaagttaatttgtttctgcatatatgcacatacatacgtaaggatcttaaacccagtcttgacagactagaagttaagtttaatacagaaaatgtcctgttcacttgaaagaaaagacctactttttaaatggacactatcttggttcttttttttttaagtcatctttttgttataagtgacctttgtctggaatgtctgaaaagtagttaatgctttttggtattgaagtaatgggtaactaaaatggacttccatagtattgactgtagaaggagcctctacaatattgactatatatttttataaactactggcaaggaacttacccagctgttatacatgttttcagttctctttgggggccatgtcctacatttgcatggatggatgcatgcattgcctagtcaactcacttaaaaagctcttgcactggtattgatcttgaacctctatacttctccactttttagagcggcgtcttagtttatttaaacgcttaacatcttccaccgcaacagcttgcctctagagggggaattgttcatccatttgtcctccagttttataggaacaagagactattaaagcccattgctttatctgctctctgtagggttcaggtacactggctaaggcagaaccccaaatttcaaggctctttctatcaatattggacctctgggagctaatactcctctttgctcaccaccatgtgatcattgatcagatgtggtgagtgagtaggggactcgacttgcgggatgcagttttgccattgcagcaaagttcattgaggaaaattgtaccatgaaaaagcattttgattatttcatttctggaggatgaccttgagggaagctttttaatattagtttcaagctttccttaccctacaactttaaacaaaagctttaattttgtttgcactcctattttgagcttgtaactggaaaagcatgtcttgcactgttcaacctcctgagtggtcgctttaacaacctccaaattgtgtacagtggttattttccccagttgtatagttttgagacattcaattatcactgtcttagttgtattttaatttactaaattatgtagctatttgactgttaagttcttttaaacaactgtttccttgggcttcagttatttaaagtaaatttaggtgtaatatagaaaactgtccctttccaggtgggagcttaacacctgtataaaacctaaggttttggtaagtaccttagttgaataaaagcacaaggttatcaccttttttatccgtccaccgtgacatggttatgcatcctttagattaacctcaccaaatgaagctttttctatccatttttaatattgtccttacataatattgtccttagattttgatcaattctatgtctgactttgaaattccatttacaatgtagtatgttttcaatgaaaaaccataaagt

SEQ ID NO: 7005 - DNA, 1109 bp, Homo sapiens
taatttctatctaattagcatgccacaatttattagtatttgtaagttcctggatggcagggatcagatgttgcctttatattctatggcgtcatccatgcagtacattctttaataatatcaagttaatctaattgtatgtatttgttgttaattttacaaataagccagatatttagtcccttggaatgtgatgggagagagacctagagggtcgagtgtattcaactgctgctgaaatgtagactgctttttgtttagaattcccacagctgctgctgctgctgcttttttttttttttaagagagaggagggaggcaggtctcatggtttcccttctcagtgtttgtgtcaaccattcatcagtcatctttgaaagaacctagtaacactcatttttcatcttgctgtattttttcccttctaggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaatggaatttttgcattattaaacttgagaccagtgatgctcagaagctcccctggcacaatttcagagtaagagctcggtgataccaagaagtgaatctggcttttaaacagtcagcctgactctgtactgctcagtttcactcacaggaaacttgtgacttgtgtattatcgtcattgaggatgtttcactcatgtctgtcattttataagcatatcatttaaaaagcttctaaaaagctatttcgccaggcacggtggctcatgcctataatcccagcactttgggaggccaaggtgggtggatcacctgaggtcaggagttcgagaccagcctggccaacacggtgaaaccccatctctactaaaaatgcaaaaattagccgggcgtggcggcacatgcctgtaatcccagctacatgggaggctgaggtgggagaattgcttgaacccaggaggcggaggcagaggctgcagtgacccaaga

SEQ ID NO: 7006 - DNA, 1281 bp, Homo sapiens
cctgttttttagacttatcctttcatcttctccacaaagcaagaaatctgccttttaagtttaagatttgatagtaataggaaaattgccttccctctacttagttgataaaccatcaaggaaccatattaatgaattatactacctccagcataagtgttttaatttcatcaggattcaactgtttcttgaatatttataaatgaaacatgggaaatattatggttgctgaaatgaatatttgccaacgcttatatttgctatacctagccctagtatatagaagtcattcttatatgtttaattataattataattggtatatctttacttgaccagagcatatgatccttaagaataaaatgaacttgtctcatgtcagagagaaaattattaaaatacatagacgttcaggatagcttacggaaatattacagtaataatttttacaagtagaaaatgtaacttttcaatagctgttgtggtgtttctttatttttttcccctctattgttcccttcaaggatgaattacaaaggctgctggggttgctaagagaccaagatcccctctcagaggagcagatgcaaggactgtgcattgaactgaatgatttcattgttgctctatcctcagtccaaccctctgccaaaagggaaggctttgtcactgtccctaatgtgacatgggcagatattggtgccctggaagacattagagaggagctcaccatggcaatattggtaggtatatcagctgccaaatattattggcatgtcatggattaaagaccagagataaagctccatgcatgtgtactaggttctgtggctaaactgacttgactataatcactgtgtctaacttgacttgaatgtagcacttctttcaagcccccaacaatggtttttcttttgtttgagatccgatttgtttatttttttaaattgatgtatcatagttgtaaatatttttgggatacatgtgatattttgatacatatattaaatgtgtattgatgaagtcagggtaattgggatattcatcacctctaatgtttatgttttctttgtgttgggaacattatactttttttcttctagctgttttgaaatatacttttttcttctagctgttttgaaatataatttccctaccgtgctatcaaataccagaacttattactcctatctaactattttttttacccgttaaccaacttctcttcattatactcatctccaccttcccttcccagcctctggtaaccatcaatttgct

SEQ ID NO: 7007 - DNA, 1119 bp, Homo sapiens
aagataattttcaatgatgaagataattaatggtttgtgtgtatgtgggggcttttatttctggtagatatccatttaatctactctaaaagtacccccataagttatttatcttatttcccctgtaatgttgtaaattcttaaaggcaaaatattttttaaaaattctatgtattcgtcacagcacttagcatgtttcctaacaaagcagatatttaccataatcctttctggaataagatggaacatgtaataatgacagcgtttgttgagtgactgaactatttgatcttatatagtatccattttgatacctttggcagacgtgaaggacttcaaataaatatagttggtgacttgtttttactattagatcaggaatcagaaattttttcccctgtcttttctacagaatacttcaaacattgtgcagaaaactgaggcttcctcaagcttttgatttctgtcacttagcacacctaactccaggctttgttggtgctgatctcatggcactgtgccgagaggcagcaatgtgtgcagtcaatagagtcttaatgaagctacaggaacagcagaagaaaaatcctgaaatggaagatttgccatctaaaggagtccaggaggaaaggctgggaactgagcccacttctgaaacacaggtgctttctctaaaggcaccttaaattgtccttttaatgttctttgtgttatcttacattgaagcaagggtcaatacaattgaggttcattactttctgttttattggcatttaatctatagaatacttatcatttatacccacgatgtttatcatttcaaaaatatgagttgttttatgtttagtttattttaataaattcattttacaataatgattatgaaattctggaatggggttggcagactgtggcctacccacccaccacgtgtttttgtaaattaaagttatattggaacacagccatgttcatttgtatacatgttgtctgtttctgctttcgttcttcatggcagaattcacacaggagtctgcagcagagaccgtggcccacaaagcctacggtgtttacagtctaaacctttacagaaaaaggttgtcaacccctatttcagca

SEQ ID NO: 7008 - DNA, 1179 bp, Homo sapiens
agcctccctgttgtcctgctcaccttgcctggatgtgccatgcatgcttgaccctctgtgctttcactaatactctttcttctacatagaattccattagcctatatatctgcttgttaaaattgtatttacccttcaagccttttctgaaatgttaccacctccatgaaccctcccttattcctcagttggaattcatgatgtcttttctcttattaccatggtgctttgtttatatctgttattatacttcacaaaatttgtctgatgccatttttttatttacacactcaatgtttctcaatagattgtgaactgctgaggacagagtttgtattttatttatcctcctcacaccttttacatatttgacatttaataaatgttggttttatatgtatgttgctgtcaaaatctgtaatactttatctttaaccatgaaatgattctgtaaccattattgccgtcagtgtcaagtgctttgttcactactctttctctgtctcttactagatctgaataatgtggctgctacagcccgggtcctagttattggagctactaatcgaccagactcgttagaccctgctttgagacgtgcgggaaggttcgaccgagaaatatgcctaggtatcccagatgaagcatccagggaaaggtatattcttatagaatgaagtttgtatgccactaagtcatcttaactgaatggtttgaaagtaagaggtgagaaataccaagtagccttttctttctctctctttctttttgtaccaattaaattgatttggaaaaggagaagcccacattaagaaaatcatttatgcctgggtgcagtggctcatgcctgtaatcccaacactttgggaggccgaggcaggaggatcacttgataccaggattttgagcctgggcaacatagtgtgaccctgtctctacaaaaaataaaatcagctgtgcacacacctgtagtcctagttactcaggaggctgaagcacaggaggattgcttgagcccaggagttcaaggctgcagtaagttatgattgtgtcactgtgctccaacctgggtgacagagggaggccccacctctgtaaaaaaagaggaagaaaacaatttactcatcagtaggataattgtttcaggttgttttttcagaagtagtaatggacttatgt

SEQ ID NO: 7009 - DNA, 1292 bp, Homo sapiens
cctgggctgagaggccagcttccccaacgaggtgccctagagccaatcacaaaacctgagtaagaagttactgctttgatggagtggtgggatggggagaagaggttccaggcatagaacagtatgtatctggctagagaatttaaaggtttttttttctggacataggtgttttttgttttgttttgtttttttttaactgagctaggttgtttttgttttgttttgtttttatttttttaactatagcctaacataggttttaagttgtacttcccccaactccccacccccagtcactcttttttagtgaaaaagtttggacatgaaagatcctaatatattctttcctttgggtatgaatgattgtcttttactcaaatgattgttcctttgtgaaccttagggacgcaagtctggacaaaccaggctctgtaggaacattcctgagaaaacattagtgacattcatttcttctttccacagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaacatgaattgagtttctgtagatttctagttctcaactttagcctgaacgccaacacttgaaggtgtttttcatcctctgtatgttgaaggtggttatttgtatgtaggaacaggactgccatcccagctttgcatgccaaagaaataaagaacacactttaaagggcaaactgaagagatgagcgagcaaaggtgcccttcaggtctactgaaaagttagagtacaaaacaacactgttgatctggacaaaagaagaaaaattaccctttttgcttgtgttgtgacaacttcatttaatatggtttaaagatttatgagactgtcagctaaaagtcttttcacaagaatgtcaacagagaatggcatctcaaaatatatatatttctttgcacaatttgtgaaaccttataagccattttccccaggtacaatgtagttcctgctgatagaaaggaaatattttgtcaagagctttcatttaaaagctactacctccacaatcacccccaaacccagaaaatccccactggctcttgccagtctggttttcgtattgcagttattccaattgtatttgatctccctgataacgtattttcatgggtttgggta

SEQ ID NO: 7010 - DNA, 4219 bp, Homo sapiens
gagattctaacatgattattcacttgggtttcttcagtattcaaaatcatgaatttagatcataatatatggtctaagacatgatacagacattgttttaatgagtatgatgaaagtttcaagaatttgctttgattttttaatgttagtataattttgtaatgtcataatgctaattttgaaactttctaactggtaatttttttctctccttcccctcttccctcccccgcccgccccccatacatttcatcttgtcttcattcagaggaatgcagtagcatggatagttgatggtgaatttggagcagacgacttctgtttaacttaaaattagtcgtattttaatggcttgggatttggtgcaaacaaacatgattgatagctggacagacatgctcgtcatgaaaaaagaaccatttctgaagcccgattggggccaaacatttacaccttgcttcatagtaaccagttgagatgaagcacgtcgttagaacgttgttggacaccatgttgaattattcccccatcggttgtgaagaactgtgctacattcaggcttacccattgaactcagtatatatatttttttccttcctgtcttttgtctggcaggataccattcttgttgctcttctgtgtaatgaagtttaaatgcttgtttggaaaactttatttaacagtttagaaggcttgatagaaagagtgcattagtctgaagagtatacattggataggaaagaatttccttcttttgtttctccaaatctttccgccttatttagcttgagatctttgcagcttggttcatggattctagccttgcccgttgcgcagtatatactgatccagatgataaaccagtgaactatgtcaaaagcactctcaatattacatttgacaaaaagttttgtacttttcacatagcttgttgccccgtaaaagggttaacagcacaattttttaaaaataaattaagaagtatttataggattaaagtgacttcatttgtatacatttggaatctaaaccagcttaaaaacagtttcctcaatgacttagatacacagtataactgatgctcttctggaataccacatgagacatggtcagaaacagtgcttggaaggacattacacaagaaattcagagtaatgctttgaagatttccccccttttgttttattcctgaaggaacatcagtacccgatcttgaagaaattcaagattcaaaaagaattttaaatacaccaacatgagacatcagtagtcagttggttttcagtaaagcttgttccaagttgttctcaacttaggaagtaattttggtgtgatctagcaaaagagtaggaatcagcgatacaaccactttggaagtttatagtataattgaaattattagaagaattcagcaggttacagacatacttaaactgggattaaaacctcatagtcatttttcttaattgcccttaatattttgacatatagggatacataaatttaaagaatattttttctcagttttttcagatattgccatactgaacctcattctaaactggtgctgtggatagtctttccctctcccctcctgttttagtttaaggaaaggtttccttcatggaaaagcacttttaattttgagaatttcacatttaaaataagccaaaagcctgatgttcacattgtgcttttaaactccgtaacagctgaatacaacataacatagtctcccttgaaattccctccctttttcagtagaggataaatagggtgactccagctgttggaatgagaatggggatacccccaaaataagattctggtgaagaaaaagtcttgtactaagttcccctttaggtgtagccaagtctataatataattatgatcatgaatagactccagaatccacaaagagaagagggcttggatgtcaaaaattcttccattgtggggtaggtggtcggggatgggagaaagggaaaagtcagggaaggggagaagaaagaaaaacacatttggccttaaaatagcatgcattctcccagaagcccatagtaaagaaaatgacagatcgtggtcagcagactcttatcaaattggtatgtaaaagatttcttcaagctccattttgcagagaccaccacttagagaatcaaaaaattcctgttttgatacttctaagttaaaatatatgttacagtttatctggtacttcatttttcttaactaaaattactttttactttaagcttgaataaaaatcttcattggtaactgtatgtaattaagtggcaacttctctttacctcagtatagttaaaaaccattcatattttaagtgattcatgtataccctgaagccgttaatacaccccagtctctatggtaacatcactaaatgtgggcatagaaactccacagctgtttacaaatttggttacagtgtgctacggtgcatttgtaacactcagatttgtgcccattcaggggcaatttggcactcagattctactctacttcacctaaccacccctagatctgagttttcagagtgcttctgaagtacagtttaaaaacactttttaaaaagtggagtaaaagtgaggcacattttacaagaacataactcctattaaaacggagtaacaactatgcaaaggtttctatagcagctaggtgagtttgttttccgggtctgtcttaactggcagcttcctgtacatactggtacttatttgctgtaaacgtctgtttcatacatttgccatgcagtgactgtgctcgaaaggtgaaatcaatggtaaagaagcctaggattttatggtatgagaaactgatcgcaggattttctgatccatagctattaattgaaaacttctgatagtgctgtaggctctatagtaggcttaagagtgagtcttatactatgaagccagccacaagatactaacaaatgtataaattgaaaagtaccaatactttttgcacatagatcaaaatagagtggagaatttgggctccaaaaatcaggttagtaggctcatttccatgtgcttaaaaatgtttttgttgttatgcattgattaagggctagagcaaatataaaattaaatgtctttttcctccaaataattggttattaatggtaaaatgttggacttggggattactgagattagtatgtgggtagtaaagaattggagtgggagttagtggggagggatgacaaagcttcagctttggtttttgtatttttttagtcttcataacagctacatttctgttgctcttattggccagataaatgtgttatattaaaccaggtaagtattttaaacagagaacattttatttgcatatatccctacaaattggcccattttattgggtggggggataaaaaagggattccctaactttaaataatcagaatatcctgcaattgaaaggagaaaaaaatccaattttgtcagtattttcttagtctgaaaaaaacagcagtagtaatctggtgaatgttattattaggagtgttctgcctctacagtggcatattccatgacattaatagaaaacccttctttcccacccctccccatcttgacattttcttttttaggatgttggttcctgcaaacaagaactgaccctatcacctctgcctcacagtgggtaaatatatcatacatctcttgaaagggaaaatatccatgtcagtttctttcacagtagaagaatggctgcttttgaatggggaggaaagaagacatttttcttaatatcctttttgtcccatctctaaaatgtataaatattttgatttggttttactttaatttctcattcataatttcgcaactgtccttttgggttgccctccaacacattacttccatttcagaaaccatatctgatttaatataaactgctaacttaagaagaggtgaatttgcatttacacttagacactttctaaaaacagggtgaacttaattgaaatttttcagtgttgttaagctattgttatagtagctgccctatagttacaaaaataaaaactataaaaacccatcccctatctacttaatccagatagcctggatttaacaaaaccaatagtataaaaatgtgtgtgtgtgttctgtgtgtgtgtgagagagagagtacttgattcattaaaaagtcctggaaacagctgttctaggatcttgt

SEQ ID NO: 7011 - DNA, 2227 bp, Homo sapiens
ttcttttgttgcactgacagggtctgtacttttttttttctttttgagtcaggactatggagccgagtagttgatcttttaatatagccgtgtttacttgtattaacttacagttaacataggaaaaatacaagtaaggatgtgagaatttgcattttaatgggaaattttcaacccttaatctgaaaacagaagacagtcttaatataaatgtactgtgaagaatgctattgatgtttatggtttctgattacttttcaaattttgatgtttttttgccagttggcttttcttaaatgaaaacactgttccatttaaagtacatttatgttttattcagtaagagaatagaattttcatttgtttttctttaaatcctttactaattatataatttgaaagcaaaaagaagggcctatattaaatgctgaaagtgaaaagtgatgacattattagcagacactgcttaaaggagaccatttgtagcagttggcttaacctcaacttctaaaactacattgaaaatgtaaatacatagcttagttttttgtaatatatggtgacttcagatttttttgtacagtattttgaatgtgagatgattgtcaggactaactgtctttttaacaaaacattttcagtattttaaataaaattttgtaaagtaatgtgaattaaaaattttggaacaattagaattcattcactattgtatagaagatgctgttaaaacataggaagggtatttttcttgatccaaagtttgtgaatttggctttgctacctcaattgcaggtgtttgtttgcctttataaactgttgcaaatagaaaaaaaatagaataagtatatatttttggagtaacatcaatatttaaacatttttacacagatcggtgtttgaaaatttgccatttcaggctaatatttttatatatttttgactttttaaaagttcatcagtgtttttgctactgttaagcttatgcagtttatactgtattttttatgtatcctttatatttaccaaacctgactccctgtaaaggagtgctgtcttaaaaacaactgaaggggttaaagtcgtttcttttagtttaatagatgtgcataaggtagctttagcaattaaattctagtgaagttgatatagtctcatttttaattgtcctgtaatggaacagtagcaaattcactaaacttttgtgttcagagttaaattgttctcagtactttcaatgtaggggaatgtaataaacatagtgtgtatgtttgggttttaattacacattttatatatgagccatttagatatgcagtgttaattctatactgcatttgaagtgtatgtaacttagcttatgttaatgcagtcatgaagttggtttgctccagcatccggtagtctttaaacattcttttagtgaaattgtcattgttttatcagtgctaatgtgtgcaagcagtttttttattttgcttttctcctggcatcagaaagtggtggcgttttctgtactggattgcaccaaggaagcttttggggaggaaggaaggacattaaattctttccctggtaatgaaaagagccctttatcaatacagtgctgcaatttctggatatcagctacactttgtttttaagtttgtttttgacatgtttatttggcaaattttataatgaagttttaagttgaaaataaaatgtagcaacattttgatcactttggagccttttttttttccctttcttgcttgaaactgagatttttgggaccaagacaggagcccttagattcccacccctgcccagcctcctgttttcctaggatcatctgtttgggacccctggccaactgctgtttaaaactctcagaatgttggaactcaaaggggttagttgggaatcctaactcccagaaaatggtcatgtgtttagtatttgctgtttgagaaaatacagaaatgctaaaactattgtagatccagtcatactttcaaatgcatttgtatgaatcacagaagcatctgtgcatttgaaagacagtacgtgtgtgagagacacacgagacacacacatgtactgtgcctgctgaccgtgctttagtgcttgtttggatttccagttgactctaagcctgaattgtgagatgagatcagacagcttcacctctcaattcttcctgctgcgacgttacattgtgacattacattgcaaaatgtgggtg

SEQ ID NO: 7012 - DNA, 1652 bp, Homo sapiens
tgggcaacatagcgaggcctgtctccttaaaaaataaataaataaataataaataaataaataaataaaaaccttgtccttgactattgtgctgtctgctgcccctttgtagggatggggttggggtcagaataagcatgtgcatgaatggcggaaagctttggtggtgtttgtttgtttgtttgttttttgagaggtgggggagtcagcagtgaacctttctggttaaagaacaacgtacataatttctattatgagatttagaaggttaaatacttttttttttcaggcctaccaagttgatagaccaaaagtatatagtagaacagcacagtagaaaaaatttaaaagtgaatttcttatggtccaaaaggatggatagtcacagtccataacctttcataatatatgctggaattggaatctcttgtcatcttgctttgctctgaattttagaactagaagtgtgcatgtatgtcaaaagattatgcagagctattttctttgctaacaatgtaaacatttgcaccccatgaatgggactttataatctggaagtgagcctaaggttgcgtatactgaagtcatgttttaaaagttaaggttgacttaaacatatacaaggctgtattttaattgtaactagaaatcatttactatgcatacagaacctcatgtatcttatcatggaatttgtgaattaatgggccttgccgaattcaagggtaagggaaactggtaacaacttgttttaaatcaacatactataagctcctgcttgcttgactcaagttgtttgaaaatctgaattaaacaggatctcattgtcaggaaacatcttctaagcttgacatctacgtttaagaagggaacgtggaagagaaggtgagacatgaaactaaaacagctgggagggtaggatcagactgcacctgatttttggaccaaagtttcatataggaataaataaaaaggaggaccacttgtgagccaacctaggaaggacttgccagaaagtagcagctcctgctgcaaaatacagtgccttcaaaatgattctctgtgtgaattgcatgcaatttcatgtaaccataaagtgtaacctgtatgtgcatgacatgtgtctagaatgtgtaaagttaggattcagcaggaaggggcctggccctgtcactgtggtggatcagtggacctgctgaagtcactggactcatgtgacttaggtttgcagcatcagacccctgtgtttgcattaagtggccacatcgttgaaatcggatcaatctctccctcagctttctttcctactttgcagctttgctggttttaactgcttcattcttctgcttcttggtatccttttttcttttgaaataaaaacatgaaatacttaattcaaatgagatttgtatttattttaccagttgctcttaatttaccaaaggtatacgacatgaaaagagttgcattcttttgtcttggttgtgattctgaccttaaaatacgctcagttctaaaagcttgaggagcgttctatactggtccttctgcatttcagcctgtcaccaaggggagtgttttgcgatccgccatcctttccctgaatgctgctgctcctctatgacggaaagcttggtgacctcttcattgga

SEQ ID NO: 7013 - DNA, 1292 bp, Homo sapiens
ccccgataaagttgagttctgaatttcctctttcactgtattctcggcagctactggttggtttattctttttttttaatcttttttggtttattcttcttttgatctttgaagagaaggagaaaaaagatctgagtttggctctcccatcttaagtgcagcttttagttgttttatagtcatagacgctattgcactggacagcatgcatcctggatgtaaacaatgcggaaaaatcaatggagtgaccatcttggggtcagtggtgttgcataaagcaccagtggtgtgctgttctgtgtcagtttcctctgcgccacgtgctttcacagtttgaattaccagcatctctgtggtggcttcagtacattctccattgtgcttcaacctggaagcacattctgccgttcagaaagactgattccaatcatgtaatgggaccacacgagatccatgctccaattatatgaatagcagaaggtccatttgactcttgtagttcaagagctgtttctaagtaaacagactttccagagctcgatgaagtgaagaagcccttctttcaattcctgggcagaattcagtggttttcatatcatctgaacctgctgtgctgctgtttattctatcactgtcagccttgaaaggaaaaaaggaataatcttaccctcctgcccttcttattttatatcttccatcttatccatctatatccatgtagtcattccttccgagttccctggttttaatccaaaagactctgtttaacagcaatgtcttggcagaccaggtgccgcttccgtgccatttgagggctctgagtctttgcttcgtcttaggaagataaagataatttggcagaaagtcagagatggaaatagcagtttgggatgataaaagatgggtcctgttttgctgacattcttttactttggttcttggtgcgtgtcctttgggattcatttcttgctagcatgaataggacatgcttttcgttaggtgcttttcttttttggagaacatgaagtgtttctaacaaaactgaatgagctagaaagaattctattttgagacatctgtagttgatgcaaagtatttctgtaatcctcaatgacagtacttacatatttgcatagaattttttttttaatttttgaggaaacctctctggagtctgtatttataggagcatcctgaaagtccctattatgtagctggtgggagcgagagagggacagccacactcgtgctgtgagcagagcacaacttcaggcagagtgaatgccttctga

SEQ ID NO: 7014 - DNA, 1230 bp, Homo sapiens
tttttttttttaaagattaaaggcattttaaaaataaatgtttcatggccgggcatggtggctcacgcctgtaatcccagcactttgggaggctgaggtgggcagatcacctgaggtcaggagtttgagaccagcctggccaacatgatgaaaccccatctctactaaaaatacaaaaaaattggctgggcatagtggtgggcacctgtaatcccagctcttcgggaggctgagacagaagagtcgcttgaatccaggaggtggaggttgcagtgagctaagaccgcgccactgtactccagcctgggcgacagagcgagattccatctctaaataaataaatgtttttcaacgtgttttatgtgagaaataccagcttttcattattactaccagttgatctcaggtgtcacttggttggttctgctgaccgaggcactgggcattttaaatatggagtttccctccacccattgatcaagtctgaggtttgtccatccttggtggcaggctagcttaaccatggattcacaaaccccatttgattgtcgtaagtcataaggccaccccagtgccagtggttgggcatcacagtgagtctgaggtgatgaatttgagttagctgtaggctagttccgcaactcagcaatagcccatggatggttggtaaaagacgttgactttgccacttaaatttccaggagaagaatagcttatagtttatctgaggaaagtaattgggaaggcttagatattgagaagaaagccctgttaaaatctaggtagcatttcctttcttctttattactagagggatgggaggttcaggcctgagtcaggactttacaatttggtgtccttcccagaggtactttgggcttgatcattttaagtttcaattgcaaaaaaaaatttttgacggagtgttgctctgtcactcaggttggagtgcagtggtgcgatctcggctcactgcaacttcccccccctgggttcaaagggattttcctgcctcagcctcccaagtagctgggactacaggcgcgtgccaccatgcccgactaatttttgtatttttagtagagatggggtttcaccatgttgcccaggctggtcttgaactcctgagctcaggtgatctgcccgcctcggccttcaattgcagaagtttttgaagggagaatatttgatcctcacataaaatgtccttgtttctgaaagaaaacatgg

SEQ ID NO: 7015 - DNA, 3913 bp, Homo sapiens
tctccttcatataatggaaattatttttataaatagggattaaacaatatccctaagtttcaggtgttgtcttttcttagatggaaaaccacatgaacagatctttctctaggttacctctactcacctatcccagtgtcctcttgtttttgagcccacataatcagtgttttcattttgtatacaaaaggagaaaataaatatatagaaattagtatcatctttctaatattaaagatgtgtgcaatgaaagatgcaaagttaatcttcttattactgtgagtttgagcacaatccttaaagtttcttaggaatgaatcactcatttatcttactttatcattatatttattttcaatacttgttcttttccatccagcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacctactctgaaagccttcagacattatgactctggtgataagctctttccctctccgtttgctgcttttttctggcctttacaacagaatggaagagaatcatttaagagttcctgtaacagttatgcagaaaatactaaaacccatcaggcaagatcaccacgcattgaaatattttcatatcaagataaagtcgcacattttccacaatacattgctaaaataaagaggagaaaggcttaggaagtttttttgcagagagtgctggtaaagaattgagcaagtttgctattgtattgtaatgtttctctcaggtttgttcttcctatcatgtttgatattccatgaataattgagatcagccctatgtaagttaagatcataatatgtggaacaaatggaattgtaagtgctttcaaagggtaatatttataagaaagtgtccgaaaaatgtttcttcagcttgagaaattttagaatgataggaagtttctcgagttagccttcatgcaattttgtagattaaaacataaaatttgtccagaacttaaagatttagatgccttcctaaattgttacaatgctttaccaaatctatgacttctacataacacaaaccagtggtcaaatgtaaacactatattgtagatttactgtaggttttcaaccttttttagatttatgcatgtggacatttttataatgtaattacaatcaccacaaggttagcttttttaattgcagacagtaatgcatgtcacactaatatgtagtggccttttcaaggcctagtcccagggaaaacattttgtagagtataggggagtgggaggaaggggaggaataattttttatttaaagttgatttctgcactatctttttctcagttacctgcatgaataaataatgagaaatattttgtgactttaattggtaaatatgttacaaaaccaagtacttaatcttttacatcatgtcttcagctatttgtattttaaccagtaatttcaatggtctgaaacatgattctgagcttcacataatatcttaactgtggaactcaaaagtttgatcactgaatttggcagttattattacctaggtacccccgctgttacacaggtgtttagatacgtgttcctgaatgaagctgcttttgaattttgttatgttgaaatgcaagaaataacaatgatggcagcaattaaggtcacagaaatcattaggtaaaggaaaaccaatgaggagttctgcagttttcttttaataagtaaagtgagacttgggtggtgggaagaaggaaggtgggaagaaggaattagacactctgcctgccactctgcgtgtgtgtgctctcgcgcacgtgctgtctatatggaagccactcccttttctttcctttgaaactggtaaggttaaaataggggagaaatcctacatgttggaatgatagctttttggaaaatttaagaaactctccaggctctccatcttgatttatgcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccactacaaagaagtttggatgagggattttttttttctttgtcaaaatagttcctgtttctgtagaaatttcatttttagattaaactgtgatggatgagctatcataattcaagtatacatttcttttttctatcagatattcattgtcatgcagtagtagtaaaaacatcaaagatgcagcaagcttattaagtattattttctaaaagaaataggaggcattttcatctttattattgtacttttggttatgcaaacactttgataatataaacagttatgtcccctataaatctggtcagcaacctcttttgattttgttgggtaagttaaatagtctgtagtaggtagagtactgggtacaagtggtccaaactaagataagagactaaaataaaatgctaaatcttaaaagaaactgggtttatgcactaaacgttttgtgccttggtctaatattaacatgatgtatgtgtaaactgacaaaaaaaaaaaaaaaaaaaaaccagtgttgaatcatgctatatttcccatcatcccagattgctaaatgttctttccaagaagtctgaatgaattattatatacatttgctatcatacatgacagttgtgtcattattagagatttcagtaattaaaatgggaaacagaagcctaagttatttaccttatcaaaaccacgttccttggaaccacattattatgatggtttttgtgctcttgtacgttggatgtcttaagctgagtacagtttaggggatcctttctaatgacaggaaggcactgctttcctcaacactgtgatctgacctgtgacaagtctgtactatccactatgtaaatggctcacaagtcaattgcaaacaaactgaatgtacaaatcttagtgctggtgctgaaatctcttcagaatagtcatcatgatttaaaagtttgtttaaaaatttgcaagcatcaagtgtcaatcaaaactgaagatgaaacactaatgaatgttgaattctcatgcttttaggtgtacttcctttttagaattttcagttttctgctatttttaccgtaactatttcgtttaaatttgtttcatttaagtttcctacacgctaacttcgtttgtgcgattgaaataaaattgcagtatatatatgttgcttgtttgtgacacttagataatcttctgaaataatttgttttaaagtaagttatattggatgtgaaaaacaccttttaaagtccaagactttactacttaaaagtttacatgtcacgtcactattctttacagatttcatagaagtcgtgaatactaagtaatgtatacaaaagaaatatgtgatgatgtgtctactttttgtttgaaataactgttgggtgttccctcttcttattttctctctgcccaccttgacacagtaacttcctcttatagtcaagatgatgattaagtgtttaatttttattccattttgttctgcaacacgttcaggtacttaaaactcattcatgcagttagaattatcctttatgtagtttgcatggtaaaggacattgtgtggtaaagggcattattgagtaatgaattttaagtatagcaaaatatgtatagtgtttatacatgatgctgatttcttaaaacctacatataagcagtagtactttttctctattataaagtattaat

SEQ ID NO: 7016 - DNA, 1327 bp, Homo sapiens
tatagtccaatgacatctttagtgacagtttttttcctagtgcaagatcatttattgcatttagttataatgtctctttgatatactttatgacagttcctcaatctttcataatactggcatttttgaagactgtaggacaattattttgcctgttatccttcactttggcttatctgatttttcctcaagattagattctagttatgcaggggttgttttagcaggaatattatcagagcaaagtcatgcccttttcatggcagcacaggaagagatacatgatactgtttcattgcattcttggtgatagtagttttgataaactcttgttgatatataaagtcatgctaagaatctattggttcttaaagcttaaaaaataatatttaggttttttaaaattaatgctgatgtttccttctgttttagatgtaatatattaataaaaatatggttgtctaacataggagttgattatgtctgtatattctcattaagatggaggatacctctttcccaagtggagggaatgctattggtgtgaactccgcctcatctaaaacagatacaggccgtggaaatggaccccttcctttagggggtagtggtttaatggaagaaatgagtgccctgctggccaggaggtaaggaatttcattataatggacatgcccagaattgagaggattttaattgtattccaaatacaactaactagatgcacttctttcctcgtagagaagtggtttttatactgaatcagataatatttttaaaaatcggatttgccttctttgtaggagaagaattgctgaaaagggatcaacaatagaaacagaacaaaaagaggacaaaggtgtaagttaataaagatagtctaccataccttaaaatatggaattcaggcacagctcattcaggaaatagtgtcagcatttatttaatttgggcttaattagtttgaacttatatttgctaatttttaactatgcatgtgaagtggcttgttttgactgttatttataaatttttaatggcagtcttagtaaagtgagttgaatatgtgaaattatgggaaaagcattgaagttcaaacctgtggagtttaattctgttccttaaatgagtgaatgacatttcactacttttttcatctcttagaatctcagttcccttgcattaatttaaaaggaaggaattcgcctaaattcatatgtttcccttaggagcttgatggttattggctgtgccccttcagagtgtaaccttcatgccctcctccctgattcagctgggcaaactctgctttgtctgtgctgtatat

SEQ ID NO: 7017 - DNA, 1208 bp, Homo sapiens
ctctcttccaaattttataagtatttattttgcttatttaccaaatccccatgaaaaaaaaaagtcttaattagatgatctgttgcatagttctattactaaagctctaacctaaagtaagtagttatatatacttggaccttacatttcagtatctttcaaaaactgatctagacttttacaactatgataaattggactcattaagtaaatacatgagtcagtttaatttagcatggcattctgcgtaccttcccacataaaataatatcactcagctctattgttgatggtcttacttaacatttctctctctcaggcattgtcttgggaccacttgcacctccacctcctccaccactcccaccagggcctgcacaggcttcagtagccctccctcctcccccagggccccctccacctcctccactcccatccaccgggcctccaccgccccctcctccccctcctctccctaatcaagtaccccctcctcctccaccacctcctgccccacccctccctgcatctggattctttttggcatccatgtcagaagacaatcgccctttaactggacttgcagctgcaattgccggagcaaaacttaggaaagtgtcacgggtaaatacctttctgaaaaatttttttaatatgtcttattcttcctaaatatctaaaatgttgaatttattgtattctaattttatgaaatgttatgaacttcattgatttaaaaaattgaaataatttaccctggcgcaatggctcatacctgtataatccctgcactttgggaggctggggtgggcggatcacctgaggtcaggagttcgagaccaggctggccaacatgttaaaaccctatctcactaaaaatacaaaacttagccagatgtgtgacacatgcctataatcccagctgctcgggaggctgaggcagaagaatcgcttgaacccgggaggtggaggttgcagtgagccgagatcatgccactgcgctctagcctgggtgacagagtaagactttgtctcaaaaaataaaataaataaaaattaaaaattgacataatttaaatttttatagtgaagttgtaagaatagtataaataatttctataaattcatcacctacattcacccattaacattttaccagtatttgcttttttattccttctttggatatgtttccttctttacacatg

SEQ ID NO: 7018 - DNA, 1568 bp, Homo sapiens
aactaaatttattcttctgtttatggtcctattcatgtgattttaatgtcctttttcttgtagactaaataaaaattaagactaatactagctttttcttgtaaaagaaattagtcaattaaatttattaatccacttattagataaaaggaaacttatttcatccccttctgaatctcaaaatgtatttacaagttaaaatattcttgggtgaaaatagttatttgcgtttgtgcctaattctctgatactaactgtagtctacatttatacattgtgtctgaatgctggttttgtggcttcactagctccctttttctctctccttttttatcctgtcttttgctgctgctttccaccttctgtccagctccatcttcagacagctccctgtataacgctccacttcctgagtattccagttgccagcctccttcagcacctcctccatcatacgctaaagtcatctcagctccagtgtcagatgccactcctgattatgctgtagtgactgctttgccacctacttccacaccccctacaccaccactgcgacactcagcgacacgttttgcaacatctttaggttcagccttccaccctgttcttccccattacgctacagttcctcgtcctctgaacaaaaactctcgaccttcttctcctgtgaacacaccctcttctcagcctccagctacgaagccctgtgcctggtctacttccaatttttcgcccctccctccatctcctccaataatgattagcagccccccaggcaaagctactggtccaaggcctgtcctccctgtttgtgtttcttctcctgtgccccaaatgcctccatcaccgacagcacccaatgggctggttgactctgtaacatatccagtgtctccaccgcctacctcagggccagcagctcctccgccgccgcctccactgccttccctcgcatcactctcacactgtggatctcaagcttctcctcctccaagcacccctattgcctcaactccctcatccaagcctagtgttctcccttctccctctgcagctgcccctgcctctgttgagactcctctaaactctgtgctgggagactcttctgcttctgagccaggcttgcaggcagcctctcagccggccgagactccatcccaacagggtaaggctttcattattgctactaacagctaatcacttgaaaatgttatatagcagtgactttaattgcctgaatggatgggtaggatggttttgatccttgaacatttatatgccataatgccatgctttttttttttttaattaaaaaaattaaagtagaaaaatgtttttcctgttggattaattgcatttggaggaatttccttattgaactaggttttgatatcttttatagtatcgcagttaaagatgttttctagtatttaagagcccctcataatacatttctttatttttttcttttttttttttgtttttttgagacagagtcttgctgtgttgcccaggctggagtagagtggcacgatctcagctcactgcaacctccacctcccgggttc

SEQ ID NO: 7019 - DNA, 1260 bp, Homo sapiens
tcctgcctcagcctcctgagtagctgggattacaggcatcaccaccacgcccttctaatttttgtatttttagtaaagacagggtttcaccatgttagccagactggtctcgaactcctgacctcagatgatccccctgccttggcctcccaaagggctgggattacaggcatgagccaccgcgcctggcctgaagctttgttgaggtatagaatgtgtgagaaaaaaatgtatagtccatgtgccaatgattctgataacacaaaatatgcttagcaacaattctataataaaatcatcattgtcatctggtcttaacttaaaaagtgttatagcattaataagctgtctttaatagttcacctgaaaataagaccaatgaagccaatggaaaagtaaatgtattttataaaagattctaattgaactattcctaactagattctcctttgcagaaattgtaggatattatattttctaggtaatatttagatgcttattcttgctcaggaagtagattatggggcttctaggtggagaggctggcggtagaaaggctgttttggaggctgttgtaatctaggaaagaaagaatgcattaatgtagtggcacagtggaacagagtggaggaggtgttagtagagatgtttgggtggtagaattgacagggctggagactgacatagggatgttggcagaggagtcatctagggcactccagtttctagctcgggccagacagtatggttttggtatccttcatctgggaaagggaatgggggggagaaaaataggttgtattttgaggtatgtatgatatctaagtagaaacacataataggcagctgtttatgtgagtttgttgctcaggagagaagtatggactgtaaatacctatttgccttttttcttttttcttttttctttttttttgagacaggctagagtgcagtggtgcgatctcagctcactggaacctccacctcccgggctcaagtgatttttgagcctcagcctcctgagtaggtgtgcgccatcatgcccgggtaatttttgtattttttagttgagacagcgtctcaccatgttggctgagcaggtgtcgaactcctggcctcaagtgattcggtctcccaaagtgctgggattataggcgtgagccaccacgcctggcccctgtttggcactttttaacaggtattagttgaaatggtgaatttggaatctgtgtttaaaccttggtgctgtgtgtgtgtgtg

SEQ ID NO: 7020 - DNA, 1477 bp, Homo sapiens
aatatcggttattaattttcaagttatttctagctgtccatcctatatcacaaacatccagctttttgaagttgagaggtggatcataaatctccatcccagacgccctctgacctcagccctcccagctgaccgctgaccctgctctctttgcccacacagagctcagggcgactgtgaccctgaagcaccaatgaccgagggcacccgctgctgccgccaggagatgtacattgacctgcaggggatgaagtgggccgagaactgggtgctggagcccccgggcttcctggcttatgagtgtgtgggcacctgccggcagcccccggaggccctggccttcaagtggccgtttctggggcctcgacagtgcatcgcctcggagactgactcgctgcccatgatcgtcagcatcaaggagggaggcaggaccaggccccaggtggtcagcctgcccaacatgagggtgcagaagtgcagctgtgcctcggatggtgcgctcgtgccaaggaggctccagccataggcgcctagtgtagccatcgagggacttgacttgtgtgtgtttctgaagtgttcgagggtaccaggagagctggcgatgactgaactgctgatggacaaatgctctgtgctctctagtgagccctgaatttgcttcctctgacaagttacctcacctaatttttgcttctcaggaatgagaatctttggccactggagagcccttgctcagttttctctattcttattattcactgcactatattctaagcacttacatgtggagatactgtaacctgagggcagaaagcccaatgtgtcattgtttacttgtcctgtcactggatctgggctaaagtcctccaccaccactctggacctaagacctggggttaagtgtgggttgtgcatccccaatccagataataaagactttgtaaaacatgaataaaacacattttattctataattttgtaattttctattttattttaattaattaattatttttgagacagagtctcactctgtcacccaggcgggagtgcagtggcccaatctcggctcactgcagcctctgccttccaggttcaagcgattctcatgcctcagcatcttgagtaactgggattacaggcatgtaccaccacgccaagctaattttttgtatttttattattattattattgagacagctctgtcgcccaggctggagtacagatggcgctatgttggctcactgcaagctctgcctcccgggttcacaccattctcctgcctcagcctcccgagtagctgggactacaggtgcctgccaccatgcctggctaattttttgtattttttagtagagacagggtttcactgtgttaaccaggatggtctcaacctcctgacctcgtgatccgcctgcctcggcctcccaaagtgctgggattacaggcgtgagccactgcacctggcctaatttt

SEQ ID NO: 7021 - DNA, 1099 bp, Homo sapiens
gattggcccttagagccctggcgttgcctgagccattctggttcctgtcagttgtttggttgcagcaaggaacaagactctaggtccacttaccagcagctgggggaactgagcctcttgcagagaacgagagccccacctctactctaggaaatgagctttttaatttaactggtcaggcctcaacccacattaggggttcatgaccattgtatagacagctgtagccagctgttcacagcccagacagacttgccctatctagacagccccctcctcccagctcagggactcgtctggctgtgagcttccaggaggtctcaggggtgtgacctccctccctccttccctccccactccctacctcctccctccaccccaggctataaagctgcccaggcttggctctcagcacatccagctgcctgagaccctcctgcagccttctcaagggacagccccactctgcctcttgctcctccagggcagcaccatgcagcccctgtggctctgctgggcactctgggtgttgcccctggccagccccggggccgccctgaccggggagcagctcctgggcagcctgctgcggcagctgcagctcaaagaggtgcccaccctggacagggccgacatggaggagctggtcatccccacccacgtgagggcccagtacgtggccctgctgcagcgcagccacggggaccgctcccgcggaaagaggttcagccagagcttccgaggtgaggccctccctccctgctgcccctggtcccatggggcaggtcagatgtgcccactccggtggtgtcaaagggctcctggccttgcagaggtctgtgggaggctgagtgagggccacggtctaaggggcagtgaggtggggccgggcctgtgaggatggcggggcctcagcatgcagcggtgcatgcagtcaggactccgggggtctgttttcgtactgccactctggtctgagttctacttggagcatattgctttaaaatcatctcacaaccatttgctcacatggaactggggtataactatgtcttgcccatcttccagcattgtgaacatcaaaatgagtcattgtaaa

SEQ ID NO: 7022 - DNA, 1164 bp, Homo sapiens
cagccttctaggaacccaggcagcaagatgggctggcaggcaggcttggactgggggtggcgcccacctcttgggcacagctggctggtacaggatgctgacccttggagctagttctagtcatcagaaagcagacctaaggaaaggcccttcagtgcctatggcctggggcttagtgagtgtctccacaggcattcatggctctggacgcattggctgatggtggggtgaagatgggtttgccacggcgcctggcaatccaactcggggcccaggctttgctggtcagtatctttcccccgcatgttcaggaccagggtgtagaatgggggttcttgtgcatcactgaactgaggtgggagttggttgggaagctggggtagcagttgggcaggagcagtgggtatgggaagcctgttccaacgcacaccagcaactttctcctaatgtgcccttccccatagggagctgccaagatgctgctggactcggagcagcatccatgccagcttaaggacaatgtctgctcccctgggggagccaccatccacgccctgcactttctagagagtgggggcttccgctctctgctcatcaatgcagttgaggcctcctgtatccgaacacggtgagtccatcccgcggacttctgtcccagacccttcagtcctggttggtccctgggctgggttgagcaccatttgcggaacctgctgtcttgggtcccatttagcagtgttggagtctgtgctctgttaataaccacaacttagtagattttgtttacctaagagtttgcaagccttacttcacttaattctcactgcatttcagataaccaggattaactttgacttgtagatgggaagttgaggctcagagataattttcccaaggtcaaacagttaaaaagtgatggagacaggattctaatttgaatctatgactccaaagcctgtcactcttcccgtgtgatcacagataccacttggggctctgatcaaatgagataaataagcaaaccctaacttaggtaactaatacttcttagaagtactagttgggaagtactagttgggaagcgtttgtcttggggctctaatttttggtggtgtcacatcaacaagcttgagggttgtgtggatagtggagactcaaagctct

SEQ ID NO: 7023 - DNA, 1256 bp, Homo sapiens
ctccctgatccccgtttaaggctcagtgtgcagcgtttgcatctacatctacccgggctgggtctccttgctgtcacacatgttctatttctaccctcaaaacaatggaggactttggaagggaaactgaggccaaaacgcacaaactaattcatccaaggccttgcagtgtgactgccatgtcaacagggtcagggtgtcctgctgggatttgaacccacgccccctgaccagtctaggctgcacctttggccccttaatctaatgggtaaacaatctcctaatcctagtagatgggctacttctgggcagcaggctaatcccatccacagttcattcatgcaatccacatctactgagcacctatccatcatcagccacctcagagctggggatacaaagcccgggtcccacccttgaggagctcagtgtttagttaacaggatgatagtggacaggatacgaagtgtggctgggcccaggccatgctaatgtggatttccatcagcttcccactgagcagctgatttcagaatttccttcttttggggtcagaggcccttccacgttgactgaacggatgcagccctgccaccgactgagcagtgggcctggagaaggccctggcacagggacgcacaggtataatcctgggtataatcccttcagatctgcctctactcttgcctcattgcaggagggctgagccacagccttgcttgcaaagcaagtggcattcttgccaccctaaaggacactggccccagttaacgtgacctggctttgaaagaccatcagtgaaataagactgggatggcctggcacagtggctcatgcctgtaatctcagcactttgggaggccgaggcgggtggatcacttgaagtcaggtgtttgaaaccagcctggccaacatggtgaaatcctgtatctactaaaaatacaaaaaattagctgggcgtggtggcaggcacctgtaatcccagctacttgggaggctgagacaggagcatcgcttgaacccaggaggcggaggttgcagtgagccaagatcatgccattgcactccaggctgaacaacaagagtgaaactccatctcaaaaacaaacaaacaaacaaacacaaattagctgggcatagtggtgcgtgcctgtaatcccagctactcgggaggctgaggcaggagaatcacttgaatccaggaggcagaggttgcagtgagccgagaacacaccagtgcactccagcctaggtga

SEQ ID NO: 7024 - DNA, 1165 bp, Homo sapiens
aacagttgcaagtctattgaacagcatttgagtttgttgagttatataagggagaggtctgacaattagttttaattactcaattagaatagaaagcattaagattatggaattagtagattcagaggcatgggattctcattaagcttttaggagtgcctgctctttctgtgggaatagtgtggggataggctggctatattttactgtttagatgtttactagaaaaatcggaaaagaaagcaatattaaaaatctgtttgggaatgctatacttctgttactgttctgaatgcttgtttctaaatgtatagatgaaaaattagttattatgtgtgttgagaatacttatggaataacatgtggatggatgatgattaaaattcagttgcaaggtatggcaaattaaatgaaaatttctcaagaaatgtagttgacagttaaagagtctttattcagaggaaggagcctgttttaaatattttcttatttttttccctcaggttattgataaggaaactatagatttattggcgttcacctctgttgcagaactggagttgctgggtttggagaagctcaaatgtgaactgatggcccttggactgaaatgtgggggcactctgcaggagcgggcagcaagactcttctctgtcagaggactggcaaaggagcaaattgacccggctttatttgccaagcctttgaaagggaagaaaaaatgagtatcatcagagctgattcctatttgtttatagtgtctaccatttacaacctgcataatgtggactcttgaccagtattcctgttgatattaaaagctaactttttagtaacccaattctaactatcccctttttccttgtcagggctgtagaattaatgtctgaaaccatctgggccttaaattttctttgtctggttttctatagtgtatttaataaatatagggctattcacattttttggtttgatcttggtgtcatttaggtaatgaatctatccaagaaatctatccttttgacccaggttatcaaatttgtagacataaggttatttataatggtcccttcttacccttttaatgtctttaggagctgtgttgataatttccttttcattatgatactggtaatttctgttctcactttcctaatcaggttgg

SEQ ID NO: 7025 - DNA, 1329 bp, Homo sapiens
gaaacatttcattctcaaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactatacctgcttttggtctttattatagccttgccctacaattatattccaaataatttcagtattaagtcctttaatagtcactttatatctgagacgtgagacttattgagagagaaggaaagtatagacttggtggcaaaaggaacttggctttatttctaatttttagaagcttgccactacccagtggtcttaactctttggatgtgttgtcttctgaaccaataattcgaaaagctaatcaacaggatcacctggaaatagtggaatctgtaagtagattgaactttcatgaatgtttaataacaaatgagagtgtgtaacagtctttagctcaaaaattaatgcattcaagatctggctattttaagatgctctattagttaaccctgaatttattcaagcactaatagttaattcttagccctgttttatttagtgttggtacaattaatgtgaaatgaggataattaaaccttctaagacttttaacacatcccattagttgtaacgtttgagtgtttgaaactgccctagaagtgatacgaaatgttaataactatgccaagaatagacgcatgtcagtaagatacgacactgggcttgcattcttactgctcttaaacatttagccataacttaatcttttgactataggtgactataaaattctttaatgggagaattaattactttaagaggctgattttgttagcatgcatcctagttttcagtatgatcttttgcatgtacttctacagggaagtacgggtaacacttggaactttctcaatataagttactaaaagccaattgtagttgaa

SEQ ID NO: 7026 - DNA, 1329 bp, Homo sapiens; identical to SEQ ID NO: 7025

SEQ ID NO: 7027 - DNA, 1639 bp, Homo sapiens
tgggcacggtggctcacgcctgtaatcccagcactttgggaggccgaggcaggtgggtcacaaggtcaggagattgagacaatcctggccaacatggtgaaagtccatgtctactaaaaatacaaaaattacctggatgtagtggtgcacgcctgtaatcccagctacttgggaagctgaggcaggagaatcgcttgcacccaggaggtggaggttgcaatgagctgagatcacgccgctgcactccatcctgggtgacagagcaagactctgtctccagaaaaaaaagaaaggatagattttaattgcctgatgcaagtgtggttttcctgaatctgttcattgacttgtctctgttcttacagaaaacatcggttgtgaagagaaagccaaaaagaatgccaacaagcctttgctggatgagattgtgcctgtgtaccgacgggactgtcatgaggaggtgtatgctggcagccatcaatatccagggagaggagtctatctcctcaagtttgacaactcctactctttgtggcggtcaaaatcagtctactacagagtctattatactagataaaaatgttgttacaaagtctggagtctagggttgggcagaagatgacatttaatttggaaatttctttttacttttgtggagcattagagtcacagtttaccttattgatattggtctgatggtttgtgaactcttgctgggaatcaaaatttccttgagactctttagcattcatactttggggttaaaggagattcctcagactcatccagcccttgggtgctgaccagcagagtcactagtggatgctgaagttacatgagctacatgttaaatatttaaagtctccaaaataaaacaccccaacgttgaccttacccggctgatggttagccccttgctgcctgctccatgtgtcttatgagagcccgtagttacagtgtcctctaatttgaaatccataagttaacaagtctatatcaggtgcagctggctttgattaaaggccatttttaaaacttaaaaactcaacacctcacagattataatagaaaaagaaatggcctcagtttgatctcgttcagaatgacccagattgtttctgctttgggtgcagctgtttagttcagagttatattacagagaattattttctgagataatcttaaactagaatgttcaaaactaattgataattgaagtatcaagatacgtagaacacctcagagatttttcttcaggaacttccacaaactttgaatccttgtatctttatttggtattcatactactagtagcaaaatacaggttttttgttttgttttgttttgttttggcttcatagagtatctcaaattgaaacttttctgcacaaagaataaaattaaggattttataaactcaaattggcacctactgaattaaaatacataaaatcatttaaatataattcagcatatgggaagtaacattgcactaatatggaaatcactgccagagacagtctattttcttttaatttgttactacttagtcacaaaccccacattattccagtttggaattacttattaaggagaattggaaatacatatgcccatgcttaaattttatagctttaat

SEQ ID NO: 7028 - DNA, 1534 bp, Homo sapiens
ccttccctaagatttatcatagctgtttcctaactaaaattcaggtcttcttttaaaaatttttttcttaattttttgaaataaagtagttaaccatgtttcttctttctttagttgctttcagaataatgtagaaatccatgttgcacatattcagagtggcctgagccagatgggaaacttacatgcctttgcagcaaataacaccaacagagactgagtaaagatttcattattccaactgcacgggacattgtttttgagaagttcttttcctttatataggcttccaacaccaaataacctaactgctggaaaacaagggaaatttaaatctccaaataaggcattttaatagactgtactgcttcttaaaccagcattgctgaccagcattatatttatttttcttttattattcagatgcagtagcattgcttatgttacatatgtttatattcacaaatatttttaaactgaaatatctgaacataatataatttcgtggaagaatacattgaccattttttttaatgtgcatgaattcaccgcaacacatgcagacaactgctgcaatggagagtatgaagaaacctggtctttttattcatgtcggtggcagtgtggaaattccatccagaaaattacaactccacttgatttagttgatcaccatctcagtcttcaaaagataacatcatgaggtgtgggaagtcctagttttaaggaaaccactgaaatatagatgggaaatgtggactttacaagtatatgttatatatacttgcaatgtgacatggttctgtagatcattttataataataaatattttaatttatcataacatataaaagaaacctttgttgtttgttgaaagaaaatgaaggaacagggggaaaaaaggtgcaaaatgctaaatttctaaaaatggatttggcatgtcttcccatcagttcaggtcaaaagtgcattgttgtgagatttattaaaaaaaaaatgataacacactattttcatatttttttgtttatttgcacaacttttaaaccagattactggttaaaatccaacagtacacaatttataaagtaaaaagattttataaggaaaacaaatataataaccagtgctgtgaaatgcagaagaaaggcttgttttggttgtttttcttttttaggaaaacgctgcctaaaatgttaatcttgtaaaaagtatgtatttggaattttcttcgttttaatagaatattataaactcaaaatataaatttttttcaaatttggagtttaagatatagctgtagaggtggttttaattcctttagatgtctcataaaatgagactttttatatgttaatgtataataaaactgaaacaagattattttccatttgaaatttttgtatagtttaaaaaggcttccgtattctttgttggtattgtgccactgcagaactttagtgcagagtttatatttagctaaactgttatgttaattaagaaatgcataaatcttctattcttaatatttgt

SEQ ID NO: 7029 - DNA, 1308 bp, Homo sapiens
tctgaagtatctgctgaaactgaaattcaattttaagacctccctgtggtaattgggagaggtagccgagtcacacccggtggctctggtatgaattcacccgaagcgcttctgcaccaactcacctggccgctaagttgctgatgggtagtacctgtactaaaccacctcagaaaggattttacagaaacgtgttaaaggttttctctaacttctcaagtcccttgttttgtgttgtgtctgtggggaggggttgttttggggttgtttttgttttttcttgccaggtagataaaactgacatagagaaaaggctggagagagattctgttgcatagactagtcctatggaaaaaaccaagcttcgttagaatgtctgccttactggtttccccagggaaggaaaaatacacttccacccttttttctaagtgttcgtctttagttttgattttggaaagatgttaagcatttatttttagttaaaaataaaaactaatttcatactatttagattttcttttttatcttgcacttattgtcccctttttagttttttttgtttgcctcttgtggtgaggggtgtgggaagaccaaaggaaggaacgctaacaatttctcatacttagaaacaaaaagagctttccttctccaggaatactgaacatgggagctcttgaaatatgtagtattaaaagttgcatttgaaattcttgactttcttatgggcacttttgtcttccaaattaaaactctaccacaaatatacttacccaagggctaatagtaatactcgattaaaaatgcagatgccttctctatttgtgtattgcgtgtctggtctcattctgactacagatatggttaatcttcacagtgcaaggtcccaagagactttggggggattgtttctacccttaatctgtgaaaccccagaacgtgccaggcagcaaatagcattgcttaatgggaatgccccacctaagggtgggccaagcaccaggcataggagacactttttttttttttcggcttatcagatgcattgtggtgatgaactcatcctgctctctggaggactgcctttcatacaccacattgccttgtacaactgctctgcatttgagaatcatacttaaatgtttacgtttcaattgcctgaaagcagggccagtgtcttatgtcacctctgaccttttacggaaggggacaagtgaggtagtagctcacacctgtaatcccagtgctttgggaggccgaggtgggaggatcatttgaggccaggagttcaagaccagcacctttgac

SEQ ID NO: 7030 - DNA, 1196 bp, Homo sapiens
tggctggcagcgcatgggactggttgcttggtactttgggaatttagagaaggctatataaacttagtcttgcaactggcccttgtgtgaggaagtgtaagagaaaagagaaggaatttgtccatcagtttcatgtcccattgctccaaagtttgcttctacagctgcccagcacttccaggttgggcatgagtgggcactagacaggttcccaggcagggaccagcaaccccagggtgggtcagcccatgcagacgctgcagtggcaactagaataagaatctggagcagccaagagaacttcagggcaggcacaggaagagtctgacccatgtgcagcatcaggcacactcatcctggccactgttttccacacctttttgattaacactcagctttttttgctggtggcactctagcctgtgtcctttgtctgcagtccagccccacagacgcagataccttgcttgagttgttgatttgggtctcttagcaatgtgcttttttcctgaaggatgaagaggcagtgaagaagctgacagtaaatcctggcaccaagtccaagctccccaagccagttcaggacctcatcaagatgatctttgatgtggaaagtatgaagaaagccatggtggagtatgaggttattgcgctttatcattttatctgtgagcatttgctgtggatgattatttgctgagctagtgaagagctgtctgcctgttcttgtttctgtttcaaaaacaatacattggctgtcagcttcttgtacctgtccttcaatcttaaattgtgtgagtgttggggcctggagtggttgcacttttgcagagggttgtttgatttgcagtgaagcatgtgttgtgttggagagagttgttcctggtccctagtcccctttgtactttttttctgagacagagtctcaccatgttgttgcccaagctggtctccaactgctgagctcaagtgatccacccacctcagtctccccaaatgctaggaatataggtgtgagccatcgtgcccggcccaccctttgtatttttccccttcttcatgctgtggcaaggtgtattagccatgcttcctttgtggcccaaccaaaccaaccaactggagttaccatgggaagtgcaagatagcccacttagagtaaaagaaaattgctgtgacgcttgattcgtaagataaaa

SEQ ID NO: 7031 - DNA, 1217 bp, Homo sapiens
ttttctcctagaatcagttagctcagctccgtgtgattgtgctggccactgctttgagggactatcatggacatgtctcattttaaaatggggttaattcataagaattgcagtttgtttgggagaataacagaaggaattgggggttcatgtgaccttacccctcttcccatccgactccagcctcctggtccctcgtccgcagatgcagccttcctagcctgaccttggcgcggacctggggtaacccgcagctgcctggctcacgccgcgaggctggcctggccatggagtggcattttgtggcttgctccctgcccagtcctttctgtgctgagggacatctgtaggtactcaggtggcagcttgctgtcccgtcctgttttctcgcgagtgtattttcataggcttttcccaggagctcgctgcttggctcacctgctcctccacctccccttactggggagcagcaccagagctggccttgctgaatgattctctcctttcatcccagataagccattatccaacatgaagatcctgactctcgggaagctgtcccggaacaaggatgaagtgaaggccatgattgagaaactcggggggaagttgacggggacggccaacaaggcttccctgtgcatcagcaccaaaagtgagttgaatctgaatttgtgcaacagggacaatgcttctgtatcttatgattgtgatgacgagtaagtgaggaagagtcgaacacagcgctgaaaaactggatcttaacatcatcatcgctgtggttctttatgaagggaaaccagtatttgctctcagtgttgctgctttgtactgtagattcacatgcattgcgtgttctcaactaaagacggtaagctactataggttgagtctccctagtcccgaagcccaaacaaattgcctcaaaattcaacactttttgagtgacaacatgatgctcaaaggaaatgttcattggagcatttcagatttcagagttttggattagatgctcagtcagtaaatatgaagcaagtattttaaggtctgaaaggtttctggtctcaagcatctcggataagggaagctgctcaacctgtattctcatcacttcgcactgctctgtaagatgtgcatagatatctgccaaaacagaagttcaaggttcaagtatgtttggaaaaggtagggtaaaacaaagctaaacaggtttctgt

SEQ ID NO: 7032 - DNA, 1162 bp, Homo sapiens
agcaagaccctgtctcaaaaaaaaaaaaaaaaaaagtgctgcattggaagcccacgcaggtgtgcaaggctctagctctgcccagcacaccataccatgtgtttttatgcctgccccaggtcagcagaaacatcttaaggggaatgttagcaattcttcacatgtccaggcaggtaggtaggttgccagccatttggaatttaaggaaccctgagtcttgagggtgggtaacacacaatccttgatgacctgagagagctaaacctctcaaaagctcatgagtcttcaagttggcgggcaggccttggcttggaccctcagctcctcactggctggagcacaggctgcccgtatcatgttcactatccttgcttgtcgctcccttggtaccacatatggtttttcctgcagggccaggtgcgcctgtccaagaagatggtggacccggagaagccacagctaggcatgattgaccgctggtaccatccaggctgctttgtcaagaacagggaggagctgggtttccggcccgagtacagtgcgagtcagctcaagggcttcagcctccttgctacagaggataaagaagccctgaagaagcagctcccaggagtcaagagtgaagggtgggtggagcactgcggggttgccctgggggttcagtgaggggttcaagggaggcccaaaggccctacaggttccataccactcctctgtttcccttcgctgactgtcagtaagccagggagatgcaaactgaggaatggtgacagcagagatgtgggggcaaaggacagggtagggaaagacagccaggggttcccatggcctctgctgagagccctctcccctgtgagacctgcttcctggtggtctattccccttccaacatctgagctccatggacaggctaactacactttcccaccacaaccctttagatacttaaaagaccaccttccttccctgggtatttgttgtgcctgggttgatcactattcggaacaatgctgggagaatggtgaccatttttagttaggggatgggcagtggataattttcctggcttagagttgagaatgataagggttttgcatggtgttaaaatttagaatgggaaggaccatcagtgactgtcttgaatccatggacacctcttggt

SEQ ID NO: 7033 - DNA, 1237 bp, Homo sapiens
cccagctactcgggaggctgaggtgggaggatcgctgggctcaggagttccagactgcagtgagccatgatggcggcactgcactccagcgcggtgagactcagtctcaaaaataaaagggggaggggttgggggtaaaattagttgtgaaatcaagtaagacttcctgggacagaacaatcaaaggggtggcgccgggtcctccaaagagctactagctcagcccaagccccgcctcggcccccagggcagcggcccgcagagctccacccggcaggcgcccgggaaactccgccccccggccggcagggggcgcgcgcgccgccggccccgccccgtggacgcgggttccgtgggcgttcccgcggccaggcatcagcaatctatcagggaacggcggtggccggtgcggcgtgttcggtggcggctctggccgctcaggcgcctgcggctgggtgagcgcacgcgaggcggcgaggcggcagcgtgtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcaggtgcgggccgctgtgcgggcggcggggcggggacgcggcgccccgggttaactgtgtccgggaaggctgggggagggcgggcccagggagcgagcgggcccgggccctcggagcggcacttggggcctatggggccgcggccgcccctcctcccgagcggcccggccgacccttccggaaggttttgctgatgttgcaggaaaagcccgggaaataaagtctgcagctggtgttgcctttcgctttgtgaaaacgaggagcctcttctcttctcctttctgggtggcggtgttttattactgccgttcgcctcaggggttgggggggaattgtacatggtctctttaagctaatctgattttgacctatcttgttctggagggtttttgttctacatggatggtggcgactgacatgtgggttttttttttttttgttaaacctatttttggcagtcatttcaacacgtcatttaaacgctcactctcattttttattttaattaggcagaactatgcagaaaggtgtcatttctgtacagtacattcactttgagcctaatttgtgctttaaagt

SEQ ID NO: 7034 - DNA, 1161 bp, Homo sapiens
cagtaacattttacccctactcccaaaggtagcttaaatagacagattacacaaatgtaagtgataagaataagattagacagattttgctttcacagtagagtctcattatagtcctaaaatagctcatgggcttctccgcatccagaagggagaattggtccctggagtggctcactaagctcttaatcagcaaacgcagtgagtatcaacctgattgttgccaggaaatccttatgaattaaaacaatgcatattttactacagtacagagtttaaatgaatacataaatgtagaagtactgaatgtatatatttaaaaggagcctcttgtattcaacaaaagatggatgcatatataagagagatgatttaatttaaagaaatatgttgtttcttgtctgtaatgtaatgtaaagggtggaaaggcctcaagctcacatttgtagagagagagcgagagaaatcagagttccctttattgccctgtcctcaaactggtcataggctctagtcacctggggagctgtagaaaacacttgcagagccaggttttgctggtttggggcatgccctgggcaccagagctttaacatttgaagccacttcagcagcagcagcaaaaggcgaactcatctctacccaagatgtttcttttcctagtggtggaatttgaacacttctcactttttattgtattttatcttccgcagataaatgtagaaatacacgattctgtcacctctgatcccttccatctgaaaggttacaaggagtgttgtagcttctgaaggtgcagaaaacaatttctaaaaatgcttttattcctgggctaatcctgtccctccctaagtcacagcgaggtgtctgtcccagggctggagatgcttcccaaggaggagtctgttttgttgagagtgggcgtgggcttcttcacataagcctggggaaggaagaaaaaacggctttcattaccaaataatgtaaaacctcaaaagcaagggcttcaacagccttaaccaaatattattccccatagccagtggaaaatggatgtgacaaccccagtgcgcaggccagagtgagtgagcccagcacggcgctccgactggcttcctctctcaggtgctggattgtggggttagtggcatttccagctgg

SEQ ID NO: 7035 - DNA, 1124 bp, Homo sapiens
aaaattataaacttactcctgtatgtgctccactttcatggttgcctgtaatggtataatatctaacaaagtctaacagaattctaaaattaacctttgattttgtaacatttttaaatttaataatttagttcagggtccacaaatgttttctgtaaaggttcatttagtaaatattttaggctttgattagcttccatcacagcttctcatctctgctattgtagtgtaaaagcagccatagtcaatacttaaatgaatgagattggctgtgttctagtaaaactgttaatctacatgaaagtaggtagcaagctgtatttgttcttcccgcagtaatttatagtcccctaatttaccatgcctgacatttaaaccaagtaagtttggctacatccaagatggctcactaaccagcaataaaaattaatgacatttttccttttttctccttatttaagtaaactaaaagattcagagaagaagaacttggaactactctcagaaatcgaacagctgataaaggacactgaagagcttagatctgaaaagggtatgggagtgtgtgtttgcctcactcaggacttactgttatgttataaatatattttattacagaagaatcaattcattgcataggtgggagaattgttgacataagcaattctggcactcatttatgaatatacgtgtgtatatatgatgcatgtgcatacacacacatttggaagactgacctctgagtcattttgttttacttaatatgcattgtttaatgatttcatagtaacagaaaaagacactttgccataaatttgacgttttttttcagtgcagtggactacttcatgaataacatttttgtgattggaaaaaaattttattttataatgtactttataatattctcaaatgctatgatatgaggttatcactctgacagtggcaatgtgtgttaacatccagaacttggtaagggtacttgaacaagtatttcctagcactttttatgtgcctagaatgtataaaaattgggggggggggggtgggattcactttcagggtagttgaggaaacaatgtatgaaatagctgaagattaatttagtattaatggagcaattc

SEQ ID NO: 7036 - DNA, 1202 bp, Homo sapiens
acctcttcccagttgttgacaggtagtatactatggtagaccttttcaaagaaattatttaagactatctttgaatttcctaccacttatttctttaggaagctttaaaataacatatattgcactgaagcttttttgttttacttttgtactttgtctttatatattctagggtcagcgatgaaaaggatgcacgagggtatcttcaggccttagcttctaaaatgactgaagaattggaggcattaagaaattccagcttgggtacacgagcaacagtaagcttctatgattttgcatggaggcttatcatattagaaaaaagagatttaaaaaacactataataaatccaattacttatatcagtttgtttagactttgagcctactaaagagttttttatgagaaaactattagtttgggtcttttccagtttagaaaaacataacacacagctggttaactataataatttaaatgttaaaaataggatggaactaaaaacacagtcattatttcataggatatgccctggaaaatgcgtcgttttgcgaaactggatatgtcagctagactggagttgcagtcggctctggatgcagaaataagagccaaacaggccatccaagaagagttgaataaagttaaagcatctaatatcataacagaatggtaagattgaatcatatagtcccactagaataatttctaagtttgtcataattatttggagagaagttacatgtttagtttccattgcttgcttttagaaaaatgatggccaaatatgttacaaagatttgaaaataactagatgcttttaagccttgtagatagtgatgaggttttaatatagccttgttttcctctggcttgtccataaagtagaattaatagtattaaataatattccattatttaattttcctcataaaatttagttgactctcaaattttattaaacctaaaattctctcatgtttaggaatattatatttgtataataatacaacatatggtgagaacaaaatataatcatttgaaaattgtggcctctaccataggtcttttataaatgaaaattctattgatggcaaatttcataatgatataatatcttttaagtataattattgtttttcatgtttctttatgtatttagaaaaagtgtatcccacagtctctgaagcagttagctaat

SEQ ID NO: 7037 - DNA, 1746 bp, Homo sapiens
tcctggtgttcgccaacaagcaggtaggcgcccgggccagcctggggaatgtgaggagccagtgtgggttccgcctggtggtaggggttactggaggctggtggggcccctttctctgtcctgtggacagcccttcccaccaacccttccttcccccaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatttcaccggctctccagtgcttccacacaggcatgctgcccccaggagatggtgggtgcatcagccagctttactctaggaagtacaggtgactgcctagggccgccacctcagtccacaccctccccatgttccctcctgagtgtgcaggcacttctctgtgtctgtgtgagaggctcttccagcatggttgcccacagtgaccttgatctcgtttgcagtcctgtcggg

SEQ ID NO: 7038 - DNA, 1319 bp, Homo sapiens
ctcccggctcaagtgattctcctgcttcagcctcctgagtagctggaattacaggtgtgcaccaccacacccggctaatttttgtatttgagtagagaccgggtttcaccatgttggacaggctagtctcgaactcccgacctcaagcgatccgcccgcctcggcctcccaacttgctgggattacaggcgagagccactccgcccggccccgttttaaccatttttaaacttccagttcagaggcgttcccgcgcccggcagggtaggcgcagtgcgcaggcgcccaaagccgacgtggaggtgatgcgcgggagcacagatccggggcagtgcgctgcgcagaggcgcgcggcgaagccgagtgggcgcgggagtgacgtcacggcgcgcgacgcggaggcggggtcgggcctgggtccgacggtagtgggtagcgggtctcgggttgcgggttgcaggttgcaagccgcaggccccaggcaactgccttcccggcgccatgttcggctccagtcgtggaggcgtgcgcggcgggcaggaccagttcaactgggaggacgtgaagactgacaagcagcgggagaactacctgggtgggtgcgcgcggtgggcgggctccgggctccgggctccgggatcccgggcgggcgctggactcacagcgtctacgtccgcaggcaactcgctgatggcgccggtaggccgctggcagaagggccgcgacctcacctggtacgccaagggccgggcgccatgcgcgggcccgagccgcgaggaggaactggcagccgtgcgggaggcggagcgcgaggcgctgctggccgccctgtgagtgtccgcggacggcagcggtcggtgcctgggacggcgctgccggggcagggtggggccggggccggggactgggggtcgggctgggcgggagcggggctgcggggactcgcgcgggcgggaccctgaggacgaaggctggagtggtgaggacctgtggtgggaggaggtccgtccgtcctgacgcctgccccggccctctcgcagtggctacaagaacgtgaagaagcagcccacgggcctgagcaaggaggtaactccccggggtggggggcgcgtggagggccgtgggtgtggggccgactcgagcgctccctgtgctctcgcacctgcaggacttcgcggaggtctgcaagcgggaaggaggcgaccccgaggagaagggcgtggaccggctgctggggctggggagcgcaaggtgcgggcgggtttccaggggagggcagcactgggctcgattgctcgggtgaggcggacccctgccgt

SEQ ID NO: 7039 - DNA, 1116 bp, Homo sapiens
gttagtacagaccccacagattaagggctcagtcccataagactgcccccacttcagatgccagtcacaacttccaggggctgcccatacttctgttccctcagcgcctctgcagatgtgagcattcgctagcacagcccatggaactcagaagagcactttacttactgtcattggtttattgtgaaggataccactcaggaagagccaaatggaagagacacatgggcaaagcctggggaagggctcagagctttcccaccctccctgggtgcaccttcccagcacctcagtgtgctcaccaacctggaaactccctgagccccaagagctgtttaggtgtctttgtggaggttccattacatggttatgattgattaaatcattggtcattggtgatggggctcaacctcagacccctttccccttcctgaggtcagaggctggggctgagtgttcccgccctctactgacaggattggtctttctggtggctggccttatgctgggctctcaggtccccacctcagccactgcagtggcatcaactcaggtgtgatggaaaggggcatcttatgatagcacaagatgcttctatcagtcaggaaattcccagggttctgtgagctctgcgccaggaactgggcacaaaacccaaatctgagtcttgtatcacagtcacccaaaggaagtactatcctcagctcttgctagcaggtcaggagcctgttgtgtaggaactgtgtgcaggcctccagaggtggatagatctgaaatcggagtggtcagggttgggacagctgccctaattcacatccttcatttggagattgaaaggaaaaacagactggatgcattggctcacctctgtaatcccagcactttgagaggctcaggcgggaggattgcttgaggccatcagttcaagaccaacccgggaaacatagcaagactcccatctctacaaataaaaaacaaaaaaatgagccagccatggtggcacacgcctgtaatcccagcagcttgggaggatctgaggcgggaggatcatttgagcccaggagatcaaggctgcagtgagccatgatcgcaccactgcactgcagcctggggcca

SEQ ID NO: 7040 - DNA, 1636 bp, Homo sapiens
ctctctgtctttccctctcccctcccatgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctccatgagtcccggcagctctgggtcatgcccttccctggtcacccatctgcccctcacctcgtcatccagggacccagaccctgcaccttccatgtgggcccacagatccttggcaggtacctgaggtgcaccattgagtgtcggatttggggttagcatccagaaagaagaatgcgcatgacgctctgtgaaggctggaactcaggtcttcagggagagaaaggaagactggattgcaccttgatgcctcctgaggaggcggcccccctcttgaggtgggcgtgggcccggcccagccttatccaagtcgctctgtccacctcccccttcctggcccccaccccactcctgtgcctcccaggagccctccctgtgctccacctgcctccgcagaaggaagcctctttctctgtttccctgggtgagggggctggcaggtggctaaccccatttagcatctccaggccctgccatcgtgtctcatcttgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtcagctcgtttgcttcgtctccgtgtgtccacctggcctcttccccctgccctggccaccctccagtgtcaaaggaaacttcctcgtgacacgtgctaaagcatggtgaggaggactttgattgggaccattgagatgggtgtgggaccctttccttggggcctggggggagatggggctccaccccgacgtagcagggcaggggttggaggagcgaggagcagtatagggtccatgggtgggaatgactgtgaggagacatcagggctgagggggctctggctaaacccacctcacagagtccttgctgcaggcaggcagggcgatcagacattggctgcaaacggtcagagaggaacccagtcaggtaccattgagggtggtcagatattatggttaaccaaattagggttcttgctaaaactggatttcataagaaagggcaaagagggccctaggagaagattccagagcctggccagagtttggccaagtagagaatctttgtcagcacgccaac

SEQ ID NO: 7041 - DNA, 1093 bp, Homo sapiens
ataaaatgaaaaacctctccaagtcctggtggaagaagtactgctgtttcgtatgatgctggcaagacacccagaaaggctattttcagatgaaatcgatattagaagctatattagctgaaacaactccttttactgcgtagaacctatatcgagagtgtgtgtatatgtattataggaggagctctcaattttatgtattctttctgcctttaattttcttgtttgtttgagcttagggatgagatacttatgcaagatatttttgaagtaaattaaacatttttcacatctctggaaatttagagttctagacctctggttaatttatatctaatatgaagaagacacctctaatctggatgttaagaatgaagttctgctacattataatgtacagaagagcaaaagggaggaacactatggttaaccctctcttgattaagggctacttaatgcacagtgcattatgtacacaggtcaaccatggtaacaatagttcttagctttgaaactccatgcaaaccatgccttttttttaaggagcaaaaatctgagaaaaaaagtgagagacctctgcctacaaaacctcaaaccagtcacttttgtcaattgctaatacccagttacttatgatttaaaaacaaccaacagaaaacatcccactgactgtatggcactctgtagtcaaaaaaggaaacttccttattgggacttttctttcttagtccagttgtgttgacacatatgaacacagacaaagtgctatgcggaggaaagcaagtgttggtcagtagtttcatgttttagggagtggttcctgtggagatcagaaagtgacatttgctttcggtactgtaatacgtgcaccaaactgcctcaatcctaggtaacgagggcaacagggagcacctgtctggattgtttttaaacctccatactcaagctgtctcttcggcagggaggtgaatactcttgaaaggccaacagcaagtgtttgtgggacacaacacagataattttttcttaagtcggccaagatgtacttctctgtgtgcacacccatgcacactcatgcacacagatacatagg

SEQ ID NO: 7042 - DNA, 1710 bp, Homo sapiens
gcagggtcgggcttgcggtgggtgacccagagccaccaaagtcacatccacaactaatgagggaaatctgtaaagccagttagatagaagaattttatttttctgtgggttttgtgttgtcttttttatgttaaaaagaaatccagtttgtgtttttctatagaaaaagtaaaagatcaggttatactttaggttaggggttctatttattcctgttagtaaataaaattaacaaatttctttgtttaacaaaagattaatctttaaaccactaaaatacatagactgattgattattcaacacattggaattgatgtcggtcatagtttcctgaagcatttagttacaacctgaaggaataaaatgatttgtggaaatgcttaaaatagacctaactgaatacagtctcatcttgccgcgcctggcttacctatctgtggaaagctaggcttcccaggctgggctctgcctgtctggtgcctggaggtgtgggagggaagatgagttatttaactggtaagcgatttgaaacactatttttatattaaagtaaatggcatggagtatagtgcaaattcatttttaagatagaacacaaaacttgaaagaagttttatgcgtgtgacagtgtatggggctgcagttggtctccctggaggggacttccacacctcctgcctttaggccatgggtggaaagtgctcagtgaagtacacctgtgtggcccagttctgaaagctttatacagttgaattttaagtggggttgataacaccttggactgttagtgttaaaaatctagtgggttgacctttaaatgcaacagtttttaaaatatattgctgcattttatagaatagtaaaggtacgattatacttgagattttcctccatttttatttcttcgtgaacatagagtttggggccgaaaatgtttttaaagtatgtgtttgagttaaatataaagttggttcacttcaaagctaaaaaattgttaaacttgcagcttggtattgcagagaagattttataagaattttgctttagagaatgccactttggctgaactacaagtgtaggccaccattataatttataaatacagcatacttcaaaactgtttgttatctcttgttaccatgtatgtataaatggaccttttataaccttgttctctgcttgacagactcaagagaaactacccaggtattacacaagccaaaatgggagcaaggccttctctccagactatcgtaacctggtgccttaccaagttgtgcttttctgttttcaagtgtaaatgatgttgagcagaatgttgtacttgaaaatgctataagtgagatggtatgaaataaattctgacttatgaatataatggctcttgccttttctatctgagaattttgttggaggtgtttagccacatcttgaagcagcactagttgggaagcatcgtggcttaccctgagaggtgttttgggaatgcatctccaaccaatttgaagtgcttattcattcagcatggggttttctgaattctggagccacagtctgacaataagcacccgccgactacatgttcctcacagactgtgtgctgatgtcccagtgtgttggagggagcactgttcttggagccaaaagtctgggctcagagaagcactagtgtgagatgaagctgagacagccagcgatctgagccttgg

SEQ ID NO: 7043 - DNA, 1382 bp, Homo sapiens
ggttatttatgaagataattccctaaatctttgatattcttataaggtttttgttttaaagcatcttaatcttttaagatactgacaccaaatgcctttaaatggcaacagatgcttacagttcagtattcttttcataagcttaggtagagcctattatcatcttgttctaaataactttccagattccatagctataagatcattccatcctacagcataagactcgttttccttatatgccgttttgtttgtgaaagaatatcaagtcaaaaatgagtgtcagcactactactgattccatgtataatgaaagtagaactttgctagttcctgaaaatttttaacttatttgtatttcagttcagcagcatctttatgtagattgtgatatttaagaattatctgggctgggcgagggtctctttttctctttcagtgatcatctaggcagttattatttaatagtttaatagctcaagtacattccaatagacgaagtgcacacaacacaatatgtgtgtacagtagtagtaaagtttcttttgagtagtcaaagactcactttttttattgcctttttttttttttttaaagaatacatactgtggattcagtcccttgtcacacttgaccttttggcatacacccactgtggacttttgcctcttctgtaatggctggcaatgacatttcaaacttacaatctggaattgcacttggtacattggcattgcttgttccactgggatggggaccagtgtgaagatgcctgttagatagactgcccacccctactttctctttttctttatagcacttaacaataacaaagtcttgatgatgtacagtattcaaactttaggttgaaatacgttactctttgattcctagccagtagatcttatctacactttaatgggagagaatggtggtgtgtgggtaggcacaaatttatgtaaatagtgctccttctctttagtatgtttgctttgggggtagaaaaatggttttaacaaacactggtttccatcaaatgaatgatgtcttctccatcctgtggagacaagaatctgctagaaggatatgtgctaagttccttataagagataatggtgctctgcctatgccagcttggcacccgaagatgtgtgagtggacgtgaggctgagtattaccttagtatttttctctgggtctttggaaaaccatagtcaatttttagaacatattgctttcattccccataaactcttcacacatgataactgtttaagctttgaaaacacatactgaagtattgtgagcttaaaaaaactttttaaatatttgcatagttttgaggtgaatttgtttccttacagatctctcctaatcattga

SEQ ID NO: 7044 - DNA, 1201 bp, Homo sapiens
caggattgaagaagaaccaagcagatacttagctgaaggggttgggcagaggacagagtgcaggtaggcaacagcatggaacccaggttttctagtcccagcacaagaaccttgacagagggtgggtaggatgttactaaggtgccaggtaggcttagaccttttttttttttttttttttccagtccccattgactgatgtggtaagttaaagtcagaattaagagaactccacaggattgaaaaagctcttcttctgagttttgcagaaggaataattttcttttttggcttactagactgactgctgtctggcaaggctagtttttattgtccttaaagctgaaagacacagagcctgcttcttcagatagcaaccggttcttagcatttgattctgggatgtaaaggatgagttcgaagtaggactaatgttgtaaaggaaaaaatgtgcttaatatatcatcaagatgattttctgcttagggtggtagcttttacatagcattttgttgttattgttagatgtatttgactctgttttcctttcttttaggagatagtgttttaggtgctggtgcctgtggtggtgttcctatcattttttctagaaacagtggactggtgtctattacttcaagggaaaatgtgtctatattggcagaagacttggaagggtctttagcatcttcagttgctggaccaaacagtgaggtaatgtgattcgataagaatttgaagtttttatgttatttattttttagagatagtgtctcacgctgtcacccaggctagagtgcagtggcacagtcgtagttcattgcagccccaaactcctggcctcaagcaatcctcctgcctcagacttcccagtaggtgcctggctaattttttgttttttggtttggtttggtttttgagacagagtctcactctgttgcccaggctagagtgcagtggcataatcatagctcactgcagcctcacctcaacctcccgggatcaagcagtcctcccctcttaacttcctaaatagctgggactacagacatgcgccatctcacctggctaattttttattttttgtagagacaggatctccttatgttgcctaggctggtctcaaactcctgggctcaagaatcctcccgcctcggcctcccaaagtgctgggattactggcgtggagccaccatgccca

SEQ ID NO: 7045 - DNA, 1123 bp, Homo sapiens
ttttataatacttttggaatttcattaataaggctaaaatttgaggaatataactaattttcagccttaagacatttaagtttggaagtccttgctattcaacagaataacaagaaaacttcagaatgtatcactctcctgaaaagaagatattaataagcccttttatttatggttatagttttatttatagtctcaaaattcctaaagcaatgctacaaccattgaatttgccatattttgtatcagtgctgttaatttgctgttgcctcaagaaaaagtgctttttctccatggatgaggctagaccctaagaagtaattaagtcaatgtaaatcaaatggaagttttcccatgaactaagcatttattagttccctgattagactggaagaagaaaccactatttcatgaaaagcatggaatattatattttattgttcataattaatgaataaaattgatatgaatgaatatagtgttctttgaattagtaaacagtacatctgtgacaatcatttttaacaagctctacttgtgttctttataaagtgtgattttcagaaagcaaacaacacaattacaaggttgaatctgaggaaaataatccttgtgccatagaagtatttacgaaattgcatttcattgttatgttttattttctgatacatgatgttcaattttatctttaggtaatattttatatcatagattaaaatttatagtgaactttatctgtgtctgtcactttttttttttttatgacccaggaaccaaagatgcagtctgtcatttcttataaaacttctcactacattgtttcttagtagaatttggctgtggagattcaggaataaagaaaagactaacattacacatatccaaaaacatgttgtaattaaaagttccattcattcctccttaccaagtttgttgaatgtcatcacttgtttgctacttacaaatattgtttaattgtttcactgcagtaaataagtatctcctacctacatcagggacaaggaactgtgctgtgaagttgatagatgagtaagccacagtttctgccctcaaggagcttctagttttgaaggagtgggaaggcaggggaaaattaataaca
